United States Patent 11,098,302 (IDENTIFICATION OF POLYNUCLEOTIDES ASSOCIATED WITH A SAMPLE) - sequence listing, part 27

SEQ ID NO: 90477 - DNA, 692 bp, Homo sapiens
  misc_feature: GYAE6OF02GGM5A.21.8.A08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacagcccacccgtggtgtcagtcgtcccaggacaacggccagactcacctgtctctggatnttcattacgacaaaagtatatacttgttcgtccagtcagagtcaggccacgccctagtactgtcatccagtgacggctaggtaccgacgacctaaccggtcccgggtacctccgtagacgtacgtatttccgtccgtcgtacccctaccaggtccccttacggacggggaacctggggttacccgtcccttaaccggttcgtaactacgtaccggtaggggttcccggggaccgtaggggtaacgtacggtagtagggaaccgtgtacgtacgtttaattaacggttccgtacgaccacgtaggtaactaggtagttacgtgtacggttacggggagggtttaacgtccggggaagggttaaccgggagttacgggtacgtaccgggttcggtttacggaccggtaaccggtcccgtaacggttccccgtcccggtaccccggttcgccgttaccggtccgtttcccccgg

SEQ ID NO: 90478 - DNA, 803 bp, Homo sapiens
  misc_feature: GYAE6OF02HFLGJ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctcggtgtcaggtcgtaccccgaggaacaaacggccaggatcacctgctcgtggagtattcattcgaccaaaagtaactatacttgttggttccaagcgaaggaagtcgacggaccccacggtcccccttaggttaaccgtcggtacctaactccgtagtcggaacggcccgaggtaccgaaccggtacgacccggttcccgggacttccccggtaggaacggtagtactttaccgtcgtccgtacccctacgtacgccgttacggaacgggtacctagggtaccggtaccctaccgtttacggtaccttagtaccggtacgggttaccggggacccggtaggggtacgggtaacggtagtacggtaacgtccgtacggtaaccgttaacgttaccggtttacggttaccgtaccgtaacccggtaagtacgttaacgggtacggttacggtaccgtaaggtaccgggttaacgggggtttaacggtaccggggtaccggggtaacgggtaccggtaccggttacggtacccggttccggttacgggtaccgtaacccggtacccggtaaccggttccgttacccggtcccccggttaccggtaccccgttaccgttaccccgtttacccccgg

SEQ ID NO: 90479 - DNA, 640 bp, Homo sapiens
  misc_feature: GYAE6OF02IATW1.21.8.A08.1.454.CMB.1.raw
  modified_base (137)..(137): a, c, t, g, unknown or other
  misc_feature (137)..(137): n is a, c, g, or t
  modified_base (169)..(169): a, c, t, g, unknown or other
  misc_feature (169)..(169): n is a, c, g, or t
  modified_base (182)..(182): a, c, t, g, unknown or other
  misc_feature (182)..(182): n is a, c, g, or t
  modified_base (211)..(211): a, c, t, g, unknown or other
  misc_feature (211)..(211): n is a, c, g, or t
  modified_base (228)..(229): a, c, t, g, unknown or other
  misc_feature (228)..(229): n is a, c, g, or t
  modified_base (299)..(299): a, c, t, g, unknown or other
  misc_feature (299)..(299): n is a, c, g, or t
  modified_base (348)..(348): a, c, t, g, unknown or other
  misc_feature (348)..(348): n is a, c, g, or t
  modified_base (461)..(461): a, c, t, g, unknown or other
  misc_feature (461)..(461): n is a, c, g, or t
  modified_base (472)..(472): a, c, t, g, unknown or other
  misc_feature (472)..(472): n is a, c, g, or t
  modified_base (494)..(494): a, c, t, g, unknown or other
  misc_feature (494)..(494): n is a, c, g, or t
  modified_base (596)..(596): a, c, t, g, unknown or other
  misc_feature (596)..(596): n is a, c, g, or t
tcagtcgtcgctcgcacgaccggtgctcgatttagcatactctacagggggctgtgggcctcaggaggtcagagctctgggaatcctcaccaatggcctggacccctctcctgcctccccctctcactttctgcacngtctctgacggccctcctatgacgctgacacngcccaccctggtntcagtcgtccccaggaccaaacggcaggntccgacctgctcgaggnnttcagttcgaccaaaagtatatacttgttgttacaagcagaagtcagccaggccctgtactgtcagtccngtgacggctagtccacgactacgtaccggcttccgtgacgtagtcttcncgtcgcctcgagctcgtacggactagttcggaccctacgtttcgaacgtttgaccgtacgggttccgggaccccgtagggacggtacgagtacggacgtcgtagacttacgtnttacggtaccncgacacgagtagtacggtgtanacggtagggacgggttacgcggggtaaccgggacgggtaccgtagggtttcccggtaacccgttcggtttaccggccgtaaccggacccgtagggttacccnccccggttacccgacccgggtcttaccccgtccgtttcccccgg

SEQ ID NO: 90480 - DNA, 853 bp, Homo sapiens
  misc_feature: GYAE6OF02HVY33.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgccctccccctcctctactttctgcacagtctcgtgacggccttacctagtgacgtctacgaccacacgtcccgtacccgttcgggtcgtacacggtccgtaccccgaaggaaccgaaaccggccgaaggtactaccgaccgttcggaccgttccggtggaagtacgttactaacgtacgaaccgtaaaaagttacgtactttacgtttggttacggtaccagtacgtaaggtaacgtaccgacggtacccgaccggtccccttagtaccggttcgtacctacgtaccgaggtacgggaccggtaccgtacggtaccgaaccggaacccgttaccgggtacccggtaccgttaccgtaggtacgtacggttaaccgtttcgtaccgtcgtaccgtccgacgtacggtacggaacggacgtacggtccgaccgttacgtaacgtacctagtaccggtacgggtccgggacgtacgggtacgaagtcgtaacgacgtcggttaactacgttaacgttccgttaacgtacccaccgaacgtaacgtacggttacgtacgtacggtctaaacggttcggggttaacggttaccgggtacggacggggtaaccgttaccggttacggttacccggttacccggttcgggttaaccggtaacccgtacccgggtaaccccgggttaccgtacccgggtttccccccgtaccggacccggttttcccgttaccgtttccccggtacccccg

SEQ ID NO: 90481 - DNA, 879 bp, Homo sapiens
  misc_feature: GYAE6OF02H3LPZ.21.8.A08.1.454.CMB.1.raw
  modified_base (166)..(166): a, c, t, g, unknown or other
  misc_feature (166)..(166): n is a, c, g, or t
  modified_base (766)..(766): a, c, t, g, unknown or other
  misc_feature (766)..(766): n is a, c, g, or t
  modified_base (859)..(859): a, c, t, g, unknown or other
  misc_feature (859)..(859): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttcctgcacagtctctgacggcctacctatcgacgctagacncacgtcccacccgtggtgtccgaggttccgtcccgaggaaccgaaacgggcctacggtactaccaccgtgtcctcgttagggactactttacgtacgttcgaaccgtaaaagtaacttattacgtttggtttagttcccgaaggtcgtaacgtacggtaccacggggacccctaccgggtaccccccgttaggttaccgttacgggtacctaaacgttccccgtaaggttaacgggaccggtacccgtaacgggtacccgtaacccggtaaccgtaccgggttaaccccggggtacctttaccccggaggtaaccggtaaaccgggttctttacccggtaccctccgggttaccccttacggaccggtttccggtaccgaaacgggtccggtaaaccggggttcccgtaccccgttaaccgtttcgaaacccgtttacgtaaccggtacggggtcccgggtacccgtacgggtacgggaccgttaggtacgacggttacgtcggtaaccttacggtttaccggttacgttaacccgcctaacgtacgacgttacggtaggttcctaggtacgttacggggttagggttacggtaccgggngggtaaacgggtaccgtacgtttacgggtcccggtttaacgtccggaacgacccgtacccggacggttccgcccccgttaccgttacccgggnttaccccgtccggttacccc

SEQ ID NO: 90482 - DNA, 726 bp, Homo sapiens
  misc_feature: GYAE6OF02IH7M7.21.8.A08.1.454.CMB.1.raw
  modified_base (335)..(335): a, c, t, g, unknown or other
  misc_feature (335)..(335): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtggtgtcagtcgtccccgaggacaaacggccaaggactcacctgctctggagattcattcgaaccaaaagatatacttgttcgtccagcagaagtcacgcacggccctgtactcgtcactccagtcgacgcagtcgacgactacgtccgggactcccgtganacgtacttccttctcgccctccgacgtacgtcgaacgggtactaggtcggaccctaccgtttcgaaccttactacgtacgggtaccggggtaccccgagggtacgggaccgtagtacggtaacgcgttacggtaaaccttaacgttagtttaccgttaaccggctaaacccgtaacggtacgttaagggttaacgttcgggtactaaggttacgggtaacggggggtttaacggttaccggggaaccggggtaacgggtaacccggttaacgggttacccggttacccgggttcccggtttacgggtaccgtaccggttaccccggtaaaggttcccggtacccggtacccccgttcccggggttacctaccccgttcgtttaccccccgg

SEQ ID NO: 90483 - DNA, 819 bp, Homo sapiens
  misc_feature: GYAE6OF02HS2A0.21.8.A08.1.454.CMB.1.raw
tcagtcgtcgctcgcacgaccggtgctcgatttagcatactctacagggggctgtgggctcaggaggcagagctctgggaatctcaccatcggcctcggacccctctcctgcctccccctcctctactttctgacacacgtcctactgacggcctctatgacgctagaccacgacgcccacccgtggtacgtcacgttccgacccgaaggaaccgaaaccggcgaaggtctaccgtaccgtgtaccgtcgtaaggacgtaacttcgtaacgttaacgaaaccctaaaaaagtactttaactttacggtttacggtttcggttaaccgaggtaaccgtaaaggtaacgtaccgaaccggtccccgtaacggtcccccgtaacggttaacgtcggtaacctaccgttaaccgacggtcggaaccggtaccgtaacggtaccggaaccgaccgtaaccggtccggtaacctacccgttaggaacggtaacgttaccgttccgtcgtaccgtaccctcgtactacgtacggaacgggtacttacgggtacccgttacccgtaccgttaacggtaccgttaacgtacgggtaccggggtacccgggtacccgggtaggtaacgggtaacggaacggtaagtaaccggtacgttaacgacccgtttagtttaacgtacggttaccgacgacctagggaaacgtgttaaggtacgtacaacggtacggttacggggtacgtacggaacgggtacgtaaccgtagtccggtaaccgtgttccgacgtccgacgtacgccctccgtaccgtcgtactcggtcctcccg

SEQ ID NO: 90484 - DNA, 781 bp, Homo sapiens
  misc_feature: GYAE6OF02GBBBS.21.8.A08.1.454.CMB.1.raw
  modified_base (217)..(217): a, c, t, g, unknown or other
  misc_feature (217)..(217): n is a, c, g, or t
  modified_base (230)..(230): a, c, t, g, unknown or other
  misc_feature (230)..(230): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctctatgagcctagaccacacgccctacccgtcggtgtccagtccgtaccccgaggaaccaaacggcaggntccacctgctcgnggactattcatacgaccgaaaagtatattacttggttaggtccagtcgagacgtcgacggtaccgacggtcccccttgtaaccgttcggtacacgtccgagttcggacgacccgtaggtacccgaacctaccgtaacccgggttccccggggaacttcccggtagtagtaacgtcctttcgtccgtacgtccctaccgagtccgtacggaacgggtactaggtaccgtacccgtaaccgttacgtaaccttacgtaccgtacggggttaccggggaccccggttaacggggtacggtaacgtacggtacgggacgtaccggtacgttaaacggttacttacggttacggttaccgtaccaaccgtacgaaccgtaggttaggtcgtagaacggtacgggtaggggttaccggttacgggaccgggtacgggtaaccgtacgggttaccggtaccggttccggttacggttacccggtaccgtacccggttacgggaccgttccccggtacccggtacccggtttacccgtacggttccccgttacccccgg

SEQ ID NO: 90485 - DNA, 796 bp, Homo sapiens
  misc_feature: GYAE6OF02ILH7O.21.8.A08.1.454.CMB.1.raw
  modified_base (131)..(131): a, c, t, g, unknown or other
  misc_feature (131)..(131): n is a, c, g, or t
  modified_base (729)..(729): a, c, t, g, unknown or other
  misc_feature (729)..(729): n is a, c, g, or t
tcagtcgtcgctcgcacgaccggtgctcgatttagcatactctacagggggctgtgggctcaggaggcagagctcgtgggaatcgtcaccagtcggcctcggaccctctctgcctcccctctctactttcngcactagtctctgacggccctactatgacgtctagaccacgtacgacccaccgttggtcgttcaaggtccgtaccgaaggaaaccgaaaccgggtcaaacggtactactaccgtacgcgttacggtaggactacgttaactaacgttaacggaaaaccctaaaaagtaattacgttattttacggttacgtaccgtaagtaacgaaggtaacgtacgtacggaccgtaccggtacccttaagttacgtacggtctaccgtacgtaaggtcggacggtacctaccggtacgaaccggacctacggttaccgggaccttaccgtaagggatacggttcttttccgacgttaccgacccgtaacggtacgtaacggtaccgggaaacgggtacgtaacggtacccggttaacctacgttaacgtacgtaacgtaccggtacgggtaccgggtcggtaacggtaacgggtaacaggtaacggaagtcgtaactacgttaacgtaacgttaacgtacaacgtaaccacgtacgtaagtagtacggactaacggtaggtacggtacggtaggaacggtacggtaacggtacgtcgtaccgggtnttaccggacgtaacggtaccgacgggtaccgtcccgttaccggtccgtaacgttccgtaccgtcccg

SEQ ID NO: 90486 - DNA, 608 bp, Homo sapiens
  misc_feature: GYAE6OF02GLVMX.21.8.A08.1.454.CMB.1.raw
  modified_base (218)..(218): a, c, t, g, unknown or other
  misc_feature (218)..(218): n is a, c, g, or t
  modified_base (506)..(506): a, c, t, g, unknown or other
  misc_feature (506)..(506): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctctatgagctgacacagccaccgtcggtgcagtcgtccccaggacaacggccagactcactgctcgtggagtntcattcgacaaaagatatacttgttcggttaccagcaagtagtacgagccgacggccccttagtacctggtacactccgagtggaacgccacggtcgacgacctaccgtccgggaattcccgtaggatacgttacttcgtaccgtcgtaccctaccgaagtcccgtaaggaacgggaccgtaggttaccggaccccttaccgtttagggaaccttacgtccggaacgggtccggggacccgtagggtacggacgagtacgacgtctagtaccttagttattcgtaccnctacagactaggtgtgtcagtcggtagggtacgtcggacggagacgtagtcgtaccgtcgttcgacacgccgaagcgtccgcccgtacgcttacgtctaccc

SEQ ID NO: 90487 - DNA, 715 bp, Homo sapiens
  misc_feature: GYAE6OF02F8CUY.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggccttcctatgagctgacacacgcccacccgtcggtgtcagtcgtcccgaggacaacggccaggatcacctgctcgtggagtacttcattacgaacctaaaagaattattacttggttcggttcagcagagtcaggccacggccccttgtactggtcacgtccagtggaccgaccgacggtaccgaccgacacccggtcggaccttccgagagtagtacttctcgtctcctaccgcgtctacggaggactggtaccgtacctccgttagtactcgttacggacggtccggggaccgtacgggtacggacgtagtacgacgtcgtacgtaaccgttaacgtttacgtttacgtaccgaccgtaaccgacggtaacgtaggttaggtcggtacctacgggtacgggggttacggggttaccgggttcggggaacggggtaaccggggtaccggtaccgggttccgtacccgggttttccggttaccggttaccggaaccggtacccggtaacgggttcccgtacccgggtcccccggttaccggtaccgttcccgttcccggtttccccccgg

SEQ ID NO: 90488 - DNA, 719 bp, Homo sapiens
  misc_feature: GYAE6OF02JVNS4.21.8.A08.1.454.CMB.1.raw
  modified_base (125)..(125): a, c, t, g, unknown or other
  misc_feature (125)..(125): n is a, c, g, or t
  modified_base (417)..(417): a, c, t, g, unknown or other
  misc_feature (417)..(417): n is a, c, g, or t
  modified_base (445)..(445): a, c, t, g, unknown or other
  misc_feature (445)..(445): n is a, c, g, or t
tcagtcgtcgctcgcacgaccggtgctcgatttagcatactctacagggggtgggctcaggaggcagagctctgggaatctcaccatggcctggacccctctcctgcctccccctctcactttcngctacagtctctgagccctctagtgagtctgaccacacgtcccaaccgttcggtagtctacggttccgtaccccgaagggaaccaaaaccggccgaagggtaacttccgaccttgcctcgtaggagtacttcgattccgaacaaagtatacttactttggttacgttccagcagtagtcgacgaccgacgccctagtacgtgtcactcagtgacgctacgaccgacacctcggtaccggactcccgtagagtacgttactcctgttaccgcccgtacaacgtcctagaacgngtacgtccgacctacctagaccttaagngaccgggtacggaccgttacgggaggaaccgtgtacgaacgtccggtataaccgttagttaacggttcgtaaccaccgttaacacgtaacgtagtacgtgtacgttcgtaacgggtacgggttacgtaccggagggtaaaccggtcgttaaaccggtccgttaccggttacggtccgggtaaccgtaacgtacccgggtaccgtaccggtaccccggttaccctcgggtttaaccccgtaccctttaggggtccccccttaacccggtcccccg

SEQ ID NO: 90489 - DNA, 671 bp, Homo sapiens
  misc_feature: GYAE6OF02H8L4P.21.8.A08.1.454.CMB.1.raw
  modified_base (132)..(132): a, c, t, g, unknown or other
  misc_feature (132)..(132): n is a, c, g, or t
  modified_base (182)..(182): a, c, t, g, unknown or other
  misc_feature (182)..(182): n is a, c, g, or t
  modified_base (247)..(247): a, c, t, g, unknown or other
  misc_feature (247)..(247): n is a, c, g, or t
  modified_base (354)..(354): a, c, t, g, unknown or other
  misc_feature (354)..(354): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
tcagtcgtcgctcgcacgaccggtgctcgatttagcatactctacagggggctgtgggctcaggaggcagagctctggaatctcaccagtcggcctcggacccctctcctgcctcccctcctcaccttttcngcaacgtcgtctcgtaggacgtccctacgtaagtgacgccgaagaccacnccgcccacccgttggtacgtcacgtccgtaccgagaaccaacggcaagctccacgtgactacggnggactacttactagtacgaaacaaaagtattaccgttacgttggttcgtaaccagaccgtaaaggacgtaccgacggcctaaccgggtcccttagtacgtacggtanaccgtaccgtagtcggaccgaagtcgacgacgcacgtcgctcgagacagttctcncgctnccgtagctaggacgtcgtcgtcgaccgttatcgaaactcgtacggtacggtaccggtcggtacggtacggtacgtacgtagaacgttctacgtaccgttacttaacgttacgtacgtacacgtaaccagttacgttagtacgtacgacggttagtacggtacgtacggacgggtacgaccgtacgtccgtacgtcgttaccgacgtacgacccgtacggccgtaccccgtacggtccgtactccggtacgttccccg

SEQ ID NO: 90490 - DNA, 681 bp, Homo sapiens
  misc_feature: GYAE6OF02GRTRH.21.8.A08.1.454.CMB.1.raw
  modified_base (104)..(104): a, c, t, g, unknown or other
  misc_feature (104)..(104): n is a, c, g, or t
  modified_base (160)..(160): a, c, t, g, unknown or other
  misc_feature (160)..(160): n is a, c, g, or t
  modified_base (184)..(184): a, c, t, g, unknown or other
  misc_feature (184)..(184): n is a, c, g, or t
  modified_base (427)..(427): a, c, t, g, unknown or other
  misc_feature (427)..(427): n is a, c, g, or t
  modified_base (519)..(519): a, c, t, g, unknown or other
  misc_feature (519)..(519): n is a, c, g, or t
  modified_base (586)..(586): a, c, t, g, unknown or other
  misc_feature (586)..(586): n is a, c, g, or t
tcagtcgtcgctcgcacgaccggtgctcgatttagcatactctacagggggctgtgggctcaggaggcagagctctgggaatctcaccatggcctggacccctntcctgcctccccctctctactttctgacacagtctctgacggcctacctatcgacnctgacacacgcccacccgtcggtntcagtccgtacccccgaggaaccaaaccggccaaggtactaccacctgctcgtaggactattcattacgacctaaaaagtaattacttaccgtttggttacggttccgagtaccgaagaacggtacgaacggcccaccggtacccctagttacgtcggtactactacctagtcggaaccggcctaggtaccgacgtaaccgccgtacccgggacctacccgtgaacgtatcttccgtccgtcncccgtacacgtcgtcggaaggacgtacggtaccgtacccgtacgttacgtacttacgtacggtacgggtccgggaccggtaggtacggacgnggttacgacgtagacgtacgttactcggtttacgaccgaccacgacggtctaaggtcgttacgtacncgggtacgagggtttcgacggtaggaccgtagacggttcgcgtacggtgtaccgtcgaccgtgcccgtaccgtcccgcttccgcgtacgtccccg

SEQ ID NO: 90491 - DNA, 744 bp, Homo sapiens
  misc_feature: GYAE6OF02FLIHX.21.8.A08.1.454.CMB.1.raw
  modified_base (183)..(183): a, c, t, g, unknown or other
  misc_feature (183)..(183): n is a, c, g, or t
  modified_base (624)..(624): a, c, t, g, unknown or other
  misc_feature (624)..(624): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcactagtctctgacggcctcctagtgagctgacacacgaccctaccctcggtntcagtcgtacccaggaaccaacggccaaggactcacctcgtctcgtaggatattacattacgaaacaaaagtaacttattacgttggttaggtacaagacgaacggtaagtcgacggacgaccggtaccccttaggtactacgggtactactaccgagtcggtaccggtacctacgggtaccgaaccggtacccgtaccggtacccgggtaaccttacccggtaggaacgtagttaaccgtttcctacggtccgtacctcgtaccgccgtaacggacggtacgtacggtaccgtacccgtaacgtttaccgaacgttacgtacgggtaccggggtaccggggtacccgtaaggggtaccggtaacgtacgtaccgggaacgtccgtacgtaacttacgttacgttacgtacgaccgtaacacggtaacgtaggtacggttnaacgtacgtagggtcggtacggtacgggacggacgtaacgtacggtaccgtacggtcgtacggacgacccggtacgtacgtccgtaccgtaccccgtcgtacctacgttccttaccccgg

SEQ ID NO: 90492 - DNA, 683 bp, Homo sapiens
  misc_feature: GYAE6OF02JSCQW.21.8.A08.1.454.CMB.1.raw
  modified_base (174)..(174): a, c, t, g, unknown or other
  misc_feature (174)..(174): n is a, c, g, or t
  modified_base (261)..(261): a, c, t, g, unknown or other
  misc_feature (261)..(261): n is a, c, g, or t
  modified_base (399)..(399): a, c, t, g, unknown or other
  misc_feature (399)..(399): n is a, c, g, or t
  modified_base (412)..(412): a, c, t, g, unknown or other
  misc_feature (412)..(412): n is a, c, g, or t
tcagtcgtcgctcgcacgaccggtgctcgatttagcatactctacagggggcgtgtgggctcaggaggcagagctctgggaatctcaccagtcggccgtcggacccctctcctcgcctcccctcctcacctttctcgcactagtctctgacggcctcctagtgagcgtgacacngcccacccgttcggtcgtcgtacgtccgtaccccgacggaaccgaaaccgggcacgggtatcctaccgtacggtctcggtagggtanatttaccagtttccgaaccaaaaaggtaacttattaaccgtttaggttccgttccgaacgcgtagtaacgtcgacggccgacggcccttgtacgtcgtacgtactccagtcgacgtcgacgtcgcgctacgcggtacncgtgagatattcnctaccgctccgacgcctacggagggactacggtccgtccaccgtttagtacctagtaccgttacgggaccgggcccgtagggtacggacgtagtacgagtcgtagtcttaacgttacgtcggtcacgtccaagtcgtagtacgtgtacgtacgtcggtagggtacggttccgggaaggtacgtacgtacgttcggtccggtacgttggtaccgacgtacccggtacgacggttcccggaccccggttctaccgtccggtacccgttcccgg

SEQ ID NO: 90493 - DNA, 785 bp, Homo sapiens
  misc_feature: GYAE6OF02JRG0N.21.8.A08.1.454.CMB.1.raw
  modified_base (269)..(269): a, c, t, g, unknown or other
  misc_feature (269)..(269): n is a, c, g, or t
  modified_base (419)..(419): a, c, t, g, unknown or other
  misc_feature (419)..(419): n is a, c, g, or t
tcagtcgtcgctcgcacgaccggtgctcgatttagcatactctacagggggctgtgggctcaggaggcagagctctgggaatctcaccatggcctggacccctctcctgctccccctcctcacttctgcacatctctgacggcctcctatgagctgacacacgtcccacccgtggtcgtcacggtcgtccccgaggaaccaaacggccgaaggactccaccctggacctcgtagggtagtacttaccagttaccggaaaccgtaaaaanaaacgtttattaaccgtttggttacggtttacccgaagtaccgaacggaaggtcgaaccggaccgtaccggtccccctaggttaccgtacgggttcctaacttccgattacggacgcccgagtaccgacgactaacgccgggtactccgngagtctattctacgtctccgtcacgcgtacgacgggtaacgtcgtacggacctacgtcgtacgtattccggtaacgggtaccggggtacctaacggggacggtaaccggtacggtaggaaacggtcggttaaccgacgttaacgttaaccgttacgtacccgtaccgaaccgacggtaaactagggttacggtaccgtacgtacggtcgggttaaggggttctttaacgggaacggggtaccgggtaaagttcgttaaccggaccgtttccgggttacggtacccttaccgggtacccgtaaaccgggttccgttccccgggtccccgttacccgggccgttacccggttacccgtttcccccggg

SEQ ID NO: 90494 - DNA, 767 bp, Homo sapiens
  misc_feature: GYAE6OF02JV39Z.21.8.A08.1.454.CMB.1.raw
  modified_base (160)..(160): a, c, t, g, unknown or other
  misc_feature (160)..(160): n is a, c, g, or t
tcagtcgtcgctcgcacgaccggtgctcgatttagcatactctacagggggtgggctcaggaggcagagctctgggaatctcaccatggcctggacccctctcctgctcccctctcactttctgcacagtctctgacgcctcctatgagtctagacacgngccctaccgtcggtgtcagttcgacccaggaacaaacggccaggatccacctgctcgtaggatacttcagtcgaaccaaaagtattattacgttggtttcgtaccaaggtcaaggtacgtcgacggtcctacggcccctaggtacgtcggtacctagtcccaaggtcggacgtaccgtaacgaccggtacgaaccgttaccggtccggggtaaccttcccggaaggtaagtaccgttaaccgttccttaccgtcccggtaccttaccggacgtacctacggggtaaccgggacgtacggtaccgggaccctttaactaccggtaaccgtaccgtcgggtaccgggtaccggggtacccgtaggggtaccgtaacggtaggtacggtaacgtcgaacgtaaccgttaacgttaacggttcgtacgtaccgaacctaaggtactaacgggttacggtagtaacgttacggtaacgggtcgggttaacggtaccggggtacggtaacgggaaccgttacggtaccgtaccgttgttacggccggtaccgtaccggtaccggtcgtcccgacccggtcgtaccgtccgttacgtccgttaccccgtccccg

SEQ ID NO: 90495 - DNA, 648 bp, Homo sapiens
  misc_feature: GYAE6OF02IGPRI.21.8.A08.1.454.CMB.1.raw
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (260)..(260): a, c, t, g, unknown or other
  misc_feature (260)..(260): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (435)..(435): a, c, t, g, unknown or other
  misc_feature (435)..(435): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcactttctgcacagtctctgaggcctcctatgagctgacacagcccacccgtcggtgtcagtcgtccccaggaccaaacggccagatccactgctcgngganattcattcgacaaaagtatatacgttgttgtccagnaagacgtcgagccgacggcccctagttacgtcgtacactacctagtcgacggccagtaccgaccgaacaccgtaccgggactccgtgagagtacttccnctcnccctacgcgtctacggacgactacgccgaccttacgtactacgtacgcggtacgggcggaccggtaggacgngtagaggtactacgtactacttaagttcttaacgcgaaaccgtcaacgtagtagttacggtacgaacgtggtaacgggttacggttaccgggcgggaacgggtaacgggttaccgttaccgggttcccggttaccggttccggtacggtacgaacccggtccgaaccgttcccgtcccgtacccggttaccgcctttccggttccgtcccccg

SEQ ID NO: 90496 - DNA, 792 bp, Homo sapiens
  misc_feature: GYAE6OF02IGGAW.21.8.A08.1.454.CMB.1.raw
tcagtcgtcgctcgcacgaccggtgctcgatttagcatactctacagggggctgtgggctcaggaggcagagctctgggaatctcaccatggcctcggacccctctcctgcctccccctcctctactttctgcacagtctctgacggcctcctatgagcgtgacacacgccaccctcggtgtcagtcgtacccgaggaacaaaccggccaggactaccacctgtctcgtggagtattctagttacgaacctaaaaagtaatattacgtttaggtttcgttaccgaagacgaaaggtaacgtacgacggaccgaccggtccccttagttaccgtcggtacacctaccgagtcggaacggacctacggtaccgacggacctaccgggtaccggtacttcccggagtacgacgtacttccgtactccggtaccttaccgacggtaccgtacgggaaccgggtaccgtacgggtacccgtaacccgttaccggttaacgtaacccgttacgtacggggtacgggggttcccgggggtaaccccgggtaagggggtaacggacggtaaacgggttacggtaaacggttaccggttaacgtaaccgttttaacgtttaacggtttaccggtaacccgaacccgtaacgtaaacggtacgttaaggttacggttacgtagttacggtacggggttaacgggttggtacgggacggtacggaacgttacggtcggtaccggtcgtccggacaccggtacgaccggtcctaccgtcccggtcgtacctccgtcttccccgg

SEQ ID NO: 90497 - DNA, 755 bp, Homo sapiens
  misc_feature: GYAE6OF02GK8IG.21.8.A08.1.454.CMB.1.raw
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
  modified_base (364)..(364): a, c, t, g, unknown or other
  misc_feature (364)..(364): n is a, c, g, or t
  modified_base (429)..(429): a, c, t, g, unknown or other
  misc_feature (429)..(429): n is a, c, g, or t
tcagtcgtcgctcgcacgaccggtgctcgatttagcatactctacagggggtgggctcaggaggcagagctctgggaatctcaccatggcctggacccctctcctgcctcccccctcctcactttctgcacagtctctgacggcctctatgagcagaccacagcccaaccgtcgggtatcaggtcgtcccccaaggaccgaaaaccggccaggactacacctgctcgnggtanattcaagttgaaccaaaaagaattagtactttagttcggttaccagctaagaagtcaggccaacgccccgtgtactcggtacactaccagtggacggactacgacgtaacgactaccgtccggactaccgngtagacggtacttcgtctacgtcgtacctacgccgtagacggacgtacgaggtaccaccgtttanaccgttaacgtcgtacgggtaccgggaccgaacgggtcggaaccggtagttacggacgtaccgtaagtaccgttaacgttaacggtttccgtttaaacggaccaccgtaaagaccgttaaggtaacgtacggtacgtacccgttaagggttaaggggtaccggtttaacggcgggggtaaacggtaaccggtttaagttaccgggttaaccgttccggttaacccggttccggaaaccggtacccggtaacgggtaccgtccccggttacccccgttaccgggtaccgttaacccgtcccgttcccgttacccccggttacccccc

SEQ ID NO: 90498 - DNA, 752 bp, Homo sapiens
  misc_feature: GYAE6OF02FQO08.21.8.A08.1.454.CMB.1.raw
  modified_base (182)..(182): a, c, t, g, unknown or other
  misc_feature (182)..(182): n is a, c, g, or t
tcagtcgtcgctcgcacgaccggtgctcgatttagcatactctacagggggctgtgggctcaggaggcagagctctgggaatctcaccatggcctggacccctctcctgcctccccctctctactttctgcacagtcctccgaggcctcctatgagtctgacacagcccacccgttcgggtntctaggtccgtaccccgaggaccgaaacggccaggactaccaccgtgtctacgtggatacttcattcgaacaaaagtatacttacgttgttcggtccagacagaagtacgacgccgacggtcccctagtcgtcggtcactaccgagtacggacggtaccgtacggtacggaccgtaaccgtaccggtaccgggtaccttcccggtacggacggtaacgtacgttacctccgtacggtccctaccgacgtccgtacgaacgggactacgggtaccgacccttaacgttacggtaacctacgtacgtacgggttccgggacccggtaggggtacggaccggtagtacggaacgtcgtacgtacgttacttaggttacgtaaccgacaaccgtataacggtaggtacggttagtacgtagttacgggtacggggtttacgtacggggacggtacgggttaaccgttaggttaccggtaccggttacggttacggtaccgtaccggtaacccggtacgtcccggtcccgtaccccggttcggtaccctacccgtttaccgtccccgttcccccg

SEQ ID NO: 90499 - DNA, 881 bp, Homo sapiens
  misc_feature: GYAE6OF02JFUUK.21.8.A08.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagcatactctacgagggggggagaggagcccagcactagaagtcggcggttgtttccattcggtgatcagcactagaacacagagactcaccagtggtagttggctgagtcgttcggttttcctcttgcttctttaagaggtntaccagtgtcgaggcacgtaacgtggtagacgtcggtaggggagtctagtcggtaccagccgttacgggacggttccctaggaccgtccttaccgtcgttacggtacgacgtaacggtcgttacgtacgtacgttacgtacgtacgtccgtccgttaccttgggtccctaattcggaccgtaaccgtcgggttacccggtcccgtacgggaccttacccgaagggtaccctaaggggggtaccttaggggaacgggttcggggttacgggtaccggttacgtttaacggtaccggttagggttaacgttacggtaacggttacggggtaaacggtacggtaaggtaaggtaacgttaacgttaacgtttaccgtaacggttaaccggttaccggtaggtaacgggtacccgtaacgtttaccgtaacccgtaacgtaccgttaaccgtaacggtaacggtaaccgtaaacgttaccgaaccgttaaaccgtaaccgtaacgtaaccgttacgtaacttacgttaacgtaaacgttacggtaacccggtaccgttacggtaacggtaaccggtaccggtaacggtaaccgtacggtaccgttacgtaacggtttaacgttaaccgtaggttaaccggtacgttacgtttaccgggtacggtaaccggtttaccgggtaaccgtaacggttacccggttaggtaccg

SEQ ID NO: 90500 - DNA, 802 bp, Homo sapiens
  misc_feature: GYAE6OF02HN1PR.21.8.A08.1.454.CMB.1.raw
  modified_base (134)..(134): a, c, t, g, unknown or other
  misc_feature (134)..(134): n is a, c, g, or t
  modified_base (371)..(371): a, c, t, g, unknown or other
  misc_feature (371)..(371): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacngtctctgagccctctatgagctgacacacgcccacccgtcggtgtcacgtccgtccccgaaggaccgaaaccggccaaggactccacctgctcgtaggatattcagttcgaaccaaaaagtaattattacgtttggttacggtccgagacagaagtcgacggccacggtcccctaggtaccgtggtacactccatcggacgccgtagtccggaacgaccgaccgtcggactacccgngaacgacgtacttcgtctaccgtcctcgactcgtacggaacgggtacgacgttaccggacccgttaccgttacggaaccgttaacgttacggtaacgggtaccggggaccccggtaaggggtaccgggtaaccggtaaggttacgggaacgtacgtaccggtaacttaacgtttaacggtttacggtttaaccaccgtaaccgaacggttaaacgtacggttaacgttcggtaacgtacggtaccgggtaagggggtttaaccgggtacggggtaccggggaacgggttaaccggttaacggttaccgggttaaccccggttcgggttaccggtacggtaacccgggtaaccccggtacggggttcccgttaccccgggtaccccccggtttacgggtacccccgtaccggttacccggtttaccccccgg

SEQ ID NO: 90501 - DNA, 816 bp, Homo sapiens
  misc_feature: GYAE6OF02HV87F.21.8.A08.1.454.CMB.1.raw
  modified_base (176)..(176): a, c, t, g, unknown or other
  misc_feature (176)..(176): n is a, c, g, or t
  modified_base (178)..(178): a, c, t, g, unknown or other
  misc_feature (178)..(178): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagttctctgacggcctcctatgagctgacacagccacctggtncngtcgcccaggacaacggcagactcacgtgctcgtaggatctatatcgaacaaaagattactacgttggttcgtaccagacgtaggtaacgtcaccggaccgtacggtccccttaggtacgtcggtactactcggaacgttggaccggtaccgacggttaccggaacccggtaaccgtacccggtacccggggtaacctttcccggaaggggtaacgtaccggttactttcccgtcgttaccggtacccttaccggacggtaccctaaacgggtacgggaccgtaacggttcccgacccttaaccggttacggtaccctagttaccggtaccggggtccgggttaccggaaggggtacgggtactaaggtaacggaccgttaacggtcggtaacttaacgttttacgttaaccgggttaaccgacctaacgacggttaaggttaacggttcgggtacggttacgtacgggtaacgggggttaaggggtttcccgacggggtaccgggttaaacggtaaccggtttacggtacccggtaccggttccggttaaggtacccggaaccgtccccgggaagggttccccgttacccggtaccccgggtttccgtaacccgtttcccggtaccgtttacccccg

SEQ ID NO: 90502 - DNA, 758 bp, Homo sapiens
  misc_feature: GYAE6OF02F7K7M.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcactgtctctgagcctcctatgagctgaacacgacgcccacccgtcggtgtacagtcgtccccaggaaccaaacggcaggatccacctgctctggatacttcattacgaacctaaaaagaattaatacgtttcggtttcgttaccaagtcgaaaggtaacggtaccgaacgggccgaacggtcccccgttagtaccgttcggtactacttaccgtagtcggacggcccaggtccggtaaccgaacctaccggtccgggtacttaccggtagaacgtacgtatttacctcgtccgacccttccgacgtccgtacgggaacggaccgtaacggtccggacccttaccgtttagaaccttacgtcggaacgggttccggggacccgtaggggtcggtaacgtaagtacggacgtccgtaactaacgtttactacgtttacgtaccgacgtaaccgtaacgagtaacgtaggtaccgtagtacgtacggggttaacggggttcgtacggggtacggaaccgggtaaccgttacggttacggttacccggttcgttacggtaccgaaccggtacccgtaaggtcccgttacccgaccccgtttcggaaccctttccgttacccggttaccccg

SEQ ID NO: 90503 - DNA, 939 bp, Homo sapiens
  misc_feature: GYAE6OF02HLDUB.21.8.A08.1.454.CMB.1.raw
  modified_base (139)..(139): a, c, t, g, unknown or other
  misc_feature (139)..(139): n is a, c, g, or t
  modified_base (158)..(158): a, c, t, g, unknown or other
  misc_feature (158)..(158): n is a, c, g, or t
  modified_base (257)..(257): a, c, t, g, unknown or other
  misc_feature (257)..(257): n is a, c, g, or t
tcagtcgtcgctcgcacgaccggtgctcgatttagcatactctacagggggctgtgggctcaggaggcagagctctgggaatctcaccatggcctggacccctctctgcctccccctcctcactttctgcacagtctcnggaggcctcctatggagtntagaccacacgcccacccgtcggtgtctacggtccgtaccccgaagggaccgaaacggccgaggtactccgaaccgtgccgtgtacgggatacttacgngttacgaacccaaaagtaacttagtttaccgttggtttcggtaccgtagacgaaggtaacgttcgaggcccgaccgggtcccgtacggtaccgttcggtacctctaccgtagttacgggaccggacctacgggtccgaaccggacccgtaccgggtccccggacgttaccccggtagtacgggacgtttacttcgttacgtaccgtcccgtctaccgttacccggacgggtaaaccgggtacggtaccggttacccggtacccgttaccggtaacttaccgtaacggtacgggtaccgggttcccggggtaaccgggtcggggtacgggtaaacggtaacggtaacgggtaacggtaccggtaacgttaaccgttaacggttttacgttaccgtaccaaaccggtaccgaaacggttacggttacggttaacgggtacggtttaccggttaagggttacccggggttaaggggttccggggtccggggtaaagggggttaacccgggtaaccgggtttaaccgggttaaaccccgggtttccccggggttttacgtaaccgggggttacccgtaaaccccgggttcccgggttaacccgttcccggggtttaaccccccggttcccccggttaaccccggttcccgggtttacccccgtttaccccggtttaccccccccgg

SEQ ID NO: 90504 - DNA, 861 bp, Homo sapiens
  misc_feature: GYAE6OF02JKMN3.21.8.A08.1.454.CMB.1.raw
  modified_base (128)..(128): a, c, t, g, unknown or other
  misc_feature (128)..(128): n is a, c, g, or t
tcagtcgtcgctcgcacgaccggtgctcgatttagcatactctacagggggctgtgggctcaggaggcagagctctgggatctcaccatggcctcggacccctctcctgcctccccctctcactttcngcacagtctctggacggcctacctatgacgtctgacaccacgtaccctccctcgggtagtctacggttccgtacccccgaaggaaccgtaaaccgggtcccgaagggtaaccttccaaccgttcgaccgttcggtagggtaacttacttaccgtaacgttacgaaacccgtaaaaaggtaaactttagtttaaccgtttttaggtttacggttaccgaaggttaccgaaaggtaacgttaccggaccggaccgtaaccggtaccccttacggtaactcgggttactaccgtaccttaaggcggtaacgtccggtaacgtaccgaaccgtacggtacccgttcggggtaacctcccggtagaacggtacgtacgtttcctaacccggtcgtaccccgtacctcgggtactaccggtaggggtaacctggggttacccgacccgtaccgtttaacgtaccgttaacggtcggtaccgggttccggggtaaccccggtagggtaaccggtacgtaaccggttaagaccggtactaaccggtaacgttaacgtacgttacgtacccgacgtaccgaaacgggtacgtacgggtacgttacggaacttacgggtacgggttacgggtaacgggttcggacgggtaaccgggaactttacgggtcgttaccggttcggttaccaccgacggttacccgaaggtcccgtacccgttcccgacgtctaccgtccgtacccg

SEQ ID NO: 90505 - DNA, 835 bp, Homo sapiens
  misc_feature: GYAE6OF02FWJ6X.21.8.A08.1.454.CMB.1.raw
tcagtcgtcgctcgcacgaccggtgctcgatttagcatactctacagggggctgtgggctcaggaggcagagctctgggaatctcaccagtggcctcggacccctctccgtcgcctccccctcctctactttctgcacgagtctcgtgacggtcctcctagtgacgtctagacacacgcccacccgtggtacgtacacgtccgtacccgaaggaaccaaccggtccgaaggtactccgtaacgtcgtaccgtgaggtacgtattaccgagttacgaaacctaaaaggtaactacgtttaccgtttggttccggttaccgacgtacgtaacgtaacggtaccgtaacggaccgtaccggtacccgtacggttaccggtacggtaccgtacgtaccgtagtacgaggtacccccccggtagtaccggtaaccgtaccgtaccgttaccggtaccgttccggtaacgacgtacggttaacttaccgttccgtaccgtaccgtaccggtaccggtaccggtaacggaacgggtaaccggtaccggtaccggtaccttacccgttacgtaccgttacgttacggtccgggtaccgggtaccggtacgggtacgggtaagtacggtacgtaacggtaccgtacgttaaccgttacgttacgttcgtacctacgtacagtaacgtacgtcggtacgtcgtacggtacgggtacgggttcggacggtaccgggtaacgtaaccgtcgttaaccggtccgttaccggtacgtaccggtaaccgtcggtaccgttaccggttaccgtacccggtaccgttccgttacgttacccgtttaccccgg

SEQ ID NO: 90506 - DNA, 713 bp, Homo sapiens
  misc_feature: GYAE6OF02FPPQO.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgacggcctcctatgagctgacacagccacctcggtgtcagtgtccccaggacaaacggccaggactcacctgctctggatattcattcgaccaaaagaatacttacttgttgttccagcagaagtcacggccacggcccctgtactggtcatccagtgacggccaggtccgacgacacgtccgggaactcccgtaggacgacgtacttcgtcgtccgtccctaccgtacgtacccgtcggaacgggactaacggtccggtaccctaaccgttcgtaactacgttacgtacgggtcgggggtaccgtaggggtacggtacgtagtacggacgtacgtcgtaacttacgttagtttacgttaccgaccaacgacgtaacgtacggtaggttacgtacgttacgtacgggtaacggggttacgttaccggggaacgggtaccgggtaaccggttaggttaccggtaacccgggttcggttacgggtacccgaccggtaaccccggtagggttccccgttaccccgggtaccccccggttaccgggttcccgttaacccggttcccgtttaccccggg

SEQ ID NO: 90507 - DNA, 1008 bp, Homo sapiens
  misc_feature: GYAE6OF02HNK8P.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctagcctccccctcctcactttctgcacagtctccgtgacggtcctcctaagtggacgtcctgaaccactacgccctaacccgttcggtcgtactacggttccgtacccccgtaagggaaccgaaaccgggcccgtaagggacctaccgaccgttcgtccgttcgttagggacgttacttactacgttaaccggaacctaaaaagtaactttaacgtttaaccgtttggtttaccgggttacccagtaaccgtaaggtaaaccggttaccgaccgggtacccggtacccggtacccccgttaggtaccggttacggtaccgtactaccgtagttacggaccggtaccgacggtaccgaccggtaaccgtaccggtaccgggtaccgttcccgttaggacgtacgttaccgtttaccgtacgttccgtacccgtaccgtacggtaccggttaccgggacggtaacgtcggttacccggtaccgttaccgttaagggtaacccttagggtaccgggtaccggggtacgggtacccgggtaagggggtccgtaaacggtacggtaacggtaccggtaaggtttaccgaaccgttttaacgtttacgggtttaccgtaccggtaaacccgtaaccgggtaccggttaacccggttaagggttaccggttaacgggtttaccgtaaaccggggttacggggggtttaacgggggtttaacgggtaacccggggggaacgggtttaacccggggtaccggttaaaccggggttccggtttaacccgggtttccggttaaccggggttacccgaacccggggtttacccggaaacccgggtttccccgggttaccccgtacccccggtttcggtttaccccggttacccttcccccggtttaaccccgg

SEQ ID NO: 90508 - DNA, 681 bp, Homo sapiens
  misc_feature: GYAE6OF02FMQT9.21.8.A08.1.454.CMB.1.raw
  modified_base (301)..(301): a, c, t, g, unknown or other
  misc_feature (301)..(301): n is a, c, g, or t
tcagtcgtcgctcgcacgaccggtgctcgatttagcatactctacagggggctgtgggctcaggaggcagagctctgggaatctcaccatggcctggacccctctcctgctcccctcctcactttctgcacagtctctgaggcctcctatgagctgacacagccaccctcggtgtcagtctcccaggacaacggcaggatcactgctctggagattcagttgaccaaaagtatatacttgtttaggtaccagtcaggtaagtcaacggccgtacggcccctagttactggtacgactccancggacggccaggtaccgacgaccaccgtaccggactcccgtaggacgagtactttcctactcgccctaccagtctacgaacgggactacggtcggaccctacgtttcgaaccgttgtaccgagggtcggggaccgtagggtacggtacgtaagtacggaacgtcgtacgtaccttaacgttaacgttcgttaccgacgtaaccgaagacgtaggttaaggtcggtactaagtaccgggttaagggggttaacgttaccgggacgggtaacgggtaaccgggttaagttccgggtacccggtttcggttacggtaccgtacggtacccgtaacggttccgtacccggtcccccggtacggttccaccgttcgttaccccgg

SEQ ID NO: 90509 - DNA, 710 bp, Homo sapiens
  misc_feature: GYAE6OF02JWXV6.21.8.A08.1.454.CMB.1.raw
  modified_base (447)..(447): a, c, t, g, unknown or other
  misc_feature (447)..(447): n is a, c, g, or t
tcagtcgtcgctcgcacgaccggtgctcgatttagcatactctacagggggctgtggctcaggaggcagagctctgggaatctcacatggcctggaccctctcctgccttccccctctctactttctgcacgagtctctgacggccttcgtatgagctagacacgagcccacccgtggtcgtactagtcgtcccgaggaccaaacggccaaggactccggacctggtccttctgggatacttaccgagttacgaaccgtaaaacgaattactaactttcggtttacggttaccaggtaccaaggtaacggtacgtaccggtaccgtaccgggtacccccgtagttcggtacgtaccgaacgttccgagtcggtaacgccgacgttacgacgaaccgaccgtccgggtagtccccgtaagtacggacgtacttacctctcgacctacncgtcacgtaagggacgtcgaccggtactacccgttcgaacttacgacggaccggtacgggacccgtacgggtacgtacggtacgtagacggttacaccggttaactcgttaacgttcggtacaacaacgtacggaacgtgtaagtcgtaactggtacggtacggtacgtcgggacggagttaacggagttacgcggttcgttaccgacggccgttaaccgacggtaccttccggaccccgttacggcttacgacgtttccccg

SEQ ID NO: 90510 - DNA, 690 bp, Homo sapiens
  misc_feature: GYAE6OF02JN09R.21.8.A08.1.454.CMB.1.raw
tcagtcgtcgctcgcacgaccggtgctcgatttagcatactctacagggggctgtggggctcaggaggcagagctctgggaatctcaccatggcctggacccctctcctgcctcccctctcactttctgcacagtctctgaggcctcctatgagctgacacacgcccaccctcggtgtcagtcgtccccaggaacaaacggccaaggactcacctgctctggagattcattcgaccaaaagtatatacttgttcgttccagcagaagtcacggccacggcccctgtactggtacagtccaagtgacggccaaggtccgacgtacaacgtcccgggatcccgtagagtaacgtattcctcgtcgcccttaccgagtcctaccgaagggacgtacggtacggtaccctaaccgtttggaaccttaacgtacgaacgggtccggggacccgaacgggtacgggaacgtaagtacggaacggtcgtacgaacgttaacgtaattccggttaacgtccaaccgaagtacctaaggttaagtacggttacaacgttcggtaagggggttaacgttcgggaaccgggtacgggtaaccgtaagggttacggtaccggttcccgttagggtacctaacggaccccggtaaggtcccgtacggtcccccgttacgggtccttaacgtcccgttacccgg

SEQ ID NO: 90511 - DNA, 821 bp, Homo sapiens
  misc_feature: GYAE6OF02JX3EA.21.8.A08.1.454.CMB.1.raw
  modified_base (124)..(124): a, c, t, g, unknown or other
  misc_feature (124)..(124): n is a, c, g, or t
tcagtcgtcgctcgcacgaccggtgctcgatttagcatactctacagggggtgggctcaggaggcagagctctgggaatctcaccatggcctggacccctctcctgctccccctctcactttcngcacagtctcgtgaggcctccgtatgagctgacacagccctacccgtcggtgtcacggtcgtccccgaggacaaaccggccaggtactccgacctgctcgtggatactttcagttcggaacctaaaagtatacgttacgttggttacggtccaagtcaaaggtacgtccgacggacccaccgggtccccttagtaccttcgggtaccaagttcccagtacggacgtacccgtagtaccgacgtaaccgtaccgtccggggactacccgtaggaacgacgttcttccgtcgtaccgcccgttaccgacgtccgtaaccggtagggtaccctagggtccgtacccgtaactttacggtaaccttacgtaccggttacgggggtacccgggtcccgtaaggggttacgtaaaccgtaaggttaccggtaacgtcggttaacgtaaaccgttaccgtttagtttaccggtaccgacgaacccgtaaggtaccgtacgtaacgggttcgtaccaacgggtttaccggggtagggtttaccgggtaccgggtaaccgggtaggttaacccgttaaggttcccggttacccgggttacggtaccggtaacggaacccggttcccggaacgttcccggttaccctacccccggttagggaccttaccccgtttaaccggtttccccgtacccccgtttaccccgg

SEQ ID NO: 90512 - DNA, 751 bp, Homo sapiens
  misc_feature: GYAE6OF02JCNWX.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctctcactttctgcacagtctctgaggcctcctatgagctgacacagcccacccgtggtgtacaggtcgtaccccaggaccaaaccggccaaggatccacctgcctcgtaggagtacttacattacgaacccaaaaagtaattacttaactttggttcggttcccaggtacaagtaacgtccgaggtccgacggtccccctaggtaacctcggttacacgtccagttcggaacggtccgtaacggtccgaaccggtaccgtaaccgtcccggggtaactccccggtgaaaccggtagtaacctttcgtaccgtgtcccctaccgtacggacccgttacgaacggggtaaccacggttaccggcccctaaccgttttacggaccttaagtccggaacgggttccggggaccccgtagggtacgggactaagtacgggaagtccgtaggtaccttacgttagtttaccgttacgaccacaaggtaccgagttacggtcggacctaggttacgggaaggggtttacgccgggtagggtacggaccgttaggtccggtacccgttccggtggtaaccgtcgtacccggtaacggccttacccggccccggttggtccctaccgttccggtttaccccg

SEQ ID NO: 90513 - DNA, 813 bp, Homo sapiens
  misc_feature: GYAE6OF02FIKFH.21.8.A08.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctggacccctctcctgctccccctctcactttctgcacagtctctgaggcctcctatgacgctgacacagcccacccgtggtntcagtcgtccccaggaaccaaacggccaggactccacctcgctcgtgggactacttcagttcgaacctaaaagaacttattaaccgtttggtttacggttaccacggactaacggtaacgtccgaacgggcccgtacgggtacccccttaggttaaccgttcggtactaaccgttacctaagttacggaacggcctaaggttacccggaaccgtaaccgtaaccggttaccccggggtaaccttccccggttaaggaacgtacggtaacttttcccgttccgtaccgtaccccgttccgaacggtcccgttacggaacggggtaccacggggttaccggtaccccttaaccgtttacgtaacctacggtaccggtacggggtccgggtacccggacggggttacggacggtagttaacgggacgtctaacgtacgttaacttaggttacgtaccgactaaccagtaacgtaggttaggtacgacgtaaggtacggtaacggggttagtaccgggacgggtaacggtaccgtaggttaccggtaacccgtttccggttaggacccgtaccggtaccggaaccggtcccggttcccggtacccccggttcgtacccggttaccttacccggttccccgg

SEQ ID NO: 90514 - DNA, 846 bp, Homo sapiens
  misc_feature: GYAE6OF02GFYMX.21.8.A08.1.454.CMB.1.raw
  modified_base (120)..(120): a, c, t, g, unknown or other
  misc_feature (120)..(120): n is a, c, g, or t
  modified_base (129)..(129): a, c, t, g, unknown or other
  misc_feature (129)..(129): n is a, c, g, or t
tcagtcgtcgctcgcacgaccggtgctcgatttagcatactctacagggggctgtgggctcaggaggcagagctctgggaatctcaccagtggcctggacccctctcctgcctcccctcnctactttcngcacagtcctctgacggtcctccgtatgaactctgacctacacgtccaccccgtggtgttcaacgttcgaccccgaaggaaccaaacgggtccaagggaccttccgaccctcggtactccgtaaggggactactttaccgaacgttcaaaacccgaaaaaagttacttaacttaccggttttggtttacggttccgtaacgtaccgtagtaaacgtacgttaacggtacccgacggtacccccgtaggttaccgttaggttacctaacgtccgtaacgtacggtaacggtacccgaacggtacgtaccggaacggtaaccgtccggtaaccgttcccggaacgtacggtaacgtaacgtttccttaacgtaccggtccctaccggtaccgtacccgtacggttacggaaccgttacggtaccggtaccgtacccgttacgttaactaccgtacggtacgggtaccggccgggtaccgtagggtaaccgaacttacgaaccggtgtaaccgtaacgttacgttagttacgttaccgacgtaacctaacggtaacttacggtacgtcgtacgttaacgacgggttacgggttacgtacgggtaccgggaacgggttaccgtagttacccggttaccggttctaccgggttaccgaacctaccgggaacgtaccgtccccggtaccccggtggtcccctaacggttccgttaacccccgg

SEQ ID NO: 90515 - DNA, 931 bp, Homo sapiens
  misc_feature: GYAE6OF02IVD0C.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcctactttctgcactgtctctgaggcctcctatgagctacgaacacagcccacccgttcggtgtcacgtccgtacccccgaaggaaccgaaaccggccctaagggacttaccgaccgttgaccttcgagggtaacgtactttcctaagttcgaaacccaaaaaaggtaaacttaactttaccgtttaggtttcggttaccgaagaccgtaaggaaacggtaccggaacggacccccgtaacggtcccccgttacggttaaccgtcgggttacctaactacccgtagttcggaacgggaccctaacggttccggaacccgaaccggtaacccgggtacccgggtaccgttaccccgtagggaacgtacgtaccgtttcttaccgtccgtaccccgttccacggtacctacggaagggtaccgtacgggttaccggtacccctaaccggtttagtaacctttaacgtaccgttaacgggggtcccggggtaccccggtaacgggggttaccgggaaaccggtaccggtaggtaaaccggtaccgggttaccgtaaccgttttaaccgttacgttttaacccggttaccggaaacccgtaccctaaacggaacgttaacggttacggttacggtaacgtaccggttacgggttaaacgggggtttaccggtacggggtaaacggggtaccggtaacgggttaccggttaccgggtacccggttccggtttaccggtaccggacccgttaaccggaaccggtcccgttaacccggtcccccgtacgggttaccctacggttcccgtttaccccg

SEQ ID NO: 90516 - DNA, 859 bp, Homo sapiens
  misc_feature: GYAE6OF02HLRRB.21.8.A08.1.454.CMB.1.raw
tcagtcgtcgctcgcacgaccggtgctcgatttagcatactctacagggggctgtgggctcaggaggcagagctctggaatctcaccatggcctcggacccctctcctgcctcccccctcctctactttctgccacagtcctcgtgacggtcccttccgtatgagctagaaccacacgcccacccgttcggtgtacgagtccgtcccgaacggaacgaaaccggacgaaggactacccgaaccgtagtccgtacgtaggacgtacttacgacgttacgaaaccgtaaaagtaactacgtttacgtttacggtttcgttaccgaacgtacgaacggtaacggtaacgaccggtaccgaccggtaccccgtaggtaccgttacggtacctaacgttacccgagtccgggaaccggtaccgaaccggtttccgaaccggtaacccgtacccggttacccggggtaccttaccccggtagtaaagtacggttaccttccgttaaccgtccgtaccccggtaaccgtcggtaacccgtacggtaaacggtacgtaacggttccgtaacccgtaaccgtttacgtaaccgtttacggtacggtaccgggttaccgggtaccgtaacggggtacggtaacggtacgtaacggtaaccgttcgttaacgacgtttacgtttacgttaccggtaacgtacctaaccgtaagtaacggtaggttaccggtagttacgtacggtaaccgggtagggttacggtacgggtacgggaacgtacggtacggtacggtcccgttacgtcgtacgaccctaaccgggactacccggtcccgtacccggtcggttacctaccggttccctaccccg

SEQ ID NO: 90517 - DNA, 739 bp, Homo sapiens
  misc_feature: GYAE6OF02IRS3B.21.8.A08.1.454.CMB.1.raw
  modified_base (172)..(172): a, c, t, g, unknown or other
  misc_feature (172)..(172): n is a, c, g, or t
  modified_base (605)..(605): a, c, t, g, unknown or other
  misc_feature (605)..(605): n is a, c, g, or t
  modified_base (615)..(615): a, c, t, g, unknown or other
  misc_feature (615)..(615): n is a, c, g, or t
tcagtcgtcgctcgcacgaccggtgctcgatttagcatactctacaggggggggagaggagcccagcactagaagtcggcggtgtttccattcggtgatcagcactgaacacagaggactcaccatggagtttgggctgagcgtgggttttcctccttgtcttactttaagnggtgtccagtgtcagggccgctaacgtgggtaggaggtcggtgggggggagcgagtggtaccgaggtccggtggggtacggttcccctggtacgtccttccgtccgttggtcgccgtacggtccgtcgtggtacttaccgtaggtacgtcgggtccttaccgtttacggccgtagtcggtccgtaccggtttcgggtccccggtacgaacggtccctaccggtacggggccggtaacggggtccgtaggggtacggttggggtcggtaccgttatttacggtggtaggttactaggtaaggtagggtaagtcggagtacgtaagttaattcgttacgacgtaccgttcggtaggtacggggtcctacgttactaccgtatccgtacgtaagaagtacaagtcgaaccgtaaaccaacgactacgtacgttaanccggttaaanacgttaccggaccgtaccgacgtaccgggtacgaccggacgaacgaccgttgattacgtagtaccgtaggaccgtgttacgttcggtactcgggtacgggtacccacgggtacccgtgtacccg

SEQ ID NO: 90518 - DNA, 886 bp, Homo sapiens
  misc_feature: GYAE6OF02F415A.21.8.A08.1.454.CMB.1.raw
tcagtcgtcgctcgcacgaccggtgctcgatttagcatactctacaggggggctgtgggctcaggaggcagagctctgggaatctcaccatggcctcggacccctctcctgcctccccctcctctactttctgcacagtctctggacggtcctcctatggacgtctgaacacacgcccacccgtcggtgtcgacgtccgtacccgaaggaacgaaccggccgaggactccacctcgcgtcgtaggatacttcagttacgaaccaaaagtattacttacgtttggtttacggtccgaagtacgaagtaacggtccgaaccggaccgtaccggtccccttaggttaccgtcggtcctacgtaccgagtcggacggaccgtacggtaccgaaccgaccgtaccggtaccgggtcctccgtaggtaacggtagttacctttccgtaccgtaccgtccgtacccgtacgtacccgtaacgggaacgggtaaccgtcgggttacccggtaacccgttacgttaacgtaaccgttacgtacggtaacggggtaccgggggtacccgggtacgggtacgggtaacggtaacggtacggtaacggtaccgtaacgttaacgttaacgtttacgttaacggttaaccgtaccgtaaccgtaacggtaacgtaacggttacggtacggtacgtaacggttacggggttaacggggttagggttaccccccccccccccccccccccccggggtaagggtaaccgggtaaccgggttacgggttaccggttaccggttaccgggttaccggttaccggtaccggtaccggtaccgggtacccggttccccggttaccccggttaccggttacccgttacccgttacccggttccccgg

SEQ ID NO: 90519 - DNA, 797 bp, Homo sapiens
  misc_feature: GYAE6OF02I6Q43.21.8.A08.1.454.CMB.1.raw
tcagtcgtcgctcgcacgaccggtgctcgatttagcatactctacagggggcgtgtgggcgtcaggaggcagagctctgggaactctcaccactggcctcggaccctctcctcgcctcccctcctcactttctgctactgtctctgaggcctcctatgacgctgacacacgccacccgtcggtgtacacgttcgtccccaaggaacgaaaaccggccgaggtactaccgaaccttcgccttcgtacgggaactacttccattacgaaccaaaaaagtaacttacttactttggttcggttaccaagtaccaaggtaacggtaccacgggtaccgacggtacccccttaggtaccgttcgggtaccaacgttcccgtaggtacggaacggtcccgtaggttaccggaacggaacctaccggtaccggggtaacttcccggtaaggaacgtacgtaccgttcctacggtcgtacccttaccgacgtactacggaaggggtacctacgggttccggaccccgtagttttaccggaacttacgtacggtaacgggtccggggacccgtagggtacggaacggtacgtacggtaacgtacgtacgtaacgttaacgttagttacggttaaccgtaccgaaccgtaaggaccgttaaggtacggttacggtaccgtaacggtacggtacggggttacgtacgggaccgggtacggtaaccgtacgttaccggtaccggttcgtacggtccgaacgtaccgtacggtccgtccggtccccgtacggtacctccgttccgtcccg

SEQ ID NO: 90520 - DNA, 647 bp, Homo sapiens
  misc_feature: GYAE6OF02G8PKH.21.8.A08.1.454.CMB.1.raw
  modified_base (482)..(482): a, c, t, g, unknown or other
  misc_feature (482)..(482): n is a, c, g, or t
tcagtcgtcgctcgcacgaccggtgctcgatttagcatactctacagggggtgggctcaggaggcagagctctgggaatctcaccatggcctggacccctctcctgcctccccctcctcactttctgcacagtctctgaggcctctatgagctagacacagcccacccgtggtcgtcacgtcgtccccgaggaccaaaccggccaggactccacctgctcgtaggacattcattgaccaaaagtatatacttgttcgtccagcagagtcaggccacggcccctgtactgtcatccatgacgccagtcgacgaccaccgtccggactcccgtagacgagtacttcctcgtcgccctaccgtacgtccttacggacgggtacacggtaccggaccctaccgttagacttacgtcgacgggttccggggcccgtagggtacggacgtagtaggtaacgcgtacgtaacttacgttagttcgtacnccgtaccagactagttagtcgtacgagtacggtagggttacgtcgggacggaacggtaacgtagttaccgtaccgttcgttacggcctaccgaccggtacggtcccgtcccggtacccccgttcggtaccctaccgtttccgttacccgttacccccttaccccg

SEQ ID NO: 90521 - DNA, 738 bp, Homo sapiens
  misc_feature: GYAE6OF02HQLHB.21.8.A08.1.454.CMB.1.raw
  modified_base (174)..(174): a, c, t, g, unknown or other
  misc_feature (174)..(174): n is a, c, g, or t
  modified_base (194)..(194): a, c, t, g, unknown or other
  misc_feature (194)..(194): n is a, c, g, or t
  modified_base (519)..(519): a, c, t, g, unknown or other
  misc_feature (519)..(519): n is a, c, g, or t
  modified_base (592)..(592): a, c, t, g, unknown or other
  misc_feature (592)..(592): n is a, c, g, or t
  modified_base (643)..(643): a, c, t, g, unknown or other
  misc_feature (643)..(643): n is a, c, g, or t
tcagtcgtcgctcgcacgaccggtgctcgatttagcatactctacaggggctgtgggctcaggaggcagagctctgggaatctcaccatggcctcggacccctctcctgcctccccctcctctactttctgcacagtcctctgacggtccctaccttatcgaggtctgaccacncgcccacccgtcggtgtacngtccgtcccgaaggacaaaccggcgaggactccgaccgtgcctcggtaggagtacttctaacgttacgaaacccgtaaaaaagtaattaccgtttaacgtttggtttacgggttacccgaaggtaccgtaaaggtaacggttacggaaccggtaccccgtaaccgggcccccggttagtaaccgtcgggttaacctaaccgtaccgagttaccgggaccggtaaccgcggtaaaccgaccggtaaccccgtacggtacccgggtactacccgtaggaacgtcgtaacttcgtctacgcctacgagtccacgaggactgcgtaccncgttatacctagtcgtagggccggacggaggacgagcaggtatacgtacgtacgtattacgtacgcgaactanaacgtagcgtttaagcgtaagtcggttaacgggtacgggttacgtacgggnggtaaccgtacgttacgggtacgtccggtagttaccgtcgaaccggcccgtaacgccggtacccgcccggttcgaccttccggtaccgtaccccg

SEQ ID NO: 90522 - DNA, 1124 bp, Homo sapiens
  misc_feature: GYAE6OF02JDL3X.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctctactttctgcacagtctctgacgcctactatgagctaggacacgtagtcccacccgttggtcgtacgacgttcgtccccgaaggaaccaaacggtccgaaggtactccgacccgttagccgttgtacgggtatactttactagttaccggaaacctaaaagtaattacgttacgttttggttccgttaccgaacgtacgaacggtaacggttaccggaccggacccgtaaccgggtcccccttaggttaaccggttaggtacctaaccgtttacccgaaggtttccgggaaccggtcccgtaacgggttaccgaaacccggtaaccgttaccccgggtaccggtaacccgtttccggaacggttaacggacgtttacctttaccggtaccttacgggtcccccttacggtaccggtacccgtaacgggtaacggggtaccgtaccggggttacccggtaaccctttaacccggttttaaccggtaacgtttaccggtaaacccgggggttcggggtttaaacccccgggggggaccccttttaaaagggggggtaccgggttaaacccggttaaaacgggtttacccgggaaaaccgttttacccgggtaaacggttttaaaacccgttttaaacgggttttaaccgtttttaacccggggtaaccccgtaaaaccccggttaacccggtaaacgggtttcgttttaaaaccggggggtttaaaggttccccggttaaaacggggtttaaccgggtaccgggggtttaaaaccggggggtttttccccgggggtaaacggggttaaaccgggggggtaaccgtttaacccggggttaaggtttacccccgggtttaaccgggttttaccggggttaaccgggttaacccgggacccggtttaaacccggggtacccgggttaaccccgtttccccgggggtttaaccccccctacgggttttaaccccgttcccggttaccccgtttttaaccccccccggg

SEQ ID NO: 90523 - DNA, 744 bp, Homo sapiens
  misc_feature: GYAE6OF02GD8PP.21.8.A08.1.454.CMB.1.raw
  modified_base (162)..(162): a, c, t, g, unknown or other
  misc_feature (162)..(162): n is a, c, g, or t
  modified_base (168)..(168): a, c, t, g, unknown or other
  misc_feature (168)..(168): n is a, c, g, or t
  modified_base (229)..(229): a, c, t, g, unknown or other
  misc_feature (229)..(229): n is a, c, g, or t
tcagtcgtcgctcgcacgaccggtgctcgatttagcatactctacagggggctgtgggctcaggaggcagagctctgggaatctcaccatggcctggacccctctcctgcctcccccctcctcacctttctgcacagtctctggacggccttcctagtgacnctgacncacgcccacccgtcggtgtcagtctcccgagaacgaacggcagatccactgctcgtggatntcatcgaacaaagatatagttgttagtccagacagaacgtcgacgccgacgccctgtactggtccactcagtggacggcgtaggtaccgaccgaccgaccgtaccgggtacctccgtaggagacgtactttcgtcgtacggtccctaccgcgtacgtacggaacgggtaacgtcggtccggtaccccttacgttacgtaacgtaccgtcgggtaccgggtcggggaccggtcgggtaggtaaccgtagtacggtaacgtcgttaaccgttacgttaacgttaccgtttaagtacccggtaccgtaaccgtaaggtaaccgtaacggttcggtaacgttacgtaacgggttacggggttaagggggtttaccggtacggggttaccggggaagggtaaccgttacgggtttacccgtccggtttaaccggttcgggtaccgtaaccggtacccggtaacggttccccggtacccgttccccggtacgtcccgtttaccgtcccgtttaccccccgg

SEQ ID NO: 90524 - DNA, 830 bp, Homo sapiens
  misc_feature: GYAE6OF02JNYKL.21.8.A08.1.454.CMB.1.raw
  modified_base (155)..(155): a, c, t, g, unknown or other
  misc_feature (155)..(155): n is a, c, g, or t
tcagtcgtcgctcgcacgaccggtgctcgatttagcatactctacggggggctgtgggctcaggaggcagagctctgggaatctcaccatggcctggacccctctcctgcctccccctcctcactttctgcacagtctctgacgcctcctatgancgtgacacacgccctacccgtcggtcgtacgagtccgaccccgaggaaccaaaccgggccaaggtactacccaccgttgtccgtccggtagggaactactttacctaagtttaccgaaaccgtaaaaaagtactttaactttaaccgttttaggtttccggttacccgaaaggtcgtaaaggtaacgtaccggacggacccgaaccggttccccctaggttaacgtcggtacctaacgtccgtaacggtggaaccggtaccacggtaccgaacgaccgtaaccgtcccgtactcccgtagacgtgtacttccgtacgtcctacccgtacctacgtaccgtacggaaccgggtattaacggggctacccttaccgtagtaaccgtttcgacggtaacggggtcccgggtaccgtaagggtaccggtacgtacgtaaacggtcgtacgtttacccgtaacgttacgttaccggtttagtacccgaacgtaaccgtaaacgcgggtttaagtaaccggttgtaaaccgtcgtacggggtacgggtttaacgtccgggtaaacggtaacgtacgttcgggttaccgtaccggtttcgtacggtacgaccggttaaccgaccggttacctacccgggttccttaaaccgcccgtttacggtcccgtttaccccggtcccc

SEQ ID NO: 90525 - DNA, 805 bp, Homo sapiens
  misc_feature: GYAE6OF02FUD7Y.21.8.A08.1.454.CMB.1.raw
  modified_base (226)..(226): a, c, t, g, unknown or other
  misc_feature (226)..(226): n is a, c, g, or t
  modified_base (259)..(259): a, c, t, g, unknown or other
  misc_feature (259)..(259): n is a, c, g, or t
tcagtcgtcgctcgcacgaccggtgctcgatttagcatactctacagggggctgtgggctcaggaggcagagctctgggaatctcaccatggcctggaccccctctcctgcctcccccctcctcacctttctgcacagtctctgaggcctcctatgagctgacacagccctaccctggtgtcagtcgtacccaggacaaacggccaggatccacctgctctggatnttcattcgacaaagaatatacttgttcgtcagnaagagtcgtagccgcggcccttgtactcggtctacgtcctagtcggacgccgtaggtacgaaccgtacgtaccggttcccgggtaccttaccccgtaggaacggttaacgttactttaccgtccgtaccgtccccgttaccacggtctaccggaacggggtcctaacggggtccgtacccctacggtttaaccgacgtttaccgtaaccgtcgggtacccggggaccggtaacggggtacggggtaaaccgtacggtaacggtaccgtacgtaacggttacgttaaaccgtttacggtttaacggttaccggtaccgtacccgtaaacggtaaccgtacgtaacggttacggtacgttacgggtacggtaccgggggttaaccgtttcgggaaccggggtaaccggttaaccgttacggttaccggtacccggtttacccggttaccgggtacccgaacccgggtaacccgttaccgggtacccggtccccggtaaccccccggttaccggttaccccgttacccggtcccgttttacccccccgg

SEQ ID NO: 90526 - DNA, 788 bp, Homo sapiens
  misc_feature: GYAE6OF02IE34J.21.8.A08.1.454.CMB.1.raw
  modified_base (134)..(134): a, c, t, g, unknown or other
  misc_feature (134)..(134): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacngtctctgacggcctctatgacgctgacacacgccctacccgtcgggtgtcacggttccgtacccccgaagggaaccgaaaaccgggccaagggactacccgaacccgttggccctttacggtagggacgtaccttttacgaacgtttacggaaaccgtaaaaaaaggtaatttaccgttaacgtttttcgggttttaccggggtttaccctaggaccgtaaaggaaacggttaccaacggggaccctaacccggggtacccccctttaggttaaccgttacgggtacctaaccttaccgtacggttacgggtaccggacctaggtccggaaccgaacccgtaccggtcccggacttacccgaggacggtagtacttccgtactcgccctacgcgccgtacggaacgggactaacgccgtacctaccgttacgacttactacgacggggtccgggaccgtagggtacgacggtacgacgacgtcgtagtaaccttagttacgttacgtaaccgaccgtacgaatacgtaggtaggtacacgtagtacgggagggttcgtacgggaagggtacgtacgtacgttccggtaccggttcgtacgtcgtaacccggacgtacggcctaccggtcccgtacggcttccgtcgttaccccg

SEQ ID NO: 90527 - DNA, 792 bp, Homo sapiens
  misc_feature: GYAE6OF02G3OOC.21.8.A08.1.454.CMB.1.raw
tcagtcgtcgctcgcacgaccggtgctcgatttagcatactctacgagggggctgtgggctcaggaggcagagctctgggaatctcaccagtggcctggacccctctccgtgccttccccctcctacactttctgcacagtctcgtgacggtcctcctatgagctagaccacgacgtcccacccgtgggtcgtctaggttccggacccccaagggaaccgtaaaccgggccgaaggactaccgaccgtcgacttcgtagggacgtacttctaggtaacaaccgaaaaagtacttacgttacgtttcggttcggttacaacgacgtaaggtaacgtaccggaacggtacccgacccggtacccccgttaggtacgttcgggtaacctaacgtccgtaacgttcgggaaccggaacccgtacgggttaccgaaaccggttaaccggaacccggttccccggaaactttccccgaggaaacggttacgtactttcccgttacgaccggtccctaccgacgtacgtcggaaacggtactcggtacgacccgttacgcgttaaaccgtgtaccggtcggggtaccgggaccggttaacgggcggtacgtaacggtaggtaaccgtaggtaccgtaagttacgttaaccgtttcggaccgtacaaccggtaggtaccgtagtaccgggtcgtacgtacggtcggttaacgggtcggtaacggacgggtacgacgtaggttacgtaccgtcggttagccgacgccggacgtccgtaccgccgtctacgcgtcgtacccg

SEQ ID NO: 90528 - DNA, 892 bp, Homo sapiens
  misc_feature: GYAE6OF02H0DUX.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctcgtggacggccttcctatgacgctgacacgacgcccaccctcggtgtcgagtcgtacccgaggacaaacggcagggactaccacgttcgctcgtacggagtacttactacgttacgaaacctaaaaacggaattaaccgtttaacgtttacgtttacgggtttaccctaacgggaacgtaaaccggaaacggtttaccggaaaccggtacccgtaaaccggggtccccccttaagggtttaaccccgtttagggttaacctaacgtttacccggtaaagttcgggaacgggtcccgtaaacggtaccggtaaaccggaaacccgacccggttacccggggtaaccttccccgtaaggaaaccggtagttaacctttccgtacccgttacggttcccctaacgtacgggtacttacggaacggtaaccgtacggtaccgaccgttaaccgtttacgaacgtacgtacgtaacgggtacggggaccgtacgggtacggtacgaaacgtaacggagtaaccgttagaaacgtttaacgttaaacgtttacgttaacggtaccgaaaccgtaaccggtaacttaaacggtagtaacggttaacgaacggttaacgggttacggggttaacggttcgggaaccggtaacggggtacccgtaaggtcggtaaccgttaaccggtttggaccgtaaccggtacccgtaacgggaccgttccggacccccgttacggtttaccgaccggttacttaccccgg

SEQ ID NO: 90529 - DNA, 885 bp, Homo sapiens
  misc_feature: GYAE6OF02FNKZK.21.8.A08.1.454.CMB.1.raw
  modified_base (175)..(175): a, c, t, g, unknown or other
  misc_feature (175)..(175): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagcccaccctggtntcaggtcgacccgaggacaaacggccaaggatcacctgcctcgtggatattcagttacgaaccaaaagtattactcgttagttcggttccagcaggtaacgtcaggacccaacggtccccctaggttaccgtcggtacctacgtcccaagttcggaaccggtccctaaggtaccgaaccgaaccgtacccggtaccgggaccttaccccgtaggtacgtaacgtacgtttacccgtcctaccggtccctaccgtaacggccttacgggaccgggtaactacgggttaccggtaccccttaacggtttacctaacttaaccgttacggtacggggtaccgggggtaaccccgtagggtaccgggtaaccgtacggttaacggtaacggtccgtaacggttaacccgttaacgtttaccgtttaccggttaaccgaaccgtaccgaaacggttacggtaaacggttacgggttaacgttaccgtaaacggggttacgggttaaaccggggggtttcgttaaacccgggggtacgggttaaacccggggtaaccggttaaccggggtttaaccccggtacccggggttttaacccggtacggggttacccggtaaaccccggttacccgggtaaacgggttcccccgttacccccgggtacccccgggtttaacccgggtacccttaacccggttttcccggttaccccccgg

SEQ ID NO: 90530 - DNA, 982 bp, Homo sapiens
  misc_feature: GYAE6OF02IROMK.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctcgtgaggcctcctatgagctgacacagcccacctcggtcgtcagtcgtccccgaggacgaaaccggccaggactcacctgctactaggacgtatcattagacctaaaagaattactacgttcgttggttccagtacgtaggtaacgttcgaacggacccgaccggtaccccgtacgtaccgtcggtactaccgttaccaacgttcggaaccggtacccgtaacggtaccggtaaacccgtaccgaaccccggttaccccggggtaccttacccccggtaggtaaccgggtaacggttaccgtttacccgttacctcccggtccccgtttaccgacccggtacgtccggtaacggggtaaccggaccgggtttaccggtacccctttacccgttaccgtttaaacgtttaccgtacggttacccggggtttaccgggggaccccggttaggggtacccgggtaaaccgtaacggtaccgggtaaacgtacccgggttaccgtaaaccgttttaaccggtttaacggttttaacccgttacccggtaacccgtaaacccggtaaaggttaacccggttaagggtttaaaccggttaacgggtttacgtaacggtttaccggggtaacgggggtttttaacccggttaccggggtaaccgggggtaaaccgggttacccggttaagggttttccccgggtaaaaccccggggtttccgggttttacccgggtaaacgggtaccccggttaccccggaccggggtttacccccggttaccccggttacccccccggtttaaccgggttacccctttacccccgggtacccttttttaccccccccggg

SEQ ID NO: 90531 - DNA, 814 bp, Homo sapiens
  misc_feature: GYAE6OF02GI578.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgacggcctctatgagctagacacacgccctacccgttcggtcgtcgagtccgtccccgaaggaaccgaaaccggcccgaaggactccacctgtcctcgtagagtacttcattacgaaccaaaagaacttaacttacgtttggttacggttaccacggtacgaaaggtacgtaccgacggaccccgtaccggccccgttacggttaaccgttcggtcctaaccgtacccgtaggttacggaccgggtaccgtaacggtaccggtaaccggtacccgtaccggttacccgggtacgttaccccgtaggtaacggtaacgttaccgtttccgtaccggttaccgtccccttaaccgacgttacccgttacggaaccggggtaactccggggtaccggaaccccttaccggttacgaaccgttacgtaccgggtacggggtaccgggaccggtacggggtacggaccgtagtacggaactaccgtaacgtaccttaacttacggtttacgtaccgtaccgtaccgaacgtacgtaaggttaggtaccgttacgaggttacgggtagggttcgggtacgggacggtacgaacgttaggtaccttccggttcgtacggtacgaccgtaccggtacgtcccgtccggtaccccgttagtccccgtacgtcccgttaccccg

SEQ ID NO: 90532 - DNA, 717 bp, Homo sapiens
  misc_feature: GYAE6OF02GVN7X.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctcctcactttctgcacagtctctgacggcctcctatgagctgacacagccaccctcggtgtcagtcgtccccaggacaacggccaggatcacctgctcgtggagtattacattcgaaccaaaagtaatacttaacgttgttggttccagcagaagtcaggccaggcccctgtacctggtcacgtccagtcgacggccagtcgacgactaccgtccgggactcccgtaggacgagtacttctcgtcgtccctccgagtcctacggacgggaccgagttcggaccctaccgtttcgaactacgttaccggtaagggtccgggggacccgaggggtacgggaaccggtacgttacggaaacggtccgttacgaacctttaaccgtagttttacgttaacccggtcgaacccgaggtaaaccgtaaggggttacgttcgggttactaacgttacgggtaacggggggtttaacgttaccgggggtaccggggtaacgggtaaccgtaacggttccggtaacccgttccggttagggtaacctaccggtacccgtaacggtccgttacccggtccccgttaccggtcctaccgttccgttaccccg

SEQ ID NO: 90533 - DNA, 836 bp, Homo sapiens
  misc_feature: GYAE6OF02IT3Q7.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtcggtgtcagtcgtccccgaggaccaaacggccaggactcaccgtgcctcgtaggatacttcattcgaacctaaaaagtaattacttaaccgtttggttcggttaccgagtacgaacggtaacgtccgaacggtccccgaacggtccccccgttaggttaaccgttcgggtacctaacgttacccgtaagttcgggaaccggtacccgtaacggttcccggaaaccgtaacccgtaacccggttacccggggaaccttccccggtaggaacgtacgttacgttccgtcgtacgccccttaccgacgtaccggtacgaagggtacctacgggtaccgtaccctacggtttacgaacgttacgtaccgacgggtccggggacccgtaggggtacggtacgtaaggtacggtaacgtcgttaacggaaccgtttaacgtttacggttaccgttaaccgcgtaaaccgaggtaaccgttaaggttaacggtcggtaacctaggttacggggtacggggttacgttacggggaccgggtaacgggtaaccgttacgggtaccggttacccgggtttccggttacgggacctaaccgggacccgtaacgggttcccgtaccccggttccccggttaccggcccgtttacccgttcccggtttcccccgg

SEQ ID NO: 90534 - DNA, 750 bp, Homo sapiens
  misc_feature: GYAE6OF02IIL98.21.8.A08.1.454.CMB.1.raw
  modified_base (106)..(106): a, c, t, g, unknown or other
  misc_feature (106)..(106): n is a, c, g, or t
  modified_base (450)..(450): a, c, t, g, unknown or other
  misc_feature (450)..(450): n is a, c, g, or t
  modified_base (574)..(574): a, c, t, g, unknown or other
  misc_feature (574)..(574): n is a, c, g, or t
  modified_base (584)..(584): a, c, t, g, unknown or other
  misc_feature (584)..(584): n is a, c, g, or t
tcagtcgtcgctcgcacgaccggtgctcgatttagcatactctacagggggctgtgggctcaggaggcagagctctgggaatctacaccatgggcctggacccctntcctgcctcccccctctcactttctgcacagtctctgaggcctcctatgagctgacacgagcccaaccgttcggtgtacagtcgtccccaaggacgaaaacggccaggtactcacctgactcgtaggatacttcagttcgaacctaaaaaagtatacgttaacgttggtttacgttacccagacgaagaagtaccgacggcctacggtccccttaaggtaccgtggtacctaacgtccaggttaccggaggtccccgtaaggtaacccgacggtaaccaccggttaccgggaacctttacccggaggtaaccgacgtatttcccgttgaccgcccggttaaccngtcctaaggacgggtaactaacggtcgtaccccgtaacgttggaaccctacgttacgaagggtcccgggaacgtacgggtacgacggaagtacgaaggtcaacgtacttacgttagttacgtanaccgacgaanacgtatacgtacggtataacgacggggtacgggtaaggtcggaccgggaagacggtaacgttcggtaacccggttcgttaccggacctaaaccgggtaccccgtaaggggtcccctttacccgggacccccgttacccggtacttacccgttcccgtttaccccgg

SEQ ID NO: 90535 - DNA, 808 bp, Homo sapiens
  misc_feature: GYAE6OF02H6C8C.21.8.A08.1.454.CMB.1.raw
  modified_base (134)..(134): a, c, t, g, unknown or other
  misc_feature (134)..(134): n is a, c, g, or t
  modified_base (516)..(516): a, c, t, g, unknown or other
  misc_feature (516)..(516): n is a, c, g, or t
tcagtcgtcgctcgcacgaccggtgctcgatttagcatactctacagggggctgtgggctcaggaggcagagctcgtgggaatctcaccatcggcctcggacccctctcctgcctccccctcctctacctttcngcacagtctctgacggcctcctatgacgctacgaccacacgccctacccgtcggttgtccgagttccggtacccccaagggtaaaccgaaaccggccgagggtactccgaaccttgtccgttcgtagggactaactttcaagttaccgaaccaaaaaagtacttactacggttttcggttacggttcccaaggacctaacgggaagtaccgtagggacccacgggttccccctaggttaccgttcggactacttcccaggttacggacgtcccgtagggtaccgaccgaccgttaccggacccggggttacttaccccggtgaacggacgtttacttccgtcgttaccgtccccacgttacgtcgtaaccggagggtaaccncggttcgaaccctacggttactactacgtacggcggtacgggaccggaggtacgacggtagtactaaggtccgtagtacctaacgtttagtccgttaacgccgtaaaccgtagtaacgcggttaacggtcgtacaacgggttcgggaacgggtttacggtccgggaacggggtacgttaacgtacgggtttaccgtacccggtttcggtaccggtacgtaccccggtacgtaccggtttacgccccgggttaaccccggttccggtaacccttcccgtccggtttacccccg

SEQ ID NO: 90536 - DNA, 905 bp, Homo sapiens
  misc_feature: GYAE6OF02GPBZC.21.8.A08.1.454.CMB.1.raw
  modified_base (460)..(460): a, c, t, g, unknown or other
  misc_feature (460)..(460): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctgacacacgcccacccgtcggtgtctagtccgtccccgaggaccaaacggccgaggactccaccgtcgtcctcgtcggatacttcagttcgaaccgaaaaagtaattacgtttaacgtttggtttacggttcccgagtaccaagtaacgtccgtaagggaccccgaccggtcccccgttaggttaacgttcggtacctaactcccgtaagttcggaaccggtccgtaggtaccggaacccgaacgtacccggttacccgggtaacttccccgtaggaacgtacgtactttacccgtggtacccnccccttacgacggtcccgtacggaacggaccgttaggggtaccgtaccccgttacccgtttagaacccgtttacgtaccggacggggtttacccgggggaccccgtaaggggttaccgggtaaaccgtaggttaacgggtaacgttacccggttaccggttaaaccttttaaaccggtttaacgttttacccggtttaaaccggacccgttaaccccggaaagggttaaccgttaaggggttaaccgttacgggtacgtaaaccgggtttcgggggttaaagggggtttcccgtaacgggggtaaccgggtaaaccgggtaccgtttaacgggttccccgggtaccggtttccggttaaccgggcccgtaacgggtaccccgacggttcccgttacccccggtccccgttacgggtacccttacccgttcccggtttccccccgg

SEQ ID NO: 90537 - DNA, 773 bp, Homo sapiens
  misc_feature: GYAE6OF02HVVD0.21.8.A08.1.454.CMB.1.raw
  modified_base (127)..(127): a, c, t, g, unknown or other
  misc_feature (127)..(127): n is a, c, g, or t
  modified_base (717)..(717): a, c, t, g, unknown or other
  misc_feature (717)..(717): n is a, c, g, or t
tcagtcgtcgctcgcacgaccggtgctcgatttagcatactctacagggggctgtgggctcaggaggcagagctctgggaatctcaccatggcctggacccctctctgcctcccctctctactttcncgacacagtctcgtaggacgtccctctagtgacgctacgaccacgacgccctaccgttcggtcgtaccgagttccggacccgaacggaaccgaaaaccggccgaaggtacctacctaccgtcgtccttacggaggtacttactataacgttacgaaacgtaaaatagttaacttacgtttgttacggttaccgagtacgtaagaacgtcggacgcccggaaccggtcccgttagttaccacgggtacctaactcgtaggtacggacggtacccgaggttaccgaaccgtaaccgtacgtaccgggtacttaccggagtacggtacttcgtaccttcccgtagtccccgtacgaggttccccaaggaacgggaccttagccggtaccttaccgttgaaccttagtcggtacgggtaccgggacggtacggacggtacgtacgtaagacgtacgtaagtaccgtttaacgttagttaacggttaccacgtaccaacgtacgtaagttggtaccgtacggtacgtcgggtaacgggttacgcggggacgtaagggtaccgtaggtttacggaccggtttcggtacgggtaacnccggtaccggtaccgtccgaccggttacccggtctacgtcccgttacgtcccccgg

SEQ ID NO: 90538 - DNA, 982 bp, Homo sapiens
  misc_feature: GYAE6OF02GSZD3.21.8.A08.1.454.CMB.1.raw
  modified_base (129)..(129): a, c, t, g, unknown or other
  misc_feature (129)..(129): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttcngcacagtctctgaggcctctatgagctgacacacgcccacccgtcggtgtctagtcgtaccccgaaggtaaccaaacggccaaggactccgacctgcttccgtggagtacttcattacgaaccaaaaagtactaattacgtttggttacggttaccaagcgaagtaacgtacgaacggtccctacgggcccccttaggtacgtcggtacaccgttccgaagttcggaaccggtccaagggtccgaacgaacccgtaccgggtaccggggtaactccccggtaggaacggtacgttaactttccgaccgttctaccccgtaccgtacggtacccgtaaccgggaacgggttaaaccgtcgggttaccccggggtaaccccgtttaacccggttccggtaaaaactttacccgggttaccgggtaacggggggttaaccccgggggtacccggtaaagggggttacccgggtaacggggttaaacgtacggggttaaaccgggtacccgtttaacggaaacccttttaaggtttaacccgttttaccgggttaaacccgacccgtaaacccggtaaacggtaacccggttaaagggtttaccggtaccgggtaaaccgttacgggttaaaccggggttaccgggggttttaaaccgggttaaccggggggtaaccggggtaaaccgggttaacggttaaccccgggttaccgggtttaccccggtttaaccggggtttacccgggttaacgtaacccccgggtaaaccgggttaaccgggtaccccgtttacccccggggtaacccccggtttaacccggtttcccggtacccttaccccgggttttacccccgg

SEQ ID NO: 90539 - DNA, 780 bp, Homo sapiens
  misc_feature: GYAE6OF02F2NMI.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctctcactttctgcacagtctctgaggcctcctatggagctcgacacacgcccaccctcgggtgtcaggttcgtaccccgaggaacaaaccggccaaggactccaccgtgcctcgtaggagtattcattagaccaaaaagattaactacttgttggttccagtcaagacgtacaggaccacggccccctagttaccgtaggtcacgtaccagtcgacggcccgtaacggtcggaacgacctaacggtcccggggtaacgtcccgtacggaggtaacgttacgttaccgtcttacgcctacccgaggtacctccggtaagggactacgggtacggtcccctaacgttcgtaaccttaacgttcgtaacggggtccgggggtacccgtaagggtcgggtaacgtaagttagggaactcggtacgtaacgttaacgttagtttacgtaacgtaccgaaccgtaacgaccgaaggtttacggtaccggtttataacggttaccgggttaaggggggttaaacgttcccgggggtaacgggtaacggggttaaccgtacgggttaccgggtaaccggtttcccgggtttaaccggtcggtaacccgtaccggaacggtccttacccgggaccccccgttcggtaccgtacccgtacgttttccccccgg

SEQ ID NO: 90540 - DNA, 707 bp, Homo sapiens
  misc_feature: GYAE6OF02IEM1B.21.8.A08.1.454.CMB.1.raw
  modified_base (129)..(129): a, c, t, g, unknown or other
  misc_feature (129)..(129): n is a, c, g, or t
  modified_base (135)..(135): a, c, t, g, unknown or other
  misc_feature (135)..(135): n is a, c, g, or t
  modified_base (229)..(229): a, c, t, g, unknown or other
  misc_feature (229)..(229): n is a, c, g, or t
tcagtcgtcgctcgcacgaccggtgctcgatttagcatactctacagggggctgtgggctcaggaggcagagctctgggaatctcaccatggcctcggacccctctcctgcctccccctctcactttcngacacngtctctgacggcctcctatcgacgctcgacacacgccctaccgtcggtgtcagtccgtacccgaggaaccaacggccaggactcactgcgtcgnggactattcagttacgaacaaaagtattacttacgttgtcgttacagtacagacgtacgacgaccgcgtcccgtacgtacgtcgtactactccgtacgacggtacggtacctacggtaccgaaccggaacctccggtaccgggtaaccttccgagggaacgtactcttaccgtgtcccgaccttacgccgtccgtaacggacggactaacgtcgacccttcgagtcgttagtacgcgggtacggaccgtagggacgacgtagtacgagtcgtacgtaacgttcgttacgttaccggtcgacaccgtaacgtagtacgggtaagttccgtacgtacgtacggggtagggttaccgggttcggaccgggttaccgggaacgttaccggttaacggtccccggttacgttacggtaccgacgtaccccgttaggcccgttccccgttacccgtcggtaccttaccggtcccgtttaccccg

SEQ ID NO: 90541 - DNA, 960 bp, Homo sapiens
  misc_feature: GYAE6OF02IUW9A.21.8.A08.1.454.CMB.1.raw
tcagtcgtcgctcgcacgaccggtgctcgatttagcatactctacagggggctcgtggggctcaggaggcagagctctgggaatctcaccagtggcctggacccctctcctgcctccccctctctactttctgacacgagtcctctggaggtccttcctagtgacgtctagaaccacgaccgtccccgtaacccgttcggggttactcggtaccggttccggtaaccccccggaaggaacccggtaaaccgggccgaaagggtacttacccgaccccgttgacgttacggagggtattacttaccgaagttaccgaaacctaaaagtattacgtttacgtttagggttacgttacgaagtacgtaacggtaacgaccgacggaccctacccgggcccttaagtacggtcgtacctacttaccgtagacgggtacgaccggtaccgtaaccggaaccgtacccgtaacccgggtaccggttactacccggtaggtaacggttaacgttcctttcccggttaccgtacgtacccccgtacgtaaccggtccgtaacggaacgggggtactacgggtcccgttaacccgttacgttagggtaacccttacgggacgggttaccgggtacccggacgggttaacgggtacgggtataacgggtaacggacgtttaaccgggtacgttaaaccggtttacttttaaaccgggttaccgggttaaccaacccgggaaacccttaacggggttaggttaaccggttacggttaccggtaccgtaaggggttaaccggggtaccgggggttttaagaaccgggggacggttaacggggtaacccgttacgggtccccgttaacgggtttcgggtacccgtaccgggtaccccgtaaccgggtacccgttccgggttaccccctacccgggttacccgtaactttcccccggttaaccggttacccccc

SEQ ID NO: 90542 - DNA, 840 bp, Homo sapiens
  misc_feature: GYAE6OF02GQ9RX.21.8.A08.1.454.CMB.1.raw
  modified_base (133)..(133): a, c, t, g, unknown or other
  misc_feature (133)..(133): n is a, c, g, or t
  modified_base (160)..(160): a, c, t, g, unknown or other
  misc_feature (160)..(160): n is a, c, g, or t
  modified_base (375)..(375): a, c, t, g, unknown or other
  misc_feature (375)..(375): n is a, c, g, or t
tcagtcgtcgctcgcacgaccggtgctcgatttagcatactctacagggggctgtgggctcaggaggcagagctctgggaatctcaccatggcctggacccctctcctgctccccctcctcactttctgcacngtctctggacggtcctctatgagtctnacacagcccaccgtcggtgtctagtcgtccccaggaccaacggccaggacttcgacctggctcgtaggatacttcgtagttccgaacctaaaaaaggtaacttacgtttaaccgttttggtttaccgggttaccaacggttacgaaaggtaacggttaccacgggtaccccgaaccgggtccccttggtaaccgttcgtactacgtcctaacggnggaaccggtccgtacggtacccggaccgtaacccgtaccggttcccgggtaacttccccggagtaaggtaacggttcttccgtacgtccgacccttccgaacggtcctacgggggaaccggtacctacggtcccggtacccttaccggttactaaccgtttacgtacggtaccgggtccgggtacccgggtacgggtaacggaacggtaagtacggtaacggtacgtaccgtaacgttacgttacgtttaccgtaccgtaccgtacgtaacgtaacggtacgttacggtacggttacgtaacgggtcgggttaaccggggttacgggtaccggaaccggggtaaccggtaccggttacggttccggtaccggttcccggttaccggtaccgtacccggtaacccggtaccggttccgtaccccggtcccgttaccgggtcccgttacccgtcccggttaccccgg

SEQ ID NO: 90543 - DNA, 971 bp, Homo sapiens
  misc_feature: GYAE6OF02ITLKB.21.8.A08.1.454.CMB.1.raw
  modified_base (141)..(141): a, c, t, g, unknown or other
  misc_feature (141)..(141): n is a, c, g, or t
  modified_base (512)..(512): a, c, t, g, unknown or other
  misc_feature (512)..(512): n is a, c, g, or t
tcagtcgtcgctcgcacgaccggtgctcgatttagcatactctacagggggctgtgggctcaggaggcagagctctgggaatcctcaccatggcctggacccctctcctgcctccccctctctactttctgcacagtctcngaggtccctcctatgagtcgtagacacacgccctacccgtggtctcgtagtccgtacccgaggtaacgaaaccggcgaacggactaccgtactcgccttacgtaggacgtacttacgtacgttaacgaaacctaaaaagtaaactttacgttaaccgttttaggtttaccggttaaccaacggtacgaaaggttaacggttaccgaaccgggtaccccgtaaccggcccccggtttacggttaccgtacggttacctaacggtaccctaacggttagggaacccggtaccggtaaccggtaccggtaaacccgtacccggtaaccggtccccggggtaaccttccccgaaggtacggtaactaccgtttcnccgtaccggtaccctaccgacgtacgtaccgggaacgggtaactacggtaccgtacccgttacgttacgtaaccgtaggtacccggtaaggggtacccgggtacccggtaagggtaaccggtaactaacggtaagtaacccggtagttaccgtaaccgtttaaacgttacggtttaccgttaacccgaaccgtaaccgtaacggaaacggtttacgttaacggggttacgtaaccgtttaacgggggaacgggtttaaccgggggttaaagggttaccccggggtaaaggggtaaccccgggttaaaccggttaaccggtttccgggttaaccccgggttttaacggtcccgggttaaacggtacccccggaaccggtttaaccggggccccgtttaacccccgggtccccggttaccggttaaccccgtacccgggtttcccctttaacccccccggg

SEQ ID NO: 90544 - DNA, 911 bp, Homo sapiens
  misc_feature: GYAE6OF02IYEQR.21.8.A08.1.454.CMB.1.raw
  modified_base (133)..(133): a, c, t, g, unknown or other
  misc_feature (133)..(133): n is a, c, g, or t
  modified_base (160)..(160): a, c, t, g, unknown or other
  misc_feature (160)..(160): n is a, c, g, or t
  modified_base (226)..(226): a, c, t, g, unknown or other
  misc_feature (226)..(226): n is a, c, g, or t
tcagtcgtcgctcgcacgaccggtgctcgatttagcatactctacagggggctgtgggctcaggaggcagagctctgggaatctcaccatggcctggacccctctcctgcctccccctctcactttctgcacngtctctgagcctctatgagctgacacncgcccacccgtggtcgtcagtccgtccccgaaggaaccaaacggccaggactccgacctcgctcgnggatcttacgtattacgaaccaaaagtattattacgttggtttacgttccaagaccgtaagtaacgtaccgacggtaccctacgggtcccccttaggttaaccgtgggtacctaacgttacccgaagtcgggaccggtaccgtacggtacccgtaccggaacccgtacccggtacccggggtaacctcccgtaacggtaagtaaccgttacgttcccgttccgtacccgtaccccgttaccggaccgtacccgtaacccgggtaacgggtaccgtaccgttcccggtaaaccccgttacgtttacccggtaaacctcggtttacggaacccgggggtcccgggtaaccccgttaagggggactacccgggttaagtacggtaacgtccggtaaaccggttactttaacggttacgtttccggaacccgtaccaaccggtaaccggttaagtccgggtttaacggtaccgggttactaacggggtttaccggggtaacgggggtttccggtacccgggaaaccggggttaacggtaacccggtttaacgggtaccccggtttaccggggttacccggtttcggaaacccgtacccggttaccgggtaacccggtccccgtttccccggaacccccgggttttccggtaaccggtttcccccgtttacccggttttaacccccccgg

SEQ ID NO: 90545 - DNA, 754 bp, Homo sapiens
  misc_feature: GYAE6OF02FJCSU.21.8.A08.1.454.CMB.1.raw
  modified_base (228)..(228): a, c, t, g, unknown or other
  misc_feature (228)..(228): n is a, c, g, or t
  modified_base (268)..(268): a, c, t, g, unknown or other
  misc_feature (268)..(268): n is a, c, g, or t
  modified_base (404)..(404): a, c, t, g, unknown or other
  misc_feature (404)..(404): n is a, c, g, or t
  modified_base (513)..(513): a, c, t, g, unknown or other
  misc_feature (513)..(513): n is a, c, g, or t
  modified_base (689)..(689): a, c, t, g, unknown or other
  misc_feature (689)..(689): n is a, c, g, or t
tcagtcgtcgctcgcacgaccggtgctcgatttagcatactctacagggggtgggctcaggaggcagagctctgggaatctcaccatggcctggaccctctcctgctcccctctcactttctgcacagtctctggacgcctcctatgagctgaccacacgcccaccgttcggtctacgacgtccgtaccccagggaccaaacggctaggactcactcgctcgtgagtntactactgacaacgaatacttacttcgttggttaccgtanacgaacgtagtacgtacggccgtacgtccccgtacgtacgtcggttacgacttcctagcggtacggccgacggtacgtaccgaaccgtaccgtaccggtacgtacctcggtaggaactcgttacttcctacgtccnccgtacgtaccggtcaacgggacgtacgtacggtacccgacccgtttaacgtaccggtaacttccgtacggggtaccgggtccggtaccgggtaaggtacggtaaaccngggtaactacgggtactaaccgtaacgtttacgtttacggtacgaccacgaaccgttagacgttacggtacgttcgaaggtttccgggaaggggtttaccgggttagacccgggttagggaccgtaacgttcgggtaccccgtaaccggttggtaccgtccggaaacccgggttanaccccgggttccgtaccccggttcggttaaccctcctacccgtacccggttttaccccaccccgg

SEQ ID NO: 90546 - DNA, 613 bp, Homo sapiens
  misc_feature: GYAE6OF02GKSZI.21.8.A08.1.454.CMB.1.raw
  modified_base (227)..(227): a, c, t, g, unknown or other
  misc_feature (227)..(227): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
  modified_base (585)..(585): a, c, t, g, unknown or other
  misc_feature (585)..(585): n is a, c, g, or t
tcagtcgtcgctcgcacgaccggtgctcgatttagcatactctacagggggctgtgggctcaggaggcagagctctgggaatctcaccatggcctggacccctctcctgcctccccctcctcactttctgcacagtctctgaggcctcctatgagctagacacacgcccacccttcggtgtccagtcgtcccccgaggacaaacggccaggatcacctgctctgganattcattgaccaaaagatatacttgttggtccagcagtaagtcaaggccacggcccctagtacctggtacatccattcggacgccaagtccgaacgaccacgtccgggcttcccgtgaacgtacgactttctacgtctcccgtcacgtctacgaggtacagtcggaccctaccgttnaactntacgaggtcggcccgagggtacgacgagtacgagtaccgtagtaccttaagttattacggtaccgaccgaccgagtactaggttacgttaggtcaacggtacggtaggggttacttacgggcgggtaaccgacgttagtcgtaccggttcgtaggtccgaacgtaccgaacgtccnccggaccccgttcgactccgtcgtcccg

SEQ ID NO: 90547 - DNA, 774 bp, Homo sapiens
  misc_feature: GYAE6OF02FSWS4.21.8.A08.1.454.CMB.1.raw
tcagtcgtcgctcgcacgaccggtgctcgatttagcatactctacagggggctgtgggctcaggaggcagagctctgggaatctcaccatggcctggaccccctctcctgcctcccccctcctcacttttctgccacagtctctgaggcctcctatgagctgacacagcccaccctcggtgtcagtcgtccccgaggaaccaaacggccaaggactcacctgctcgtggatattcattcgaccaaaagatattacgttgttcggttccagcaagaagtcaggccacggcccctgtactggtcactcctagtggacggcctaggtacgacgaccacgtccgggactcccgtaggacgacggtactttccgtccgtcgtccctaccgaggtcctacggagggaaccgtaggttaccgggtaccctaaccgtttcggtaaccgtttactccgggtaacgggttccgggggaccccgtaagggggtaccgggtaacggtaacgttacgggtaaacgtccgtacggttaaaccttaacgtttaacgttttacggtaacccgtacccgaacccgtaacggtaacgttaagggttacggttacgggtacgtaacggttacggggttaagggggttcggtccggggtaacgggtaacggggaaccgttaagggttccggttacccggttcgttaccgggttaccgaaccggtacccggtacggttacccgtcccggttccccccgttaccgggtcccttacccggttcccgtttccccccgg

SEQ ID NO: 90548 - DNA, 823 bp, Homo sapiens
  misc_feature: GYAE6OF02FRTLB.21.8.A08.1.454.CMB.1.raw
  modified_base (178)..(178): a, c, t, g, unknown or other
  misc_feature (178)..(178): n is a, c, g, or t
  modified_base (224)..(224): a, c, t, g, unknown or other
  misc_feature (224)..(224): n is a, c, g, or t
  modified_base (231)..(231): a, c, t, g, unknown or other
  misc_feature (231)..(231): n is a, c, g, or t
tcagtcgtcgctcgcacgaccggtgctcgatttagcatactctacagggggctgtgggctcaggaggcagagctcgtgggaatctcaccatggcctggacccctctcctgcctccccctctcactttctgcacagtctctgacgcctcctatgagctgacacacgccacccgtcggtntacgagtcgtaccccaagggaacaacggcaaggatccactgctcgngggactntacgtatcgaaccaaaagtacttacgttaacgtttcggttacggttccaagacgtaaggtaacgtaccgaacggtccgaccggtccccgttaggtaccggtcggtacaactccggagttacggaaccggtcctaacggtccgtaaccgaccgtaccggtaccggtaccgtacccgtaggaacgtaacggtactttaccgtccgttccgacccgttactaccggttaccgtacggaacgggtaaccgtcgggtacccgtaccgtaccggttacgtaccttacggtcggtacgggtaccccgggacggtacggggtaacggacggttaagtacgggtaacgtccgttaacggtacctttaacgtttcggttacggtaaccgtacccggaagtaacgtaaccggtaggtttacgtaccgggttataacggggttacgggttacgggggttaccgtacgggggtaaccggaacggttacggtacgttaccgggttcccggttaaggtcccgggtaacgacccggtaccgggtaacccgttcccggtacccggttaccccggacggtttaacccctagggttccccgttacccccgg

SEQ ID NO: 90549 - DNA, 753 bp, Homo sapiens
  misc_feature: GYAE6OF02F8MIZ.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgctccccctctcactttctgcacagtctctgacggcctcctatgagctgacacacgcccacccgtcggtgtcagtcgtaccccaggacaaacggccagatcactgctcgaggagtattctattacgaaccaaaaagattattacgtttgttcgttaccaggcaagtaagtcacggccacggtccccctgttacgtggtcatcccagtggacgcctaggtcgaaccacgaccgtcgggaccttccgtaggagacgtcgttctctcgccctccgagtccctaggacggaccgtagtccgggacccttaccgtacggtaacttacgtcggtaacgggtccggggacccgttaaggggtcggtaaacggtagtaacggaccgtacgtacgtaaccgtttaagtttacgtttacggttacccgaacgtaacccgtaacggaacgttaggtacggttaggtaccgtacggttaccgggttaagggggtttccgtaccgggggtacgggtaaccgggtaaccggttaaggttacccggtacccggttttacggttaccgggtaccgtaacccggtcccgtaacccggtcccggttaccccggttaccccccggttaccggtaacccttacccggttacccgtttacccccgg

SEQ ID NO: 90550 - DNA, 783 bp, Homo sapiens
  misc_feature: GYAE6OF02JL9MY.21.8.A08.1.454.CMB.1.raw
  modified_base (447)..(447): a, c, t, g, unknown or other
  misc_feature (447)..(447): n is a, c, g, or t
tcagtcgtcgctcgcacgaccggtgctcgatttagcatactctacagggggctgtgggctcaggaggcagagctcgtgggatctcaccatggcctcggacccctctcctcgcctccccctcctctactttctgcactcgtctctgacgtcctctatgagtctagacacacgccctaccgtggtgtctagtccgtacccgaaggaaccgaaaccggccaaggtactccgaaccgttgtcctggtacggatacttacctaagttacgaaacctaaaaagtacttagttacgttcggttgttccaaggactaaaggtaacgtaccggaccggtaccgaccggtcccgttaggtacgtcggtacctaagtccgagtacggacggaccgtacgaccgaccgtacgtaccgtaccggtactccggagacgtagtacttcgtctccgtccctanacgtcgacggaacggtaccgtacgtaccggtacccttacggtctacgtactacgggtacgggtccggacgggtacgtagggtaccgtagtacggtaacgtcgtacgtaaccgttaagtttcgttaacgtaacccgacgttaaccgaacggttaacgtaaacgttcggtacgtaaccgtagggttaaccgggttacggggttaacggtcggggtaaacggggtaaccggaacgttacgggtaccggttaacggttcgggtacgttaacggtacggtaccggtacggtacccgttcccggtaccggtacccgtccgtaccggttcccttaccccgggg

SEQ ID NO: 90551 - DNA, 895 bp, Homo sapiens
  misc_feature: GYAE6OF02GI3OJ.21.8.A08.1.454.CMB.1.raw
  modified_base (122)..(122): a, c, t, g, unknown or other
  misc_feature (122)..(122): n is a, c, g, or t
  modified_base (226)..(226): a, c, t, g, unknown or other
  misc_feature (226)..(226): n is a, c, g, or t
tcagtcgtcgctcgcacgaccggtgctcgatttagcatactctacagggggctgtgggctcaggaggcagagctctgggaatctcaccattcgcctcggacccctctcctgcctccccctcncctactttctgcacgagtctctggacggcctcctagtgagcgtagacacgcgcccacccgtggtgtcaggtcgtccccgaaggaaccgaacggccgaaggtacnccacctgctcgtcggaagtcttcattacggaaacctaaaagtaattacgttacgttttcggttcgggttaccaggaccgtaaggtaacgttacgacggtaccccgaaccgggtcccccgtgttaccggtggacctaagtccgtaggtacgaccgggtacccgacggtaccggaaccggaccccgtacgttacccggggtcctaccggtacggaaggttacgttaacctttcccgcggttacccgttacccggttccgtaccgtaccggtttaaccggggaaaccggggtaccttaacggggtaccccggttacccccgtaaacgttttaaccgggaaccctttacgttaccgggtaacggggtttaccgggggaccccgggttaacggggtacggggtaaacgtaacggtacgggttaaccggttacctaacccgggttactttaacggtttacggtttaaccgtaccggtaacctaacggtaccggttaacgtacgggttacggttacggtacttaaggggttacggggttaacggggttaacggttcggggaacgggtacgggtaaccgtcgggttaccgacggtttccgggtacgtaccggccgtaacccggtaggtacccgtcccggttacccgtacggtacccgttacgttcccggtaccccgg

SEQ ID NO: 90552 - DNA, 799 bp, Homo sapiens
  misc_feature: GYAE6OF02F29NT.21.8.A08.1.454.CMB.1.raw
tcagtcgtcgctcgcacgaccggtgctcgatttagcatactctacagggggtgggctcaggaggcagagctctgggaatctcaccatggcctggacccctctcctgctccccctctcactttctgctacagtctctgaaggcctcctatgagctagacacagccaccctggtgtcagtgtccccaggacaacggcaggactcactgctctggagtattcagttcgaaccaaaagattagtactttgttacgtaccagcaaggtaagtcaggtaccacggcccctgtactacggtactacgtaccatcggacggccgaggtaccgaacgacacgtaccgggtactcccgtaggaacgtacgtaacttcgtaccgtacggcccttaccgaacgtcccgttacggaacgggtaacgtaccggtacgggtaccccttaaccggttacggaaccttacgtacgtaacggggtccgggggaaccccgtaaggggtacgggaacccgtagtacggtaaccgtacgttaagaacccgttaacgttaagtttaccggtaaccggtacctaaccgtaagtaccgtaaggtacgggttacgtaccgtaaggttccgggaaggggttaccgttccgggggaaccgtacggggttaaacccgtaacgggtttaccgggtaccctttccgggtttaaccgggtaccgtaaccgggtaccccggttaaacgggtcccgttaaccccggtccccggtttaccgggtaccccgttaaccggtttccggttaccccggttacccccttaacccccgg

SEQ ID NO: 90553 - DNA, 1037 bp, Homo sapiens
  misc_feature: GYAE6OF02JHSWS.21.8.A08.1.454.CMB.1.raw
tcagtcgtcgctcgcacgaccggtgctcgatttagcatactctacagggggctgtgggctcaggaggcagagctctgggaatctcaccatcggcctcggacccctctccgtcgcccttccccctctcctactttctgacactagtcttcgtggacggtcccttaccgtagtcgacgtcgtagaaccacgtaccgccctacccgttcgggtcgtaccgtacggtcccgtacccccgaaagggaaccgtaaaccggccgaacgggtaacttcccgaccgttcgtaccttaccgggtaggtaacgttaactttaccgtacgtttaaccggaaaaccgtaaaaggtaactttaacgtttaaccggttttggtttaccggttaccaacggtacgtaaaacgttacgggtaacggtaccggtaccccggttaacccgggtcccgtttacggtaaccgttcgggttaaccctcgttaaccggtaacgtacgggtacccgtaaccgtaacggttaccggtaaacccggtcccggttaaccccgggttacggttaccctaacccgggttacggtaacggttaaccgtttaccgtttcccgtacgggtaaccccgttccgtaacccgtacgggtccccgttaaacggggaaccggtaaccggtacccggggtttacccgtaaccgtttacccggttaacccggtaagtttaacccgtacggggtaaaccgggggttcccgggtaacccgggtttaaggggaccggttaacggtaacgtaaccgggtaacgttcggttaacccgttacgttaacgtttaccgggttccgtaaccgtacgtaaccggtagttaccggtaacggtacggttaccgtaaccgtacgggtttaaccgggtaacggggttcgggttaaacccgggacgggtaacgtaaccgggtacgggtttaccacccggggtttaaccgtagggtaccccgtaggttaccccggtacgacccggttcccggttacccggtaccgtttcccgtcggttaccccggtccccgg

SEQ ID NO: 90554 - DNA, 936 bp, Homo sapiens
  misc_feature: GYAE6OF02F1XNO.21.8.A08.1.454.CMB.1.raw
  modified_base (152)..(152): a, c, t, g, unknown or other
  misc_feature (152)..(152): n is a, c, g, or t
  modified_base (183)..(183): a, c, t, g, unknown or other
  misc_feature (183)..(183): n is a, c, g, or t
  modified_base (191)..(191): a, c, t, g, unknown or other
  misc_feature (191)..(191): n is a, c, g, or t
tcagtcgtcgctcgcacgaccggtgctcgatttagcatactctacaggggggggagaggagcccagcactagaagtcggcggtgtttccattcggtgatcagcactgaacacagaggactcaccatggagtttgggctgagcgtggttttcncttgctctttaagaggtgtcagtgtcaggcncaactggngagtcgtgggggagcatcgggtaccagccgttaggggacgttccctaggacgtccctcgtccgttggtcgaccgtaggccggttctgggtactttaccaaggttaacgtccgggtcctttccttttaggacccctaagttcggaccttaaccggttcggggtccccggccggtaaggggtcctttacccggaggggaccggtaaacgggggggtcgttacggggaaggggttcgggggtacggacggtaagttttaacgttccggttaggggttaattcggggaaagttagggggtaaaggttacggaacgggtaaaggttaaccgtttaagtttaattacccggtaaaggttaccccggttacccgggtaaggggtaaaccggggtcccgtaactttacccgaaacctaacgttacccgtaacccgtaaaggtaacggtaaacctaaacggttacccggaaaacccctaaacggaaacccttaacctaaccggtttaacgttactttaacccggtttaaaccaaaacggttaccggaaccccgggtacgttaacgggaaccggacggttaacccggggaacggtaaccggtaaccggtacgtttaacgttacggttaaaccgttttaacggtaaccgggtttaaacggtaccggttttacggttttacggggtaaccggttaacgggtttacccggggggaacccttaaaccggggggtttacccccgtggggtttaacccccg

SEQ ID NO: 90555 - DNA, 866 bp, Homo sapiens
  misc_feature: GYAE6OF02FYVQ6.21.8.A08.1.454.CMB.1.raw
  modified_base (95)..(95): a, c, t, g, unknown or other
  misc_feature (95)..(95): n is a, c, g, or t
  modified_base (152)..(152): a, c, t, g, unknown or other
  misc_feature (152)..(152): n is a, c, g, or t
  modified_base (170)..(170): a, c, t, g, unknown or other
  misc_feature (170)..(170): n is a, c, g, or t
  modified_base (251)..(251): a, c, t, g, unknown or other
  misc_feature (251)..(251): n is a, c, g, or t
tcagtcgtcgctcgcacgaccggtgctcgatttagcatactctacaggggggggagaggagcccagcactagaagtcggcggtgttccattcggngatcagcactgaacacagaggactcaccatggagtttgggctgagctgggttttccncttagcttacgtttaagnggtctccagtcgtacaggcacaacgtggtaggagtcgtggggagcagtcggtaccaggtccgtggggacgtccctaggacncccttctccgtggtacgccgaggtccgttctgggtattaccgaggttactccggtacctttaccgttgacctacgtacggacctacgtccggggtaccctccgagggtccctaaccggacgggttaccggaaacggggtccgtaggggtacgggttcggggttaccgacgttaagtttacgtaccgttaggggtaagtacggtaaggttaggggaacgttagggaacgtaaggtaaacctttaggtttaacgttaccggaaacggttacccgtaccgggtaacggaaacccgggttacttaaccgttactaacccgtaacgtccgaacgtaacggtaacaacggttaacctaccgtaacccgttaaaacaacccggttaaacctaggtttaacgttaaccgttacgttaaaccgtaaaccgggtcccgtaaccggtttaccgaaggaccgggttaaccgaacccgggtaaggtccggtaacccggttacttaccgtttaacggtaacccgttttcggttaacggttaaccccggaaagttttccggtttaacccgttaggaaccggggtttcccggggaacccgtaaccggggttacccgtttacgggaaccccg

SEQ ID NO: 90556 - DNA, 871 bp, Homo sapiens
  misc_feature: GYAE6OF02GP89S.21.8.A08.1.454.CMB.1.raw
  modified_base (104)..(104): a, c, t, g, unknown or other
  misc_feature (104)..(104): n is a, c, g, or t
  modified_base (132)..(132): a, c, t, g, unknown or other
  misc_feature (132)..(132): n is a, c, g, or t
  modified_base (176)..(176): a, c, t, g, unknown or other
  misc_feature (176)..(176): n is a, c, g, or t
tcagtcgtcgctcgcacgaccggtgctcgatttagcatactctacagggggctgtgggctcaggaggcagagctctgggaatctcaccatggcctggacccctntcctgccttcccccctactcacttttcngccacagttctactggaggtccctacctagtgagtcgtgaccanacgcccctacctggttgtactacggttccgtacccccgagggaaccaaaccggccgaagggtactccgaacccgtggtccttacggtaggacgtctttaccgtattaccggaaaccaaaaaggttaacttacgtttacgtttaggtttacggttacccagtaccgtaaggtaacggtaccacgggtacccggtaccgtcccccgtagttaccggttacggtacctaaccgtccgtacgtagggtaaccggccgtacgggttaccgaaccggtacctaaccggttcccgggtaccttacccggtaggacgttacgtaccgtttccgtaccgtccgtacccctacgacggtccgacgggtaacgggactacgggttaccggaccttaccgggtttcgtaacttccggtacgggtacgggtaccgggaaccggttacgggtacggtaacggtactaacggacgtaccgtacgttacttaacggttacgttacgtaccgtaccgtaccgtaacggtaccgagggtttagtaccggttactacgggttacgggttggggttaaccggtaccgggtaacgggttaccggaaccgttaccgggttacggtacccggttggttaaccggcggttaacccgtaccgggtacccgtccggttaccccgaccccggttagtcccgtttacccgtcgttaccccccg

SEQ ID NO: 90557 - DNA, 927 bp, Homo sapiens
  misc_feature: GYAE6OF02FG1OW.21.8.A08.1.454.CMB.1.raw
  modified_base (104)..(104): a, c, t, g, unknown or other
  misc_feature (104)..(104): n is a, c, g, or t
  modified_base (168)..(168): a, c, t, g, unknown or other
  misc_feature (168)..(168): n is a, c, g, or t
tcagtcgtcgctcgcacgaccggtgctcgatttagcatactctacagggggctgtgggctcaggaggcagagctctgggaatctcaccatggcctggacccctntcctgcctccccctctcactttctgcactagtctctgaacgtcctctatcgagctagacctacngtaccctaccgtggtcgtcacgtcgtaccccgaggaaccaaacggccaggtactacctaccgtcggtcctacgtagggacttaacttcgaatttacgaaccctaaaaaggtaacttccgtttaacgttttcggtttaccggttaccgaacgtacgtaaacggtaacggttaccgaaccgggtccccgtaaccgggtccccccgttaggttaccggttacggttaacccgtaaccttacccgtaacgttggaacccggtaccgttaaaccggttaccggaaccgtaaacccgtacccggttacccggggtacccgtcccccggttaaaggaaccgttacgtaaacgtttcccgtacgttacccggtacccgttcccggtacggtaccctaacggggtaaacgggacggttaacggttcccggtaccccgtacgttttacggacgttaaccgtaccggtacgggtacccgggtacccgtacgggtacgggaacgtacgttacggaacggtcgtaacgtaccgttaacgttaggttaccgtaaccggtaccctacggtaaccgtacgttaacggttacggttacgtaccgttaaccggtacgggttaacggggttaccggttacgggaaccggggttaaccggtaacggttaccgttaccggtaaccggtttacccggttagggtaacccgtaccggtaacccgtaccgggttacctacccgggtaccccttagggtccctacccggttcccttacccccgg

SEQ ID NO: 90558 - DNA, 867 bp, Homo sapiens
  misc_feature: GYAE6OF02JLLW2.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctcccccctcctcactttctgcacagtctcgtgaggcctcctagtgagctcgacacacgaccctacccgtcggtcgtacaggttccgtaccccgaaggaaccgaaaccggcccgaaggactacccgtaccgtcggccttacgtagggtacgtacttacgtacgttacgaacccgtaaaaagtaacttacgttacgtttggttacggttaccaggtacgtaacggtaacgtaccgaccgggtacccgtaccggtacccccgttaggttaccgtcggttacccgtaacttacccggtagttaaccggaccggtaacccgtaacggtaccgtaaccggaccgtacccgggtaccggtaacccttcccgtaagggaacggtaccgttacgttccgttaccgtccggtaccctaccgtacggtactaccggggaaggtacccgtaaccggtcccggaccgttacccgtacgttacctaggtaccggtacgggtccgggtaccggtagggtacggaccgtagtacgaacgtccgtacgttaccgttaacgtttacgttacgtacctaccgaaccgagtaacgtaggtaccgtaggtacgtacgggttacgggtacggggttacgttaccggggacggttaccgggaacgttccggtacggtcccggttaacggttcggtacccgtaccggtacccggttaccgtaccccggtacccggttaccccggtaccgttacccgttcccggttacccggttcccccgg

SEQ ID NO: 90559 - DNA, 631 bp, Homo sapiens
  misc_feature: GYAE6OF02H9T73.21.8.A08.1.454.CMB.1.raw
  modified_base (174)..(174): a, c, t, g, unknown or other
  misc_feature (174)..(174): n is a, c, g, or t
  modified_base (177)..(177): a, c, t, g, unknown or other
  misc_feature (177)..(177): n is a, c, g, or t
  modified_base (509)..(509): a, c, t, g, unknown or other
  misc_feature (509)..(509): n is a, c, g, or t
  modified_base (520)..(520): a, c, t, g, unknown or other
  misc_feature (520)..(520): n is a, c, g, or t
tcagtcgtcgctcgcacgaccggtgctcgatttagcatactctacagggggctgtgggctcaggaggcagaactctgggtgtctcaccatggcctggatccctctacttctccccctctcactctctgcacgaggctctgaggcctcctatgagctgacacagccaccctcggntcngtcgtcccaggacagacggccaggactcacctgctcgtgcagatcggactcgacaaaagaatagtgacttattacggtaacaacagaacgccaggccacggcccctagtagttacgtagtattaagtaagtaaagactaacgtaggaagacggcccgtacaagtacggtactaccgaggtacgacgttactttaccgtcggtacgtccctacgacgtcgtacggtaacggacgacgtacgtacgtacgtacgttacgtaactacgtactaacggtacgtaacgacggtaacgacggaagggacggaacggacgtagtactaactataacgtntaaacaaagtnaacgacgagtaacgagtacgtacgttaggtggtacggtacgggtaggaacggtaacgtcgtacgtacgtacccgttaggtaccgagaaccgcgaacccgtcgtacccccgg

SEQ ID NO: 90560 - DNA, 974 bp, Homo sapiens
  misc_feature: GYAE6OF02HKNR9.21.8.A08.1.454.CMB.1.raw
tcagtcgtcgctcgcacgaccggtgctcgatttagcatactctacaggggggctgtgggctcaggaggcagagctctgggaatcgtcaccatgggcctggacccctctcctgcctcccccgtctcgtactttctagcacagtcctcgtgacggccctacctatgagtctgacacagcccacccgtggtgtacgtagtccgtccccgaggaacccgaaacggccgtaaggtaccttaccgaacccgttggaccttacgttaagggaacgtactttacgtaacgtttacggaaacccttaaaaaggtattaacgtttacgttttacggtttaccggttaccgacgtactaaggtaacggttacgaccggaccgaacggtcccgttacgtacgtacggtactactaccgtacgtacggtaacggtacccgtaaccggtccggaaaccgacccgttaaccggtacccgggtaacgtcccccggttaggtaaacggacttaccggtttacccgttacgttcccgtaacccgttacccgacggttacccgttaccggaaacggggtaaccgtaccgggttaccggggaccccttaacccgggtttaactaaccggttttaacgtaaccggtaacggggttcccgggggaaacccgtacgggggtaaaccgggtacggttaagtaaacgggaaccgtacggttaaccggtaacctttaaccggtttacggtttaaccgttaaccggaaccctaacgtaccggtaacgaaaggggtttacggtaccggttacgtaacgggttaccgggtaaccggggtttaaggtaccccgggttaagggaaccgggttaaccgggtacggtaacgggtttaacccccggttaggtttaaccggaccgtaacccgggaacccggtaaccggttcccgtcccggtacccccggttacccggtttcccggtacccgttacccgtttacccccgg

SEQ ID NO: 90561 - DNA, 925 bp, Homo sapiens
  misc_feature: GYAE6OF02IXMVV.21.8.A08.1.454.CMB.1.raw
tcagtcgtcgctcgcacgaccggtgctcgatttagcatactctacagggggggggagaggagcccagcactagaagtcggcggtgtttccattcggtgatcagcactgaacacagaggactcaccagtggtagtttggctggacgtcgttagggttttcctcgttgcgttacttttaaggacggtcgtccgtagtcgtcgaggccggacaacgttgggtggtagtcggtgggggacgcgacgtacggtccacggtccgtggggtaccgttccctggtaccgtccttcgtccgttggtagaccgcggtaccgtcgtaggtaactttcgacggttacgttcccgggtccttaccgtttacgaaccgtaacgtccggtaccccggttacggttcccgggtaccccgtaccggtacgggtcccgtaccgggtaaccggggaccggggtaacgggggttccggtagggggaaccgggtttcgggggtaacgggtaccgttaaactttacgggttaccggttaaggggtaccggttaagggtaaacgggtttacgggggaaacgttagggtaaacgttaacgtttaagttaacgtttaaccggtaaccgtaaacgggttaaccggtttaccggggtaaacgggttaaccgggtacccggtaaccctttaaccggtaaaccttacccgttaccggtaccgaaaacgggtaacggttaaacccgaaagtacccggaaaacccgtaaacgtaaaccgtaaccgttaacgttaacgtaccgttaaccttaaacgaaccgttaccggtaccgtacgtacgaaccggaccgtacggaacgtaccgtaccggttataccgttacgtagttacggtagtaacggtcgttacgttacgtcggaacggttccggaccggtacggtacccgtaggttacccg

SEQ ID NO: 90562 - DNA, 690 bp, Homo sapiens
  misc_feature: GYAE6OF02JB6QC.21.8.A08.1.454.CMB.1.raw
tcagtcgtcgctcgcacgaccggtgctcgatttagcatactctacagggggctgtgggctcaggaggcagagctctgggaatctcaccatggcctggacccctctcctgcctccccctcctcactttctgcacagtcctctgcggcctcctatgagctgacacgacgcccacccgtcggtcgtcacgtcgtcccgaggaaccaacggccgaaggactcaccgtcgctcgtggagtacttcagttcgaaccaaaagtaacgtacttacgttggttacggttccagtcgaacgtaagtcgacggccacggtacccctggtactggtctactcagtaggaccggacgacgtacgaccggtaccacggtcccgggactccgtcgaggagtcttcgtcgtcgtaccctcacgtcgacggtacggacgtacggtcgacctaccgttagactacgtcgtagggtccgggaccgtacggtagggaccgtagtacggtaacacggtacgtaacgttacgttcgtttacgtaccgacgtaccgtaacgtacggtacggttaacgtcggtactaacggtcgggtaacgggttacggtcgggaacggaccgggtaacgtacgttccggtaccgttcggttcggaccgacgtaccggacgtacccggtccggtaccccgtcggtacctccgttccgtaccccg

SEQ ID NO: 90563 - DNA, 439 bp, Homo sapiens
  misc_feature: GYAE6OF01DW78F.25.69.G03.1.454.CMB.1.raw
  modified_base (438)..(439): a, c, t, g, unknown or other
  misc_feature (438)..(439): n is a, c, g, or t
tcagactgtacagtcacgaccggtgctcgatttagtcgctgcgtaaaggagaaagggctggagtgggttggccgtcttagaagtaaagttaaaaattacgcgacagcatacgctgcgtcggtgcaaggcagattcaccatctccagagatgattcggaaaacacggcgtatcttcacatgaatagcctgaaagacgacgacacggccacatattactgtattcccgagttgaaatcctcgcgaccagaatcctcgtattacatggagttctggggcaaagggaccaaggtcaccgtctcctcagcctccaccaagggcccatcggtcttccccctggcaccctcctccaagagcacctctggggcacagcggccctgggctgcctggtcaaggactacttccactgtacagtctgagcgggctggcaaggcgcatagnn

SEQ ID NO: 90564 - DNA, 594 bp, Homo sapiens
  misc_feature: GYAE6OF01DJYMT.25.69.G03.1.454.CMB.1.raw
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (538)..(538): a, c, t, g, unknown or other
  misc_feature (538)..(538): n is a, c, g, or t
  modified_base (546)..(546): a, c, t, g, unknown or other
  misc_feature (546)..(546): n is a, c, g, or t
  modified_base (552)..(552): a, c, t, g, unknown or other
  misc_feature (552)..(552): n is a, c, g, or t
  modified_base (555)..(555): a, c, t, g, unknown or other
  misc_feature (555)..(555): n is a, c, g, or t
  modified_base (561)..(561): a, c, t, g, unknown or other
  misc_feature (561)..(561): n is a, c, g, or t
  modified_base (563)..(564): a, c, t, g, unknown or other
  misc_feature (563)..(564): n is a, c, g, or t
  modified_base (568)..(568): a, c, t, g, unknown or other
  misc_feature (568)..(568): n is a, c, g, or t
  modified_base (571)..(573): a, c, t, g, unknown or other
  misc_feature (571)..(573): n is a, c, g, or t
  modified_base (575)..(577): a, c, t, g, unknown or other
  misc_feature (575)..(577): n is a, c, g, or t
  modified_base (587)..(590): a, c, t, g, unknown or other
  misc_feature (587)..(590): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
tcagactgtacagtcacgaccggtgctcgatttagtcgctgcgtaaaggagaaagggctggagtgggttggccgtcttagaagtaaagttaaaaattacgcgacagcatacgctgcgtcggtgcaaggcagattcaccatctccagagatgattacggaaaacacggcgtatcttcacatgaatagcctagaaagacgacgacacgccacatattactgtacttccgagttgaaactccgtcgacgaccagtaactccgtacgtattacagtggtagttcgtggggacaaacgggaccaaggtccaccgtctcctcacgccctccgacacggccctagtccgtcttccccgngccnccgtgcctccagacgccaccgtcgagacgacacgacggtcccggcccgtgggacctcgtacccggttaggtaacccaaagggttaccccttactcccgtaacgttcgttaaccgaggttccgtacgggacgggcccggggtagtaccggaagggtaaccggcgaaccaaggttcgacttagngcgctcgngcgtancgntcgcgngnngcgncgnnncnnncgttttttcnnnngngn

SEQ ID NO: 90565 - DNA, 447 bp, Homo sapiens
  misc_feature: GYAE6OF02GLOH1.25.69.G03.1.454.CMB.1.raw
  modified_base (437)..(447): a, c, t, g, unknown or other
  misc_feature (437)..(447): n is a, c, g, or t
tcagactgtacagtcacgaccggtgctcgatttagtcgctgcgtaaaggagaaagggctggagtgggttggccgtcttagaagtaaagttaaaaattacgcgacagcatacgctgcgtcggtgcaaggcagattcaccatctccagagatgattcggaaaacacggcgtatcttcacatgaatagcctgaaagacgacgacacggccacatattactgtattccccgagttgaaatcctcgcgaccagaatcctcgtattacatggagttctggggcaaagggaccaaggtcaccgtctcctcagcctcaccaaggcccatcggtctccccctgcgccctgctccaggagcacctccgagagcacagcggccctgggctgcctggtcaaggactacttccactgtacagtctgagcgggctgggcaaggcgcatagnnnnnnnnnnn

SEQ ID NO: 90566 - DNA, 494 bp, Homo sapiens
  misc_feature: GYAE6OF01CIM8W.33.7.A07.1.454.CMB.1.raw
  modified_base (255)..(255): a, c, t, g, unknown or other
  misc_feature (255)..(255): n is a, c, g, or t
  modified_base (302)..(302): a, c, t, g, unknown or other
  misc_feature (302)..(302): n is a, c, g, or t
  modified_base (472)..(472): a, c, t, g, unknown or other
  misc_feature (472)..(472): n is a, c, g, or t
  modified_base (484)..(484): a, c, t, g, unknown or other
  misc_feature (484)..(484): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccaatcagagtgttagcagtaacttagtctggtaccaanatagacctgaccaggctccaggctcctcatccagaatgcattcaacngggccactggcatcccagccaggttcagtggcagtggtctgggacagacttcactctcaccatcagcagcctagagcctgaggattctgctagtttattactgtcagcagcgtctcaactgcctcgtgcaccttcggccaagggacacgatggagagttagacgaactgnggctgcaccctntgtcttctac

SEQ ID NO: 90567 - DNA, 536 bp, Homo sapiens
  misc_feature: GYAE6OF01DC6UV.33.7.A07.1.454.CMB.1.raw
  modified_base (197)..(197): a, c, t, g, unknown or other
  misc_feature (197)..(197): n is a, c, g, or t
  modified_base (390)..(390): a, c, t, g, unknown or other
  misc_feature (390)..(390): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagngccaccctctcatgcagggccagtcagagtattagcatcttcttggcctggtaccaacagaaacctggccaggctcccaggctcctcatccagaatgcattcaacagggccactggcatcccagccaggttcagtggcaggtgggctgggacagacttcactctcaccatcagcagctagagcctgagattcngctagtttatactgtcagcagcgttctcaacgtgggcctccggtgcctaccgttcggacctaaggggaccacggtagtttgggaagtacgtttacggaaccggtaacttgggtacgggaccttagggccctaaccccgtgttaccg

SEQ ID NO: 90568 - DNA, 506 bp, Homo sapiens
  misc_feature: GYAE6OF01EBPRG.33.7.A07.1.454.CMB.1.raw
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagagccaccctctcatgcagggccagtcagagtattagcatcttcttggcctggtaccagcagaaacctggccaggctcccaggctcctcctctatggtgcatccaccagggccactggcatccccagacaggttcagtggcaggtgggtctgggacaggacttcactctcacccatcgacagactggagcctgaagtattttgctagtctattactgtcagcagtatacgtggggaagacgttcggcgaagggacaagggtaggaaatacaaacgactagtggctgcacatctgtcttcatctcccgctac

SEQ ID NO: 90569 - DNA, 517 bp, Homo sapiens
  misc_feature: GYAE6OF01EHSJU.33.7.A07.1.454.CMB.1.raw
  modified_base (255)..(255): a, c, t, g, unknown or other
  misc_feature (255)..(255): n is a, c, g, or t
  modified_base (488)..(488): a, c, t, g, unknown or other
  misc_feature (488)..(488): n is a, c, g, or t
  modified_base (499)..(499): a, c, t, g, unknown or other
  misc_feature (499)..(499): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggggaaattgtgttgacacagtctccagccacctgtctttgtctccaggggaaagagccaccctctcctgcagggccagtcagagtgctggcagcaacttagcctggtaccaaanaaaacctggccagactcccaggctcctcatctatgatgcatccaccgagggccactggcatcccagccaggttcagtggcagtggtctgggacagacttcactctcacatcagcagcctagacgcctgaagtatttgctagttgtattactgtacagcaagtacggtagttcatcctccgtacgttcggaccgaagggaccaagggtgaaatacgaaaacgtaacgtggtcgntgcacatcgtntctctatccgttcccgac

SEQ ID NO: 90570 - DNA, 492 bp, Homo sapiens
  misc_feature: GYAE6OF01BFU6R.33.7.A07.1.454.CMB.1.raw
  modified_base (488)..(488): a, c, t, g, unknown or other
  misc_feature (488)..(488): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagagccaccctctcatgcagggccagtcagagtattagcatcttcttggcctggtaccaacagaaacctggccaggctcccaggctcctcatccagaatgcattcaacagggccactggcatcccagccaggttcagtggcagtgggtctgggacagacttcactctcaccatcagcagcctagagcctgaggattctgctagtttatactgttagcagcgtctcaactggcctcgtgccaccttcggccaagggccacgagttggagtattagacgaactgtgctgcaccctntgtc

SEQ ID NO: 90571 - DNA, 517 bp, Homo sapiens
  misc_feature: GYAE6OF01EJ21D.33.7.A07.1.454.CMB.1.raw
  modified_base (490)..(490): a, c, t, g, unknown or other
  misc_feature (490)..(490): n is a, c, g, or t
  modified_base (514)..(514): a, c, t, g, unknown or other
  misc_feature (514)..(514): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaagttgtgttgacgcagtctccaggcaccctgtctttgtctccaggggaaagagccaccctctcctgcagggccaatcagagtgttagcagtaacttagtctggtaccaacatagacctgaccaggctcccaggctcctcatctacgatgcgtccaacaggggccactggcatcccagccaggttcagtggcagtggtctgggacagacttcactctcaccatcagcaacctagaacttgaagtatttttcattttatactgtcaacatcacgcagctggcctctctacgtttcgggacggacgggaccaagggtggagctacgaaacgactggtgcgtgcacctntctgttcttcactccttcccgctntcg

SEQ ID NO: 90572 - DNA, 491 bp, Homo sapiens
  misc_feature: GYAE6OF01C4QQA.33.7.A07.1.454.CMB.1.raw
  modified_base (239)..(239): a, c, t, g, unknown or other
  misc_feature (239)..(239): n is a, c, g, or t
  modified_base (302)..(302): a, c, t, g, unknown or other
  misc_feature (302)..(302): n is a, c, g, or t
  modified_base (389)..(389): a, c, t, g, unknown or other
  misc_feature (389)..(389): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagagcccaccctctcatgcagggccagtcagagtatagcatcttnttggcctggtaccaacagaaacctggccaggctcccaggctcctcatccagaatgcatcaacngggccactggcatcccagccaggtcagtgcaggtgggtctgggacagacttcactctcaccatcagcagcctagacgctgagattcngctagtttatactgtctgcgagtcgtagacaacgtgacccttaacgccttcggacaagggcacgactggaagtataaacgatggngntgcacatctgtctac

SEQ ID NO: 90573 - DNA, 578 bp, Homo sapiens
  misc_feature: GYAE6OF01D797X.33.7.A07.1.454.CMB.1.raw
  modified_base (439)..(439): a, c, t, g, unknown or other
  misc_feature (439)..(439): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagagccaccctctcatgcagggccagtcagagtattagcatcttcttggcctggtaccaacagaaacctggccaggctcccaggctcctcttctatgatgcatccaacgcgggccacgtggcactccccagccaggttccaggtcggcggttgggtctggggacaggacttcactctcaccatcagcagcctagacgcctaggaagtattttcgcttaagttttattacgtgtcagcagtcgtanctaacgtggttcgttgggtacgtttcggaccgaagggaccaagggtagaaactaccgaaaacggtacgtggtacggcgttcggacctaacccgaacttccgttacggttacctttccgtaacgttccccgttacccccg

SEQ ID NO: 90574 - DNA, 532 bp, Homo sapiens
  misc_feature: GYAE6OF01ATWY1.33.7.A07.1.454.CMB.1.raw
  modified_base (197)..(197): a, c, t, g, unknown or other
  misc_feature (197)..(197): n is a, c, g, or t
  modified_base (303)..(303): a, c, t, g, unknown or other
  misc_feature (303)..(303): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagngcccaccctctcatgcagggccagtcagagtatagcatcttcttggcctggtaccaacagaaacctggccaggctcccaggctcctcatccagaatgcattcaacngggccactggcatcccagccaggttcagtggcaggtgggtctgggacagacttcactctcaccatcagcagcctagacgcctggagtattcgtgctagtttactactgtcagtcagtcgtctcaacgtcggtccctccgtgcctacccgttcggaccgaacgggcacggtagttcgggaatagttacggacgtaacgttggtacggacctgccctacccgttgttaccg

SEQ ID NO: 90575 - DNA, 495 bp, Homo sapiens
  misc_feature: GYAE6OF01CBNKV.33.7.A07.1.454.CMB.1.raw
  modified_base (380)..(380): a, c, t, g, unknown or other
  misc_feature (380)..(380): n is a, c, g, or t
  modified_base (393)..(393): a, c, t, g, unknown or other
  misc_feature (393)..(393): n is a, c, g, or t
  modified_base (487)..(487): a, c, t, g, unknown or other
  misc_feature (487)..(487): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagagccaccctctcatgcagggccagtcagagtattagcatcttcttggcctggtaccaacagaaacctggccaggctcccaggctcctcatccagaatgcattcaacagggccactggcatcccagccaggttcagtggcagtgggtctgggacagacttcactctcaccatcagcagccctagngcctgaggattcngctagttttatactgtcagcagcgtctcaactggcctcgtcgctaccttcggccaagggaccaggagttggagtagttgacgatggtggctgcnccctgtcg

SEQ ID NO: 90576 - DNA, 802 bp, Homo sapiens
  misc_feature: GYAE6OF01BXQZG.33.7.A07.1.454.CMB.1.raw
  modified_base (195)..(195): a, c, t, g, unknown or other
  misc_feature (195)..(195): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaagttgtgttgacgcagtctccaggcacctgtctttgtctccaggggaaancgccaccctctcctgcagggccaatcagagtgttagcaagttaacttagtctggtaccaacatagacctgaccaggcctcccaggcctcctcatctacgatcgccgtaccaacgacgggcccacgtcgggaccactccccgaagtccctagggtttccaagggttcgggccgtaagggttcggggtacgtagggggaacctacggtaacctttccgaaccgtttccctaccaacccctaaagttccgaaacggtaccctaaaacccgttaggtaaccgtaccccgttaaggtaaaacggttaacgttttttacggaacccgtttaaaggttttttaaacgtttaccgtttacggttaccgtaacggtacccgtaacgggttacccggttaacggtaaccgttaaaccggttaaccgggtaaccccttaaaaccgttaaccccggtttacccgggaacccgtaaacggggaaccctaacgggtaaccgtacgggtaaacgtaaacgtttaaaaccggaacgttacgggtacggtaccgttaggaccctaaccgtacgttccgttacgttccctttactaacccgtttcccttaccccggtccttaacg

SEQ ID NO: 90577 - DNA, 517 bp, Homo sapiens
  misc_feature: GYAE6OF01DC5HG.33.7.A07.1.454.CMB.1.raw
  modified_base (493)..(493): a, c, t, g, unknown or other
  misc_feature (493)..(493): n is a, c, g, or t
  modified_base (507)..(507): a, c, t, g, unknown or other
  misc_feature (507)..(507): n is a, c, g, or t
  modified_base (513)..(517): a, c, t, g, unknown or other
  misc_feature (513)..(517): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagcgcctgaagtattttgctagtttattactgtcagcagcgtagcaagtggtcttgggacgttcggaccgaagggaccaagggtagaaatacgaaaacgacgttagtcggctagcctaaccatctcgtcttcattcctcccgctatctgtatgtgtgtacgtgacggtcgggtntagggcaaggcganagtagnnnnn

SEQ ID NO: 90578 - DNA, 632 bp, Homo sapiens
  misc_feature: GYAE6OF01BXNEK.33.7.A07.1.454.CMB.1.raw
  modified_base (195)..(195): a, c, t, g, unknown or other
  misc_feature (195)..(195): n is a, c, g, or t
  modified_base (491)..(491): a, c, t, g, unknown or other
  misc_feature (491)..(491): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctcagccacctgtctttgtctccaggagaaagngcccaccctctcatgcagggccagtcagagtattagctattcttcgttcggccttaggtaaccaacgtacgaaaccgtggacccaggcctcccgaggtcctccgtcactcgacgaatcgactattaccgaacgacgggccctaacgtcggactaccgtcccgacgtaccgtaggttcgaggtcggacgtagggtcggtcgtagggaccaggttccttaccaccgttctaccgactagtcacgcgacgctaacgcgtcgtagagtcttccgtgtcttaagttttactcgtgtcgtancgtagtcgtctaccgtaacgtccgggtaccctccggtcgtacccgtccgttacccggacggtaacggtcgtaccggttaggtggtaagtaacgttacggaacgttacgtggtcggtacgtcgaccccttcgttccgttacg

SEQ ID NO: 90579 - DNA, 675 bp, Homo sapiens
  misc_feature: GYAE6OF01B1L02.33.7.A07.1.454.CMB.1.raw
  modified_base (207)..(207): a, c, t, g, unknown or other
  misc_feature (207)..(207): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccgaggagaaagcgcccacctntcatgcaggccagtcagagtatagcatcttcgttggcctcggtaaccaacgacgaaacctggaccacggcctccgacggctcctcactccaagaatcgactacttaccaacgacgggccacgtcggaccactccccgagcccgtaggttcaggtcggcgtagggttgggtcgtgggtactaggtcttaccgacttccgtacacctataccagacgaacgtacgtcgggacgcccgtaggaacggtactttcgagtaccgtttaagttttaccttacgtcgtacgacggtctacggtccgttaccgtaccgtaccgtcgggtcccgttacggttccggtacccgttaccggttccgggaaacccggtacgggtaaccgtaacgggttagttaacggggataacgggtttaaccggaacggtttaacggtcggttacggaccgttacggacccttacccgttcgtttacg

SEQ ID NO: 90580 - DNA, 954 bp, Homo sapiens
  misc_feature: GYAE6OF01AN4O9.33.7.A07.1.454.CMB.1.raw
tcagtacacacactcacgaccggtgctcgatttagcacgtgtcgcagggggaggaactgctcagttaggaccctagacgggaaccaataggaacgccccgagctcagcttctcttcctcctgctactctcggctccctagattaccgaccggagaattgtgttgacacagtctccagcccacctgtcttgtctcgaggagaaagcgccgacctctacagtgcagggccagtcgaggagttattacgctatcttcgttggccgtaggaccaacagaaacctggaccaggcctcccgaggccttaccgtcgactaccgaagtaacgttccggactaacttaccgaaaccggacggggaccctaacgttcggggacctaacgtacccccgaaggtccccgttaagggtttccaacggggttacggaaccgtaacgggttcggggtaccgttaggggaaccgtacggttaccgtttaccgaacgttacctaccgaacctaacgttaccgaaccggaccaacgggtacccttaacgggacccgtaccggttaaacggtaacggttaaccgtttacccggttacggttaacccgttttaagggttttttaacgtttaccggttacggtttaccggtaaacggttaccggtaaaccggtttccgtttaacccgttaacccgggtaaacccggttttccccggggtacccccgttttaccgggttaccggttacccgttttaacccccgggtttacccggggaaaccccgggttaaacggggtaaacccggtaaacccggggtttaaacgggtttaaacccggggtaaacggttttaaaaccgggttttaaaccccgggtaaacccggttaaccgggttttaccggggtacccgggttttaccgggttaaccccggggttaaccccggttacccccggttttacccgggttttaaccccggg

SEQ ID NO: 90581 - DNA, 620 bp, Homo sapiens
  misc_feature: GYAE6OF01DQBMC.33.7.A07.1.454.CMB.1.raw
  modified_base (206)..(206): a, c, t, g, unknown or other
  misc_feature (206)..(206): n is a, c, g, or t
  modified_base (284)..(284): a, c, t, g, unknown or other
  misc_feature (284)..(284): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagcgccaccctntcatgcagggccagtcagagtattagcatcttcttggcctggtaccaacagaaacctggccaggcctccaggctcctnactccagaatgactattacaacgtacgggccacgtggacactcccaggccgtaggttcaggtcggcgtaggtgggtctgggactagtacgttcacgtctacaaccgtatcacgacagcccgtaaggacgtaccgtaggtaggtacttcgtcgtacgttagttttacttacgtagttctaggtctacgtcgtactaccgtaaccgtcggtacccttccggtacgtccgtacccgtttccgggaacccgttaaaggggaccctaacggtaggttaggaacggtagttaacgaacggtaacgtcgggtacggacttacggaccctcccgttcgttaccg

SEQ ID NO: 90582 - DNA, 505 bp, Homo sapiens
  misc_feature: GYAE6OF01ESH9B.33.7.A07.1.454.CMB.1.raw
  modified_base (495)..(495): a, c, t, g, unknown or other
  misc_feature (495)..(495): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagagccaccctctcatgcagggccagtcagagtattagcatcttcttggcctggtaccaacagaaacctggccaggctcccaggctctcatccagatgcattcaacagggccactggcatcccagccaggttcagtggcagtgggtctgggacagacttcactctcaccatcagcagcctagagcctagaagtatttgctagtttattactgtcagcagtagtagtcatcgtccgtacgttcggaccgtaagggaccgaaggtggaaactcgaaacgtacgtgtggctgacacatcatctnctcttccccg

SEQ ID NO: 90583 - DNA, 545 bp, Homo sapiens
  misc_feature: GYAE6OF01BCDSI.33.7.A07.1.454.CMB.1.raw
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagagccaccctctcatgcagggccagtcagagtatagcatcttcttggcctggtaccacagaacctggccaggctcccagctcctcatccagaatgcattcaacagggccactggcactcccagccaggttcagtggcagtgggtctgggacagacttcactctcacctatcagtccagccctagacgccgtgaacggtattcctgcctaagttttactactgtcagctagcgtcctacgaacgtggtccctccgtgccctacccgttccggaccctaaggggacccacggtacgttcggggaatacgttaggaccgaacttggtacggctaggccctaccgttcttacgg

SEQ ID NO: 90584 - DNA, 729 bp, Homo sapiens
  misc_feature: GYAE6OF01DKAOB.33.7.A07.1.454.CMB.1.raw
  modified_base (492)..(492): a, c, t, g, unknown or other
  misc_feature (492)..(492): n is a, c, g, or t
tcagtacacacactcacgaccggtgctcgatttagcacgtgtcgcagggggaggaactgctcagttaggacccagagggaaccatggaagccccagctcagcttctcttcctcctgctactctggcctccagactaccaccggagaaattgtgttgacacagtctccagccctaccctgttctttcgtctccgaaggaagaaagcgaccccaccctctacagtcgacgacgggccagtcgagagtattagctattccttcgtcggtccgttacggtaacctaaacgaacgaaacccgtcggaccaacggccctacccgacggtcccttccgtaccactaccgaagtaacgtcgacctattaccgaaacgtcgggaccctacggtacggacctacctacccggacgtaaccgtacggttacgtagggtacggacggtaggggttcgggtacgtacggggaactacggtaccttacgtacctccgtacacctanacgtacgaactcgaccgtacggacgtccgtaggtacggtacttaccgtgttaccgttaagttttactacgtttcggttactacggtacgtcgtacgtaccgaccgttaacggtccgtaacccgtaaccgtaccgtaaccggacggtaaccggacgtaaccgtacggtaaggaacgtaacgttaaacggagttcgggtacgacgtacgtacccgtacgtacttccgtgttcccttacg

SEQ ID NO: 90585 - DNA, 565 bp, Homo sapiens
  misc_feature: GYAE6OF01ARPGZ.33.7.A07.1.454.CMB.1.raw
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (238)..(238): a, c, t, g, unknown or other
  misc_feature (238)..(238): n is a, c, g, or t
  modified_base (347)..(347): a, c, t, g, unknown or other
  misc_feature (347)..(347): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgctccagganaaagngccaccctntcatgcagggccagtcagagtattagcatcttnttggcctggtaaccaacagaaacctggccaggctccaggctcctcatccagaatgctatcaacgagggccatggcactcccagccaggtcagtgcagtggtctgggacngtacttcactctacacatcagcagcctagacgcctaggagtattcgtgacgttagtttatactgtcagtcaagtcgtactacgaacgtcgggtcccttccgtacgtacccgtacccgttacggaaccgtaaacgggtacctaacggtagttacgggaagttaacgttacggaaccgtaaacgtggtacggtactacggtaccctacccgttcgttacg

SEQ ID NO: 90586 - DNA, 569 bp, Homo sapiens
  misc_feature: GYAE6OF01BZ8DQ.33.7.A07.1.454.CMB.1.raw
  modified_base (197)..(197): a, c, t, g, unknown or other
  misc_feature (197)..(197): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagngccaccctctcatgcagggccagtcagagtattagcatcttcttggcctggtaccaacagaaacctggccaggcctcccaggctcctcactccagaatgctattcaacgagggacccacgtcggcactcccagccaggttcagtggcaggtgggtctgggacaggtacttcactctcaccatcagcacgcctagacgtcctggacgtattcgtgtcctagttttacttactgtcagtcagtcgtctactaacgtcggtcctccggtcgtaccctacccgttcggacccgtaaagggacccgaacggtagttacgggaagttacggttagaccggtaacgtggtacggacttcggacctaccccgtgttaccg

SEQ ID NO: 90587 - DNA, 1035 bp, Homo sapiens
  misc_feature: GYAE6OF01AC4T9.33.7.A07.1.454.CMB.1.raw
tcagtacacacactcacgaccggtgctcgatttagcacgtgtcgcagggggaggaactgctcagttaggacccagagggaaccatggaagccccagctcagcttctcttcctcctgctactctggctcccagactaccaccggagaaatttgtgttgacacagtcctccagcccacccttgttctttgtcctccgaggagaaacgcgcccaccctctacagtcgcgacggcctagtcagtagtatagctattcttcgtacgccgtacggtaccagaccaacggtaaacccgtcggacccgacggtccctacccgacggtcccttaccccttccgttacgttaacggttcgggtacctaccgtaaccgttacccccgaaccggtaccggggtacccctacggttaccgggaccctaacccggttacccccgaaaggttaacccggttaacgggtttacccggaagggtttccgggaaccggttaagggggtttccgggggttaccggtaaacggggtaaccgtaaccggtttacccgtttacccgtaacccgtttcccgttaacccgtaacccgtaaccggttacccggtaaaccggaaccggttaacccgggttacgggtaacccgttaccgtttaaaggggttaaaacggttttacgttttaccgggaaccgtttaaccggttttaccgttttaaacggtttttaaccggacggtttaacccgtaaccggttaaccgttaacggtttaaccgggttaccggggtttaacggggggtaaacccgttacccggggtttaaacccggggaaacccgggttaaaaccggggttaaaccgggtaaaccggggttaaaccggtaaaaaccgtttaacccggggaaaaccggttttaaccgggtacgggttaacccgggtaacccgttaaccgggtaaccccttaacccggttaccgttttccccggttaaaccggttttacccccgtttacgttaaacccccgttttccccccgttaacccgggtacctttaacccgggg

SEQ ID NO: 90588 - DNA, 606 bp, Homo sapiens
  misc_feature: GYAE6OF01E44I5.33.7.A07.1.454.CMB.1.raw
  modified_base (196)..(196): a, c, t, g, unknown or other
  misc_feature (196)..(196): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgctccaggagaaagngccaccctctcatgcagggccagtcagagtattagcatcttcttggcctggtaccaacagaaacctggccaggctcccaggctcctcatccagaatgcattcaacagggccactggcactcccagccaggttcagtggcaggtgggtctgggacagacttcactctcacatcagcagccctagacgctggaggtacttcgtgccttaagttttacttacgtacgttcgacgtctaggtcgttcctaccgaaccttccggggtacccttcccgggtcggtacccttaccccggtttccgggcccggtaaacggggtaccaaccgggttaacgttcgggtaaggtaacgtttaacggaaccggtaaacgttcgggtaggtacccgtagggccctaccccgttcgttacccgg

SEQ ID NO: 90589 - DNA, 628 bp, Homo sapiens
  misc_feature: GYAE6OF01ES6TT.33.7.A07.1.454.CMB.1.raw
  modified_base (197)..(197): a, c, t, g, unknown or other
  misc_feature (197)..(197): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaagttgtgttgacgcagtctccaggcaccctgtctttgtctccgaggggaaanagccaccctctcctgcagggccaatcagagtgctggcagcaacttagcctaggtaaccaaacaaaacctggccagacctcccaggcctcctcatctatgatgcactacccgaccgacgggcccacgtggaccactccccgagccctaaggttccaggtcggctagggtgggtacgtaggggactacgacctttcacgttacctccaccatcacgccaacgaccttaggacgtccgttaggtaacgttagttttacgaccgtttaagtttttactacgttgtcttcgcgtacggtcgtacgactaaccgtcggtaaccctaacgtcccgttaccgggaaccgaacgggtaccaacggtacgtagggtaacgtaaacgttaaccgacgtggacggtctacggacctaccgtatccgttattctgtccttcccg

SEQ ID NO: 90590 - DNA, 773 bp, Homo sapiens
  misc_feature: GYAE6OF01EFIG2.33.7.A07.1.454.CMB.1.raw
  modified_base (701)..(701): a, c, t, g, unknown or other
  misc_feature (701)..(701): n is a, c, g, or t
  modified_base (728)..(728): a, c, t, g, unknown or other
  misc_feature (728)..(728): n is a, c, g, or t
tcagtacacacactcacgaccggtgctcgatttagcacgtgtcgcgagggggaggaactgctcagttaggacccagagggaaccatggaagccccagctcagcttctcttcctcctgctactctgctcccagataccaccggagaaattgtgttgacacagtctccagccacccttgtctttgtctccgaaggggaaagagcccaccctctcctgcgacggccagtcagagtgttaggccgggtacctagcccgtacggtaaccaaacgaggacgtaccgtcggacccgaacgggtccctcccgaggtcccttcccttacgtttactatgatcgacctactacccaaacggacggggccctaacggtcggacctacctaccccgacgtacccggtaggtttaccgacgggttcgggtaccggggttggggtaccgttacggggaacgtaacggttaccttaccgaccttacccaccgtaacctacgtacgacgtaccgaacgtaccgtaacgacgtaacccgtaggtaaaagtttctttttacggaacgtttaagttttaacttacgttacggttacgaacgttacgaccggtacgttaacgtaccgttaacggttgggttaccgtttaacggggtaacccggttacccggaacggtaaccggggaaccgtaaaggggtaactaaacgacgtaaaaccggntttcggacggttacgacaccgttaacncgttcgttccgtacctttcacccgtttccctcccgactgttaccg

SEQ ID NO: 90591 - DNA, 563 bp, Homo sapiens
  misc_feature: GYAE6OF01C16T6.33.7.A07.1.454.CMB.1.raw
  modified_base (197)..(197): a, c, t, g, unknown or other
  misc_feature (197)..(197): n is a, c, g, or t
  modified_base (377)..(377): a, c, t, g, unknown or other
  misc_feature (377)..(377): n is a, c, g, or t
  modified_base (403)..(403): a, c, t, g, unknown or other
  misc_feature (403)..(403): n is a, c, g, or t
  modified_base (413)..(413): a, c, t, g, unknown or other
  misc_feature (413)..(413): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagngccaccctctcatgcagggccagtcagagtattagcatcttcttggcctggtaccaacagaaacctggccaggcctcccaggctcctcatccagaatgcattcaacagggccacgtggcactccccagccctaggttcaggtcggcaggtcgggtctggggacagtacttcactctcacntcagcagcctagcgcctgagtattcngctagttttntactgtcagtcagtcgtactacaacgtcggtccttccgtgtccctaccgttcggaccgtaagggacctacggtagtttcgggaagttaacgttaacggaaccggtaacgttcgggttacggacctttacggccctacccgttcgttaccg

SEQ ID NO: 90592 - DNA, 774 bp, Homo sapiens
  misc_feature: GYAE6OF01BONY1.33.7.A07.1.454.CMB.1.raw
tcagtacacacactcacgaccggtgctcgatttagcacgtgtcgcagggggaggaactgctcagttaggacccagagggaaccatggaagccccagctcagcttctcttcctcctgctactctggctccagactaccaccggagaaattgtgttgacacagtctccagccacctgtctttgtctccgaggagaaacgcgcccaccctctacagtcgcgagggccagtcgaagagttaattacgctatttccttcgttcggccttaggtaacccaacgaacgaaacccgtcggacccgacggtcctcccgaggtcccttccgtacactcccgaagtaactcgactacttaccgaacgacgggccacgtcggacctaccgtacccgacggtacccgtagggttaccgagggtcggtacgtaggggttcggggtacgtagggtaccgacggttaccttccgtaaccgttcctaccaccgtacttaccgacgtaccgtaccggtacccgttaacggacgttaccgttacggacggtttaacttcggtacgttacgttttaacgtttttacgtaaccgttggtaaccgacggttacgtacgttcccgttaacttaccggtaaccggtcccggttacccgtcggttaccgtaccccggttaccggtacccggtaaccgggaacgggttaccctaagggttggtacgggtaagttaacgttacgggaaccgttacggttcgggtcgtacccgttacccgtacccttcccggtttgttaccg

SEQ ID NO: 90593 - DNA, 804 bp, Homo sapiens
  misc_feature: GYAE6OF01EZIDE.33.7.A07.1.454.CMB.1.raw
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccacccttgtcttttgtctccgaggagaaagcgccaccctctcatgcaggccagtcagatatagcatcttcgttggcctaggtaccaagaacgaaaccgtggccgaggtcctcccgaggcctcctcactaccagaactcgactaattaccgaacgacgggacccagtcggccacgtccccgagtccgtaaggtttccaggtcggcgtaggggttcgggtacgtcggggaactacgtaaccgtttcaaccgttcctaaccaccctaattccgaagtaccgaacggtacccgtaaggaccgtaccgttagggtaacggttactttaccggttacggtaccttttaaggtttttaacctttaccgttacggtttacgaacgggtaccgtaacgttcccggttaccccttaacggtaaaccccggttccgggtacccccgtttacccgggttccgttaacccccgttacccgggttacccggaaaccccgggtaaacggggttaaacccgaaacccgggtttaagggtttaccgggaaggtttaaaccggtttaaaccgggtaaacccgggttaaacgtttccggggtaccgggttccttaaccgggacccccttaaccccggttcggtttttaacccgg

SEQ ID NO: 90594 - DNA, 577 bp, Homo sapiens
  misc_feature: GYAE6OF01A4J8E.33.7.A07.1.454.CMB.1.raw
  modified_base (332)..(332): a, c, t, g, unknown or other
  misc_feature (332)..(332): n is a, c, g, or t
  modified_base (571)..(573): a, c, t, g, unknown or other
  misc_feature (571)..(573): n is a, c, g, or t
  modified_base (575)..(575): a, c, t, g, unknown or other
  misc_feature (575)..(575): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcattctcacatcagcagactggagcctagaagtnttttgactagtcgtattactgtcagtcagtacggtagttcattccgtaccgtacggttccggacccgtaaggggaccgaagggtacggtaaactacgaaaaccggtaactggtaggtacctgacctaccacgttctgttaccttcctaacttccgttccccgcctacttcgtagtaagtcggttgtcgttacgtgggtacggccggggtctcgggacccgaagggccgactacggaggnnngncg

SEQ ID NO: 90595 - DNA, 629 bp, Homo sapiens
  misc_feature: GYAE6OF01BIRM6.33.7.A07.1.454.CMB.1.raw
  modified_base (196)..(196): a, c, t, g, unknown or other
  misc_feature (196)..(196): n is a, c, g, or t
  modified_base (604)..(604): a, c, t, g, unknown or other
  misc_feature (604)..(604): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctcagccaccctgtctttgtctccaggagaaagngccaccctctcatgcagggccagtcagagtattagctatcttcgttggccttggtaaccaacacgaaaccgtggccaggcctacccgaggcctcctacactccaagaactggcctatccaacgacggcctacgtcggacacgtccccagtccgtaggttccgaggtacggtcgtagggtcgggttcgtacggggactagtaccgtttaccgactccgtacctaacccgagttccgacgtaccgacgtaccctaggacgtccgttaggacgtacttcgtacgacttagttttactacgttgtacctagacgtagtccgtactaccgaacgttcggtcccttaccggtcgcccgtaccgtaccggaccgtaacggaccgtagtacgtggaacgtaggtaccgacgtacgngtcggacttagaccctcgtcgttcg

SEQ ID NO: 90596 - DNA, 812 bp, Homo sapiens
  misc_feature: GYAE6OF01DVW91.33.7.A07.1.454.CMB.1.raw
tcagtacacacactcacgaccggtgctcgatttagcacgtgtcgcagggggaggaactgctcagttaggacccagagggaaccatggaacgccccagctcagcttctcttcctcctgctactctggctcccagactaccaccgggagaaattgtgttgacacagtctccagcccaccctgttctttgtctccgaaggagaaagcgcccaccctctcatcgcgagggccagtcagatatagctattcttctcggccttacggaccaaacacgaaacctcggccgtaaggccctcccgaggtccctcccttcacgttcccaagtaacgtgactataccgaaccgtacgggaccctagtcggacctacgttaccccgacgaccccgtacggttacgtaacggtcggtacgtagggttggggtaccggttacgggggaactacgggtaaccttttacccgaccgtttacccttaccaaacccgttatacccgacgtacccgaacgtaccccgttaaggaccgtacccgtagggtacgttaacgttcgtacggttacctttaacgttttaactttaccgttaggtccgtaggtaccgtacggttacccgttccgtaccgtaaacccggtttcccgggtaaccccgttcccggttcccggttaccccgtacccggtttaccggggtaaaccccggtaaaggggtacccgtaacgggtaacggtttaaccggggaaggtttaacccggttaagggtaaccggttaaccggttacgggttcggtacccgtcgtaccccgtacccgttcggttttaacccg

SEQ ID NO: 90597 - DNA, 855 bp, Homo sapiens
  misc_feature: GYAE6OF01BBR7P.33.7.A07.1.454.CMB.1.raw
tcagtacacacactcacgaccggtgctcgatttagcacgtgtcgcagggggaggaactgctcagttaggacccaggagggaaccatggaacgccccagctcagcttctcttcctcctgctactctggcctcccagactaccgaccggagtaaattgtgttgacacagtcctccagccacccttgttctttgtcctccgaggaacgaaagcgccctacccttctcagtcgccgacgggcccaaggtcgaaggtaagttacttacggaccttacgtttccgttttcggttcgggacccgttagggtaaacccctaaacgtaaaccggtaaaacccgtcgggacccgtacgggccctaccccggaagggtccctaccctaccgacgttacccgaaaggtaacttacggaccttaacgtttaaccgaaaccggtacgggtaccctacggtacggaccctaccgtaccccgacgccggtaaggttccgtaggtcggacgtaggggttcggggtcgtacgggacacggttaccttacgaccgtcctaccaaccttacgaccgacgacccgtaggacccttagggacccgtcgttacggacgttcgttaccgtacggtacgtttacgttttaacttccggtttacgtaccgaggttaccgtacgttacccgttaccgtaaccggtaaccgttcccgggtcccgtttaccgtaccgttacccggttaacccggttccgggaaaccccgggtaaggtaacccgttaaggtaccggttaacgggaaacgttacggtaacggtaaccgtaacggttcgggtcccggtttaccacgggttaaccccttccgggtttctttacccggg

SEQ ID NO: 90598 - DNA, 759 bp, Homo sapiens
  misc_feature: GYAE6OF01BIPDZ.33.7.A07.1.454.CMB.1.raw
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
  modified_base (294)..(294): a, c, t, g, unknown or other
  misc_feature (294)..(294): n is a, c, g, or t
  modified_base (563)..(563): a, c, t, g, unknown or other
  misc_feature (563)..(563): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagactaccaccggagaaatttgtgttgacactagtctccagcccacctgtctttgctcaggagaaagcgccacctncatcgcagggccagtcagtagtatacgntattcttacgtggcctggtacccaacagaaacctggaccaggcctcccaggcctaccgtntactaccaagaatcgactacttaccgaaacgtcgggaccacgtggacacgtcccagcctaggttcaggtcggactagggtggtccgtaggggactacggactttacgacctttccgtacctaaccgtattaccgacgtaccgaacggtacccgtacgtaaccgtcccggtaagggtaacggttaaccgtttacgacgggttaccttaaaggttttaaccgtttcgttaacggttaaccgtaggtaacccgtacggttcccgtttaaccncccggttaaacgtccccgggttaacccgttcccggtttaccggtacctttaaccccggtttaccggggaaacccgggttaaacggggacccgtaacggggttaaccgttggggtaaaacgtacggtttaaaccggaacggttaaccgtgggttaaccgggtcctaaccggtaccccgttcccgttccgtttaccgg

SEQ ID NO: 90599 - DNA, 778 bp, Homo sapiens
  misc_feature: GYAE6OF01EHIDS.33.7.A07.1.454.CMB.1.raw
tcagtacacacactcacgaccggtgctcgatttagcacgtgtcgcagggggaggaactgctcagttaggacccagagggaaccatggaagccccggctcagcttctcttcctcctgctactctggctcccagataccgaacggggaattgtgttgacacagtctccagccacccttgttctttgtcctccgaaggggaacacgccaccctctcctgcgacgggccagtcagagtgcgtggcagactaacgttgccgtacggtaaccaaaacctaaaaaccgtcggaccaacgtaccctacccgaacggtccctacctacgtattacctatacgagttcgaccttacgaccccgtaccgggaccgggaccctacgtcggacctaccctacccgaagtcccgtaaggttcgagggtcgaccgtaggggttcggtcgtacggggaactacggttacctccgtacctaccgtaccctaacctacgtaacgacgtaccaccggtacgtacggaacctaccggtaaggttaacgtttcttttacggtaactttaacgttttacgtttaaccgttcgttacgttcgtacgttacggtacgttaacgtaccttaaccgtaccgtaacccgttaaccgtacccggttaccgggaaaccgtacgggtaaccgaaccggtacggtaacggtaaaggttaaaccgtaaacggtaagttcgggtacgtaccggtactaacgaccttacggttaccttcgttactttaccctccgttcccgtcccgttaacg

SEQ ID NO: 90600 - DNA, 573 bp, Homo sapiens
  misc_feature: GYAE6OF01DTZOV.33.7.A07.1.454.CMB.1.raw
  modified_base (429)..(429): a, c, t, g, unknown or other
  misc_feature (429)..(429): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagacgccaccctctcatgcagggccagtcagagtattagctatcttcttggcctggtaccaacagaaacctggccaggcctcccgaggcctcctcactccagaatgactattcaacgacgggccacgtggaccactccccgacgcctaggttcaggtggctagggtgggtcgtgggacagtacttcacgtctaccaccatcgacgcacgtacctagcgcctaggaggtacttcgngtacgttagttttattacgtgtacacgctacgtcctctactacgtcggtccctcggtcgcctaccgttcggacccgtaaggaccacggtagtaggagtacgttacggacgtagtcggtcggactcggacccaccgttcgttacg

SEQ ID NO: 90601 - DNA, 743 bp, Homo sapiens
  misc_feature: GYAE6OF01A4ZJ1.33.7.A07.1.454.CMB.1.raw
tcagtacacacactcacgaccggtgctcgatttagcacgtgtcgcgagggggaggaactgctcagttaggacccagagggaaccatggaagccccagctcagcttctcttcctcctgctactctggctcccagactaccaccggagaaattgtgttgacacagtctccagccaccctgtctttgctccaggagaaagcgcccaccctctcatcgcagggccagtcagtagtattagctatcttcgtggcctggtaccaacagaaacctggccaggcctacccgaggcctacctcactaccaagtatcgctagttccaacgtcgggacctacgtggaccactccccgagtccgtaggttcacggtggacgtagggttcgggtcgtaggggacctaggtacctttccaacttcctaccgaaccgtactaccgagacccttaacggcccgttaaggaccgtaccggttaggaacgggttactttacggacggttaacgtttaaggtttttaacttaacccgtggttaccctaacggtaccgtaacggttcccgttaccgtacccgtaacgttcccggggttccccttaccggttacgtaccccggttaacccggttccgggaacccgggtaaaccgggtacccgtaacgggttaacggttacggggtaaacgtttacggtaaaccgggaacccgttaacgtttcgggtacggttccctaccggtaccccttaccgttcggttaccg

SEQ ID NO: 90602 - DNA, 788 bp, Homo sapiens
  misc_feature: GYAE6OF01A6FB2.33.7.A07.1.454.CMB.1.raw
  modified_base (223)..(223): a, c, t, g, unknown or other
  misc_feature (223)..(223): n is a, c, g, or t
tcagtacacacactcacgaccggtgctcgatttagcacgtgtcgcagggggaggaactgctcagttaggacccagagggaaccatggaagccccagctcagcttctcttcctctgctactctggctcccagataccacggataattgtgttgacacagtcctccacgccctacccttgttcctttcggtacctaccgagggaagaaacgacgccctacccctntacagtcgcgacgggaccagtcagtagttattagctattcgttcgttcggccttacggtaaccaacgtacgaaaccgtcggaccacggtccgtacccgaccggtaccttcctacctacgtacccgaaggtaactgtaccgtactacgaaaccgcggacctacgtcgactacgtcccgagacgtacgttcgaggtcgacgtggtacggctcggaactagtctcgactcgacacgtcaacgtcgacgtaacgtccgtaacggtacgtacccgttaaggtaagtttacgtttaacgtaccggttttaacgttttcgtttaaaccggtgttaaccggtaacggtaaccggtaagttcccgggtttaaacgtaaccggtttaaccggtttaccggtttacccggtttacggggtacccggttaacgggtaaccccggggtaagggtaaacccggttaagggtaaaccgggtaaaacccgttaacgtaaaccgggtacgtttaggtaccgggtaccaccgtaccgttaaccgtacggttacttccgggttacctttaccgtcgttaccccg

SEQ ID NO: 90603 - DNA, 746 bp, Homo sapiens
  misc_feature: GYAE6OF01BKLC1.33.7.A07.1.454.CMB.1.raw
tcagtacacacactcacgaccggtgctcgatttagcacgtgtcgcagggggaggaactgctcagttaggacccagagggaaccatggaagccccagctcagcttctcttcctcctgctactctcggctcccagactaccaccggagtaaattgtgttgacactagtctccagccctacccttgttcttttgtcctaccgaaggaagaaacgcgcccacccttcgtcagtcgacgacggccagtcagtagtattagctacttcgtttacgttcggacccttaggtaacccaaacgtaaccgtaaaccgttcggacccgaacggtccctacccgacggtccctccgtacactaccgaagtactcgactactaccgaacggcggaccacgtcgactaccgtccgacgtccgtaggttcgaggtggacgtggtacgggtccgaggacctacgtaccttacctacgtcctaccaaccgtctacgacgtacctacgtaccgtaacggtccgttacgtaggtaacgttacttcgtacgttacgtttaagttttaacttcgtacgacgtacgtcgtaaccggtcgttaccctaacgtacccggttccgtcccttaccgtcgtacccgttacccgtaaccggacggaaaccggttacgtacggtacggtttagggaacgttaacggtaacccggtacggttaacggtcggttaccgggaccgttaaccgtacccccgttacgttcgtttacccgg

SEQ ID NO: 90604 - DNA, 687 bp, Homo sapiens
  misc_feature: GYAE6OF01EGT98.33.7.A07.1.454.CMB.1.raw
  modified_base (194)..(194): a, c, t, g, unknown or other
  misc_feature (194)..(194): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagtaagttgtgttgacgcagtctcaggcaccctgtctttgctcgaggggaanagccacctctcctgcaggccaatcagtagtgtagctaagtacttagtctggtaaccaaactagtacgacctacgaccgacggcctacccgacggcctcctcacttcctaacgtactcggccgtaccaaccgtacggaccgacgtcggacctacctaccgacgaccgtacggtacgtcaaggttgggcgtaggtggggtactggggacctacggacctttcgaacctcgtacgtaccaagtaccaacggtacctaaacctttaggaaacgttttgttaaacgttatttttttacaagtttttaacgttaaccttagtaacctaaccgtaacgttacctaaccgggtctaacggtcccttacggtacccttacgttccgaacggtttcgggaaccgggtaacggggtaccgaagggtacgtaacggacgtacgtaacggtacgtaggtacgcgtacggctaccgtactcgtctcttctacctcttaccgtctacg

SEQ ID NO: 90605 - DNA, 782 bp, Homo sapiens
  misc_feature: GYAE6OF01BNTFO.33.7.A07.1.454.CMB.1.raw
  modified_base (482)..(482): a, c, t, g, unknown or other
  misc_feature (482)..(482): n is a, c, g, or t
tcagtacacacactcacgaccggtgctcgatttagcacgtgtcgcgagggggaggaactgctcagttaggacccagagggaaccatggaagccccagctcagcttctcttcctcctgctactctggctcccagataccacggagaattgtgttgacacagtctccagcccacctgtctttgtctaccgaggagaaagcgcccacctctcatgcagggccagtcagtagtattagctacttctttcgttcggaccttacgggtaacccaaacgaaccggtaaaacccgtcggacccgtaacgggtccctacccgtaacggcccttacccctacgtaactacccgaagtaactgtacctaattaccgaaacggtccgggacctacggtcggaccctacctaccccgaacgtcccgtaagggtccaggtcggacgaggggttcgggtacgtaggggacctaacgtaccttactaccttcgaaccnccgtaacgtcgagacctacgaccgtaacgaccgtacgtaggtaacggtctttaccgtagaccttttaaggttttaccttacggtcgttacgaacgttcggtaacgtccgtttacgaccgttaccccggtcgggtacccctttaccggttacccggtccttaacccgggttcccggaaccgggtaaacgggacccgttaacgggtaaggttacccgggttaaatacggtttaacccggggaaacttacgggttcggttacggaccgtttaccgccccttaacccgggtttccgttaacccg

SEQ ID NO: 90606 - DNA, 489 bp, Homo sapiens
  misc_feature: GYAE6OF02F3BUO.33.7.A07.1.454.CMB.1.raw
  modified_base (434)..(434): a, c, t, g, unknown or other
  misc_feature (434)..(434): n is a, c, g, or t
  modified_base (454)..(454): a, c, t, g, unknown or other
  misc_feature (454)..(454): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagagccaccctctcatgcagggccagtcagagtattagcatcttcttggcctggtaccaacagaaacctggccaggctcccaggctcctcatccagaatgcattcaacagggccactggcatcccagccaggttcagtggcagtgggtctgggacagacttcactctcaccatcagcagcctagagcctgaggattctgctagtttattactgtcagcagcgtctcaactggcctccgtncacttcgccaagggcacggnttggatatagacgaactgtcggctgccacctctcg

SEQ ID NO: 90607 - DNA, 484 bp, Homo sapiens
  misc_feature: GYAE6OF02GNHUS.33.7.A07.1.454.CMB.1.raw
  modified_base (392)..(392): a, c, t, g, unknown or other
  misc_feature (392)..(392): n is a, c, g, or t
  modified_base (455)..(455): a, c, t, g, unknown or other
  misc_feature (455)..(455): n is a, c, g, or t
  modified_base (481)..(481): a, c, t, g, unknown or other
  misc_feature (481)..(481): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagagccaccctctcatgcagggccagtcagagtattagcatcttcttggcctggtaccaacagaaacctggccaggctcccaggctcctcatccagaatgcattcaacagggccactggcatcccagccaggttcagtggcagtgggtctgggacagacttcactctcaccatcagcagcctagagcctgaggattcngcagtttatactgtcagcagcgtctcactggcctcgtgcaccttcgccagggcacgattgganattagacgaacgtgtggctgcacctntcg

SEQ ID NO: 90608 - DNA, 519 bp, Homo sapiens
  misc_feature: GYAE6OF02HJEC1.33.7.A07.1.454.CMB.1.raw
  modified_base (378)..(378): a, c, t, g, unknown or other
  misc_feature (378)..(378): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagagccaccctctcatgcagggccagtcagagtattagcatcttcttggcctggtaccaacagaaacctggccaggctccaggctcctcatccagaatgcattcaacagggccactggcatcccagccaggttcagtgcagtgggtctgggacagacttcactctcaccatcagcagcctagancctgagattctgctagtttattactgtcagcagcgtctcaactcgcctcgtgccaccgttcggaccaagggaccacggacgttgggacgtagttaagaccgtaacgttcggtacgggccttacggcctacccgttgtacgg

SEQ ID NO: 90609 - DNA, 496 bp, Homo sapiens
  misc_feature: GYAE6OF02GMB2U.33.7.A07.1.454.CMB.1.raw
  modified_base (493)..(493): a, c, t, g, unknown or other
  misc_feature (493)..(493): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagagccaccctctcatgcagggccagtcagagtattagcatcttcttggcctggtaccaacagaaacctggccaggctcccaggctcctcatccagaatgcattcaacagggccactggcatcccagccaggttcagtggcagtgggtctgggacagacttcactctcaccatcagcagcctagagcctgaggattctgctagtttatactgtcagcagcgtctcactggcctccgtgccaccgttcggccaagggccacggagttgggatattagacgaacgtgtggctgctaccctntcg

SEQ ID NO: 90610 - DNA, 505 bp, Homo sapiens
  misc_feature: GYAE6OF02IT69U.33.7.A07.1.454.CMB.1.raw
tcagtacacacactcacgaccggtgctcgatttagcacgtgtcgcagggggaggaactgctcagttaggacccagagggaaccatggaagccccagctcagcttctcttcctcctgctactctggctcccagataccaccggagaagttgtgttgacgcagtctccaggcaccctgtctttgtctccaggggaaagagccaccctctcctgcagggccaatcagagtgttagcagtaacttagtctggtaccaacatagacctgaccaggctcccaggctcctcatctacgatgcgtccaacagggccactggcatcccagccaggttcagtggcagtggtctgggacagacttcactctcaccatcagcagcctagagcctgaagattttgctagtttattactgtctgcagcgtagcaactggacctaacaccttcggaccaagggacacgactggagattaacgactgtggctgcaccatctgtccttcacttccttcccgc

SEQ ID NO: 90611 - DNA, 536 bp, Homo sapiens
  misc_feature: GYAE6OF02GWPE5.33.7.A07.1.454.CMB.1.raw
  modified_base (529)..(529): a, c, t, g, unknown or other
  misc_feature (529)..(529): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagagccaccctctcatgcagggccagtcagagtatagcatcttcttggcctggtaccaacagaaacctggccaggctcccaggctcctcatccagaatgcattcaacagggccactggcactcccagccaggttcagtggcagtgggtctgggacagacttcgactctcaccatcagcagcctagacgcctgaggtattcgtgctagtttactactgtcagcagcgtctacacgtcgccctccgtgcctaccgttcggacccaaggggaccacggtagttcgggaagtacgttaacggaacgtaacgttggtacggtacttcggcctacccgttnttaccgg

SEQ ID NO: 90612 - DNA, 708 bp, Homo sapiens
  misc_feature: GYAE6OF02IMMZC.33.7.A07.1.454.CMB.1.raw
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
  modified_base (340)..(340): a, c, t, g, unknown or other
  misc_feature (340)..(340): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccggggaaagagccaccctctcctgcagggccagtcagagtgttagcgggtacctagcctggtaccaacagagacctggccaggcctcccaggctcctcttctatgatgcactcccaccagggccactggccactccccagcccaggttcagtggcaggtgggtctgggacngacttcactcncaccntcagcagcctagngcctagaagtntttgctagttttatactgtctgctagcgtagcctaactgggacccttaaacacccgtttcgggaccgtaaacggggaccaaccggtacgtagggtaaacgtaaacgttaaaaccggtaaccgttagggttacgggtacctacggtacccgtaacccgtaagttcccgtttacgtttacccttttaccgtaaccgttttcccccgttttaccccggaccccgtttaacttacccggttaagggtaaaccgtttcgggttacgtttacggttaaccggttgggtaaccgggtcccggggggttaccttaacggggggtacccgtaaaggggtcccggtaaccggtacggtttaacgggctacggtactgg

SEQ ID NO: 90613 - DNA, 502 bp, Homo sapiens
  misc_feature: GYAE6OF02HPBAR.33.7.A07.1.454.CMB.1.raw
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagagccaccctctcatgcagggccagtcagagtattagcatcttcttggcctggtaccaacagaaacctggccaggctcccaggctcctcatccagaatgcattcaacagggccactggcatcccagccaggttcagtggcagtgggtctgggacagacttcactctcaccatcagcagcctagagcctgaggattctgctagtttatactgttcagcagcgtctacacgtgcctcgtcgcctaccttcgccaagggaccacggtattcgggagtacttagacgtaatggtcggctgcctacctctcg

SEQ ID NO: 90614 - DNA, 519 bp, Homo sapiens
  misc_feature: GYAE6OF02F1LKT.33.7.A07.1.454.CMB.1.raw
  modified_base (303)..(303): a, c, t, g, unknown or other
  misc_feature (303)..(303): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagagccaccctctcatgcagggccagtcagagtattagcatcttcttggcctggtaccaacagaaacctggccaggctcccaggctcctcatccagaatgcattcaacngggccactggcatcccagccaggttcagtggcagtgggtctgggacagacttcactctcaccatcagcagcctagacgcctggagattctgctagtttactactgtcagcagtcgtctctacgtcgcctcgtgcctaccttcggccaagggacacggtagttgggaatagttaacggacgtaacgttcggtaggtccgtcgcctacccttcgttcg

SEQ ID NO: 90615 - DNA, 539 bp, Homo sapiens
  misc_feature: GYAE6OF02F0VLP.33.7.A07.1.454.CMB.1.raw
  modified_base (529)..(529): a, c, t, g, unknown or other
  misc_feature (529)..(529): n is a, c, g, or t
  modified_base (531)..(532): a, c, t, g, unknown or other
  misc_feature (531)..(532): n is a, c, g, or t
  modified_base (537)..(539): a, c, t, g, unknown or other
  misc_feature (537)..(539): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctagaagtattttgctagtctattactgtcagcagtatacgtaggggagtacgttcggaccgaaaggggaccaagggtaggaaatacgaaaacgaacgtagtggctgacaccgatctgttcttcacttcttacccgcctatctgaagttgtgttgtactggacggtcgggtcgttcgggacgtaacggggcgacgtaagtacggngnngtcgnnn

SEQ ID NO: 90616 - DNA, 519 bp, Homo sapiens
  misc_feature: GYAE6OF02HMRPN.33.7.A07.1.454.CMB.1.raw
  modified_base (417)..(417): a, c, t, g, unknown or other
  misc_feature (417)..(417): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagagccaccctctcatgcagggccagtcagagtattagcatcttcttggcctggtaccaacagaaacctggccaggctcccaggctcctcatccagaatgcattcaacgagggccacgtggcactcccagccaggttcagtggcaggtgggtctgggacagacttcacttctcaccatcagcacgcctaagcgcctaggaggtattctgctaagtttattacngtcagcagctctcacgtcggcctcgtgccacgttccggaccaagggccacggtagttggacgtagttaagacgtaagtggtcggctcgacctaccctgttcg

SEQ ID NO: 90617 - DNA, 631 bp, Homo sapiens
  misc_feature: GYAE6OF02FH8A0.33.7.A07.1.454.CMB.1.raw
  modified_base (220)..(220): a, c, t, g, unknown or other
  misc_feature (220)..(220): n is a, c, g, or t
  modified_base (229)..(229): a, c, t, g, unknown or other
  misc_feature (229)..(229): n is a, c, g, or t
  modified_base (279)..(279): a, c, t, g, unknown or other
  misc_feature (279)..(279): n is a, c, g, or t
  modified_base (333)..(333): a, c, t, g, unknown or other
  misc_feature (333)..(333): n is a, c, g, or t
  modified_base (451)..(451): a, c, t, g, unknown or other
  misc_feature (451)..(451): n is a, c, g, or t
  modified_base (625)..(625): a, c, t, g, unknown or other
  misc_feature (625)..(625): n is a, c, g, or t
tcagtacacacactcacgaccggtgctcgatttagcacgtgtcgcagggggaggaactgctcagttaggacccagagggaaccaatggaacgccccgagctcagcttctcttcctcctgctactctcggctccccagacttaccgaccgggagaaaacttgtcgtttggaccaccaggtcctcccaagcccacccgtgtcctttgctccgaggagaaagngccaccctntcatgcagggccagtcagagtctagcatcgttcttggcctggtaccaacngaaacctggccaggcctcccaggcctcctcgatccagaactcgcattacgaacncgggccacgtggccaatccccgagccctaggttccaggtcgacaggtgggtctagggactaggtctcgactcctcacctatccagccacggcctaggaccgccctaggacgtattccngaccttagtttactacgttgtaccgacgtcgacgtcgttcctacgaaacctccggtcccgttacccggttcgacccttacccggttccgggaccgtaaacgggcaaccggtagtttacgggaactacgtttaacgaccgtaacgttggtacggccttcggaccctacccgtttntaccgg

SEQ ID NO: 90618 - DNA, 590 bp, Homo sapiens
  misc_feature: GYAE6OF02GOP9O.33.7.A07.1.454.CMB.1.raw
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagagccaccctctcctgcagggccagtcagagtgttagcgggtactagcctggtaccaacagagacctggccaggctcccaggctcctcttctatgatgcatccaacagggccacgtggcatcccagccaggttcaggtggcggtggtcgtgggacagacttcactctcaccatcagccggcctccagtctgaagtatttgctagtttattactgtcagtctagtatactaactcggcctccctatacgtacttacgtttcggtaccgacggggtaacccaaggtccgtagggacgtacgttacgacgggtaccggtaacgttcgggtcgggtaccgttacggaccctaacccgtacggttacccgtttacggtttccctttacccgttaaccccg

SEQ ID NO: 90619 - DNA, 510 bp, Homo sapiens
  misc_feature: GYAE6OF02GX514.33.7.A07.1.454.CMB.1.raw
  modified_base (255)..(255): a, c, t, g, unknown or other
  misc_feature (255)..(255): n is a, c, g, or t
  modified_base (367)..(367): a, c, t, g, unknown or other
  misc_feature (367)..(367): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagagcccaccctctcatgcagggccagtcagagtattagcatcttcttggcctgtaccaanagaacctggccaggctccagctcctcatccagaatgacattcaacagggccactgcatcccagccagttcagtcggcaggtgggtctgggacagacttcactctcacatcancagcctagcgcctgacgtattctgcttagtttatactgtacagacagtctctaccacgtggtccctcgtcgcctaccgtcgaccgaagggccacggtacgtggaatattaacggacgtagtagtcggcctgacctcccgtgtc

SEQ ID NO: 90620 - DNA, 507 bp, Homo sapiens
  misc_feature: GYAE6OF02FOXMO.33.7.A07.1.454.CMB.1.raw
  modified_base (337)..(337): a, c, t, g, unknown or other
  misc_feature (337)..(337): n is a, c, g, or t
  modified_base (504)..(504): a, c, t, g, unknown or other
  misc_feature (504)..(504): n is a, c, g, or t
tcagtacacacactcacgaccggtgctcgatttagcacgtgtcgcaggggggaggaactgctcagttaggacccagagggaaccatggaagccccagctcagcttctcttcctcctgctactctggctcccagataccaccggagaaattgtgttgacacagtctccagccaccctgtctttgtctccaggagaaagagccaccctctcatgcagggccagtcagagtattagcatcttcttggcctggtaccaacagaaacctggccaggctcccaggctcctcatccagaatgcattcaacagggccactggcatcccagccaggttcagtggcnggtgggtctgggacagacttcactctcacctatcagcagcctagacgcctgaagtatttgactagtttattactgttctgcagcgtagcaacgttggacctaacaccgttcggaccaagggacacgacgtaggagattaaacgatggtgctgcacgatctcgtcttntac

SEQ ID NO: 90621 - DNA, 653 bp, Homo sapiens
  misc_feature: GYAE6OF02GYNHZ.33.7.A07.1.454.CMB.1.raw
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaaggccaccctacctcactgcgcgggaccgacgtacgagagtaagttagtacgacttactttcgtttcggtccgtcggttaaccgaaccaacgaaaccgtacggccgacggcgtccccgacggcgtccctcctatccctaacgaagtagccgacttactaaccgaacgggccgaccgtggcgactcccctacgaccgacggttcgtagtggcgaggtgggtcgtgggacgagtactccgtactctccaccactcacgcacgccgtagacgtcctaggaggtacttctcgcgtaagttttattactcgttagacgtacgacgtcgtaccttactaacgtccggtccgtccgttcgaccttacccgtccggaaccgaaccggcgtaacgtcgttagggtacgtaacttaggaaccgtacgttggttcggacgttccggacctccccttagtttcgttacccg

SEQ ID NO: 90622 - DNA, 559 bp, Homo sapiens
  misc_feature: GYAE6OF02HMG6P.33.7.A07.1.454.CMB.1.raw
  modified_base (195)..(195): a, c, t, g, unknown or other
  misc_feature (195)..(195): n is a, c, g, or t
  modified_base (290)..(290): a, c, t, g, unknown or other
  misc_feature (290)..(290): n is a, c, g, or t
  modified_base (391)..(391): a, c, t, g, unknown or other
  misc_feature (391)..(391): n is a, c, g, or t
  modified_base (448)..(448): a, c, t, g, unknown or other
  misc_feature (448)..(448): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggggaaattgtgttgacacagtctccagccaccctgtctttgctccaggggaaanagccaccctctcctgcagggccagtcagagtgctggcagcaacttagcctggtaccaaacaaaaacctggaccagactccaggctcctcatctangatgacactccaccgagggcccaacgtcggcactcccagcctaggttacagtggcaggtgggtctgggacagacttcactcacacatcagcagcctagacncctagaagtatttgactagtttatactgtactgcagcgtagcaatcgtacctaaacncccgttacggaccaaacggaccaacggacgttagggagtaacgttaaacgacgttggtcggacgtcggaccaacgtactacgttacgttaccttcaccgttcccgtacccg

SEQ ID NO: 90623 - DNA, 809 bp, Homo sapiens
  misc_feature: GYAE6OF02H5QT7.33.7.A07.1.454.CMB.1.raw
  modified_base (285)..(285): a, c, t, g, unknown or other
  misc_feature (285)..(285): n is a, c, g, or t
tcagtacacacactcacgaccggtgctcgatttagcacgtgtcgcagggggaggaactgctcagttaggacccagagggaaccatggaagccccagctcagcttctcttcctcctgcctactctggctcccagataccaccggagaaattgtgttgacacagtcctccagcccaccctgtctttgtctccaggagaaagagcccaccctctcatgcagggccagtcagagtattagcatcttcttggcctggtaccaacagaaacctggccaggctccagctccncatccagaatgacattcaaacgcgggacccacgtcgggaccaactccccgagtccccgtagggtttaccagggttcggaccgtaagggttcggggttaccgtacgggggtaaccacgggttaaccctttaccgaaccctttaccgttacccaaccccgaactttaacccgaacggtaccgaacccggtacccgttaacgggtaaacggtccccgttaggggtaaacgggtacctttacgtagggttaaccctttaaggttttttaacgtttaaccgttacggttacctaacgcgtaacggtcccgtttaccttaacccgaaccgtttcgggacccctttcccgggttaccggtacccgtaccccgttttccggggaacccgtaaaggggtaccccgtaacgggtaacggtttggggaaaaccggttaaacgttttaacgggaaacccggttaaaccggtttcgggttaaccggggaccgtttacccgggtaaccccttaccccccggtttagttttaccccggg

SEQ ID NO: 90624 - DNA, 656 bp, Homo sapiens
  misc_feature: GYAE6OF02F3HBO.33.7.A07.1.454.CMB.1.raw
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggagaaagagccaccctctcatgcagggccagtcagagtattagctatcttcttggcctggtaccaacagaaacctggccaggctcccgaggcctcctcactccagaatgactattcaacgagggccacgtggcactcccagccctaggttcaggtggcgtaggttcggggtactggggacaggtaccttccgacttctacctaccgatcgaacgtcacgtccgtagacgtccgtaggagtacttccgtgtacgttaaggttttaacttaccgttcgttaccgagtcgtacggtaccgttacgtaaccgaaccggttccggtacccgttccggttacgccccgttacccggtttaccgggaacccgttaacggggacccaacggttacggttacgggaacggttaacgtttaacggaacgttaacggttcggttaacgggtcttacggaccctacccgttgttaccgg

SEQ ID NO: 90625 - DNA, 732 bp, Homo sapiens
  misc_feature: GYAE6OF02GG99Z.33.7.A07.1.454.CMB.1.raw
  modified_base (196)..(196): a, c, t, g, unknown or other
  misc_feature (196)..(196): n is a, c, g, or t
  modified_base (256)..(256): a, c, t, g, unknown or other
  misc_feature (256)..(256): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaagttgtgttgacgcagtctccaggcaccctgtctttgctccgaggggaaangccaccctctcctgcagggccaatcagagtgttacgcagtaacttagtctggtaaccaanatacgacctgacctaggcctacccaggtcctcctcactctacgatcgccgtaccaacgacgggcccacgtggaccactcccgagccgtaaggttcaggttcggctagggttcggtacgtggggactacggtacctttcgaaccgtctaccaaccgtataccgacgtacctaaaccgtagacgtacctagtaaagttacgttttacggtactttaaacgtttttaacgttaaccgttgttaccgtaaggtaccgtaacgggttacgtaacgaccgtaaaccggtaccggtaacccttaaaccgttacccggtttacccgggaaccgtaaacggggtaccaaccgggtaaccgtaacggtaaacgtaacgtttaaaaccggtacgttagggtaccggtacgtacgtaacccgtaacccgtacgttacgttaccgttacctttaccgttaaccgtttccccgttacccgtccttaaccg

SEQ ID NO: 90626 - DNA, 609 bp, Homo sapiens
  misc_feature: GYAE6OF02G51VO.33.7.A07.1.454.CMB.1.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (253)..(253): a, c, t, g, unknown or other
  misc_feature (253)..(253): n is a, c, g, or t
  modified_base (280)..(281): a, c, t, g, unknown or other
  misc_feature (280)..(281): n is a, c, g, or t
  modified_base (380)..(380): a, c, t, g, unknown or other
  misc_feature (380)..(380): n is a, c, g, or t
  modified_base (602)..(602): a, c, t, g, unknown or other
  misc_feature (602)..(602): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaagttgtgttgacgcagtctccaggcaccctgtctttgctccagggaaagngcccaccctctcctgcacggccaatcagngtgttagcagtacttagtctggtaccaanatagacctgaccaggcctccagctccnntctacgatcgcgtaccaacgcgggccacgtggccacgtcccagcctaggtttcaggtcgcgtaggtcggtcgtaggggactaggtactttcaccgttcncctaccatcgatacccaaaccgtaagtaaccgttagtaatttactttttactaatttttacgttaactcgttacaacgtactacgacgtcagtcgacgtcctctacgttacgtttcggagggtacgaccgtaagggtccgagtaccgtacgaaacgtacgtcgtcggtcgtacaccgtaccgtatccgttacgttccttactccgttcccgtcccgtacctnttaccgg

SEQ ID NO: 90627 - DNA, 654 bp, Homo sapiens
  misc_feature: GYAE6OF02F8SBM.33.7.A07.1.454.CMB.1.raw
  modified_base (199)..(199): a, c, t, g, unknown or other
  misc_feature (199)..(199): n is a, c, g, or t
  modified_base (384)..(384): a, c, t, g, unknown or other
  misc_feature (384)..(384): n is a, c, g, or t
  modified_base (604)..(604): a, c, t, g, unknown or other
  misc_feature (604)..(604): n is a, c, g, or t
tcagtacacacactcacgaccggtgctcgatttagcacgtgtcgcagggggaggaactgctcagttaggacccagagggaaccatggaagcccccagctcagcttctcttcctcctgctactctggctcccagataccaccggggaaattgtgttgacacagtctccagcccaccctgtctttgtctccgaggggaaangccaccctctcctgcagggccagtcagagtgcgtggcaggcaacgttagcctggtaacccaaacaaaaacctggccaggctcccaggccttcctcctctatggtcgcactcccaccgacgggccacgtggcctactccccgaagaccgtaggttccaggttcggcaggttggggtcgtgggaacnggtaccttccacttctaccaacctataccggacgtacgtaccgtgggaacctccgtagaagttattttcggaccttagttaccttaacgttacgtcgtacgtaggtaccgtaggttaaccgttcggtagggggtactaccgggtttaccggaccggaacggggtactaagggtacggaaactacgaaacgtacgttggacgtacgtcgaccgtaaccgtntccgtcgttctacctacgttccctccgtcctattccggtagtacgttcgg

SEQ ID NO: 90628 - DNA, 714 bp, Homo sapiens
  misc_feature: GYAE6OF02HO7UI.33.7.A07.1.454.CMB.1.raw
  modified_base (197)..(197): a, c, t, g, unknown or other
  misc_feature (197)..(197): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggggaaagngccaccctctcctgcagggccagtcagagtgctggcagcaacttgcctggtaaccaaacaaaacctggaccagacctcccaggcctcctcatctatgatgcactcccgaccgagggcccacgtcggacactcccgagcccgtaggttccaggtcggccagggtcgggtcgtaggggactacggtacttaccgtacttcctaccgtaaccctattccgaacgtaccacgacccgttaaggacgtacccgtagaaacgttagttttacggactttaaggttttacttacgttagttaccacggtaccgaggtaccgtacggaccttaaccggttggttaccgttacggggtaccggtttaccggggaaccgttaaaccgggggaccgtaaaaggggttaacgggtaaaccttaacccgggtaaaacggttaaccggtagggttaaccggtacgttccggaaccgtaacccgttagtttaccgttacgtttaccgtttactaccgtttcccgttaccccg

SEQ ID NO: 90629 - DNA, 617 bp, Homo sapiens
  misc_feature: GYAE6OF02F0ZQ7.33.7.A07.1.454.CMB.1.raw
  modified_base (198)..(198): a, c, t, g, unknown or other
  misc_feature (198)..(198): n is a, c, g, or t
  modified_base (381)..(381): a, c, t, g, unknown or other
  misc_feature (381)..(381): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagcccaccctgtctttgtctccaggagaaagngcccaccctctcatgcagggccagtcagagtattagcattcttcttggcctggtaccaacagaaacctggccaggcctcccgggctccctcatccagatgctacttacaacgacgggccacgtcggcactcccagcctaggttcaggtgcgaggtgggtcgtggacagtctcactctccacancagcactcctagacgtcgtagtacgtacttctagtcttagtttacttacgttcgtacgtacgcgtacgtccgttctaccgtacgtcgtacccgtacgttccgtaccgtccgttaccggaccgtaaccgggtacctacgggtaacgttcggggtaaacggttaacggttaacgggtaaccgttaggttacgggtcggtaccgtccggtaccctacccggttccgttcggtttacccg

SEQ ID NO: 90630 - DNA, 545 bp, Homo sapiens
  misc_feature: GYAE6OF02G2LCF.33.7.A07.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (433)..(433): a, c, t, g, unknown or other
  misc_feature (433)..(433): n is a, c, g, or t
  modified_base (541)..(541): a, c, t, g, unknown or other
  misc_feature (541)..(541): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgctccaggagaaagngccaccctntcatgcagggccagtcagagtatagcatcttcttggcctggtaccaacagaaacctggccaggctcccaggcctcctcatccagaatgcattcaacagggccacgtggcactcccagccacggttcagtggcaggtgggtctgggacagacttcacgtcctcaccatcgagtcacgcctagacgtccgtaggagtacttcgtgaccgttagttttacttacgtgttcncgtcagtcgtctaccgtaacgtcgtccgttccgtcgacctccgtccggaccgacgggaccacgtagttcggagtagtacgacgtaagtggtcggtctcggctaccgtnttcg

SEQ ID NO: 90631 - DNA, 779 bp, Homo sapiens
  misc_feature: GYAE6OF02GPMGF.33.7.A07.1.454.CMB.1.raw
  modified_base (198)..(198): a, c, t, g, unknown or other
  misc_feature (198)..(198): n is a, c, g, or t
  modified_base (233)..(233): a, c, t, g, unknown or other
  misc_feature (233)..(233): n is a, c, g, or t
  modified_base (305)..(305): a, c, t, g, unknown or other
  misc_feature (305)..(305): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggggaaattgtgttgacacagtctccagccaccttgtctttgtcctccgaggggaaancgcctaccctctcctggcacgggccagtcagagtncgtggcagcaattagcctaggtaaccaaacaaaacgtcgacacgacctccaggacctcctactatcctaatnatacgctactccaaccgacggaccacgtcggacctactccgaacgtccgacggtttccgaaggtcgacgtacggttcggggtcgttagggaccaaggttccttacgtaaccttccgtaacctaaccctacgttccgaagacccgtaacgtacccgtaaacgggtccgtacccgttaaggtaaaccggtttatttttaccgggaactttaacgtttttaactttacccggttacgttacggtaccggtaactacgggttaacccggttaactacccggtaacggttacccgtaacccgttaacccgtaacccgtttcccgggaaaccccgtaaggggtaacccaacggttacccgggtttaaagaacccgggtttaaagttaaacccggttaacgttcccgggtaggtaccgtcggttaacccctaacggtaccttaaccgttcgtaaccgtttcgttacctacccccgttcccg

SEQ ID NO: 90632 - DNA, 605 bp, Homo sapiens
  misc_feature: GYAE6OF02GLVI3.33.7.A07.1.454.CMB.1.raw
  modified_base (198)..(198): a, c, t, g, unknown or other
  misc_feature (198)..(198): n is a, c, g, or t
  modified_base (490)..(490): a, c, t, g, unknown or other
  misc_feature (490)..(490): n is a, c, g, or t
  modified_base (602)..(602): a, c, t, g, unknown or other
  misc_feature (602)..(602): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccgggagaaattgtgttgacacagtctccagccaccctgtctttgtctccaggagaaagngccaccctctcatgcagggccagtcagagtatagcattcttctggcctggtaccaactagaaacctggaccaggcctcccgaggcccttctcactcccagaatcggctattccaacgagggcccaacgttggccacgtcccgagcccgtaggttccaggttggccgagggttcgggtcgtaggggactacggtacttctaacgtcttaccacctatccgacgtcaggtacctaggaccgtacgtggacggtacttcccagggtcccttaagttttactttacgtcgttaccngccgtagtcgtctaccgacttcggaccctccggtacgccttccggtcgaccgaggtacaccggagttcgggattaacggtagacgttactggtcgggcacggtcctaccgtntcg

SEQ ID NO: 90633 - DNA, 836 bp, Homo sapiens
  misc_feature: GYAE6OF02JIN1L.33.7.A07.1.454.CMB.1.raw
tcagtacacacactcacgaccggtgctcgatttagcacgtgtcgcagggggaggaactgctcagttaggacccagagggaaccatggaagccccagctcagcttctcttcctcctgcttctcgtggctcccagtactaccaccggagaattgtgttgacgcagtctccaggctaccctgtctttgtcctccgagggacagacgcccacccttcgtccgtgacgacgggcctagtcagtacttgttacgcacggtcggttacttccttacgcctacggtaaccagtaccgaaacgtaaaccgtcggacctaacgggtccttaccccggacggttccttccctccgttaccgttacgtcgggtccaccttaccgtaccccgaaccggaccggggtaccaacggtcggaacctacccgtacccgtaggtacgtacgggttcgaacgggtcgtcgtaggttcgggtacggtacgggtactaacggttaccgttactaccgttacccgtaccgtaaccgtccggtttaaccgaacgtaacggtaccggtaacggacccgttacgggtaacgtttaagtttacgttttaccggaaccgtttaaccgtttacgtttaacgttaccgttacggttaaccgtaacggttacttaaggttaccggttaaccgggtgggtaaccgtttaccggtaccgggtaaaccggtaaacgggttaacgggtaacggtaaacggtaaaccggttaaccgaaccgggttagttaaccggtacgtaccgtaacgtaccgttacgtaccgttacgttaccgtttacgtccgttacgtccccgttaccacggttaacg

SEQ ID NO: 90634 - DNA, 661 bp, Homo sapiens
  misc_feature: GYAE6OF02GBWDU.33.7.A07.1.454.CMB.1.raw
  modified_base (404)..(404): a, c, t, g, unknown or other
  misc_feature (404)..(404): n is a, c, g, or t
  modified_base (538)..(538): a, c, t, g, unknown or other
  misc_feature (538)..(538): n is a, c, g, or t
  modified_base (591)..(591): a, c, t, g, unknown or other
  misc_feature (591)..(591): n is a, c, g, or t
tcagtacacacactcacgaccggtgctcgatttagcacgtgtcgcagggggaggaactgctcagttaggacccagagggaaccatggaacgccccagctcagcttctcttcctcctgctactctggctcccagactaccaccggagtaaattgtgttgacacagtcctccacgcccaccctgttctttcgtcctccgagggaagaaagacgcccaccctctcatcgacgagggccagtcagtagtattagctattcttcttcggcctcggtaacccaacgacgaaaccgtggacccgacggtacctcccgacggtccctccctacacctccaagtaactcgactattaccgaacgacgggcccacgtcggacctactacccgagaccgtacgttccgaggtcgngtacggtggttcgtgggaccagtaccttctacgttccacctaccgtatccagaccacgacggtcggacgccgtaaggtaactttagtttacgactttagttttacttactcgttcgtagccgtagtccgtaacncgtaacgtccgtaaccttaacccgtaccgtaccgaacgaaacggtctaaccgngtacggaagtaacgtaacgaccgttaggcgtacgtatacccgacgtattccggtacttacgttctaaccg

SEQ ID NO: 90635 - DNA, 699 bp, Homo sapiens
  misc_feature: GYAE6OF02GPZHI.33.7.A07.1.454.CMB.1.raw
  modified_base (144)..(144): a, c, t, g, unknown or other
  misc_feature (144)..(144): n is a, c, g, or t
  modified_base (194)..(194): a, c, t, g, unknown or other
  misc_feature (194)..(194): n is a, c, g, or t
  modified_base (255)..(255): a, c, t, g, unknown or other
  misc_feature (255)..(255): n is a, c, g, or t
  modified_base (307)..(307): a, c, t, g, unknown or other
  misc_feature (307)..(307): n is a, c, g, or t
  modified_base (565)..(565): a, c, t, g, unknown or other
  misc_feature (565)..(565): n is a, c, g, or t
tcagtacacacactcacgaccggtgctcgatttagcacgtgtcgcagggggaggaactgctcagttaggacccagagggaacatggaagccccagctcagcttctcttcctcctgctacctctggctccagactaccaccgganaaacttgtgttgacacagtctccagccacctgtctttgctcaggagaagngccacctctcatgcaggtccagtcagacttgtagcaggcgtcttctacgccgtggtaaccngctaagccactggaccaggctaccgacggtcctccactaactctaagcggtnaccgtactacccaccggaccggtacacccggttagcctaactacccgaagtaacctagggtttccaagggtttcggcgtaacgggttcgggttcggtacgggaacgaagttcttaaccgtacgtttaccaacacccgtaacttaccgacgtacgaaccggtacgaccgggtagtacgtaacggtaagttagtttacggtacgtaggtttactaaggtttaacgtcgtaacgtaaccgtacggtaaggttaccggtttnttaccgttaattccccggttaacgttacggtaccgggaacccgtaacggtaccgggtaacgttaacggggaaacttaacggaaacggtaacgttacgtaccggtataccgaccgtactacgttcttaaggttcc

SEQ ID NO: 90636 - DNA, 715 bp, Homo sapiens
  misc_feature: GYAE6OF02I6O0T.33.7.A07.1.454.CMB.1.raw
  modified_base (199)..(199): a, c, t, g, unknown or other
  misc_feature (199)..(199): n is a, c, g, or t
  modified_base (329)..(329): a, c, t, g, unknown or other
  misc_feature (329)..(329): n is a, c, g, or t
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgttactttgtctccgagggaaagngcccaccctcgtcctgcgacgggccagtcagagtgctggcagcaacttgcctagtaccaacaaactgaccagctccgagctcctcatctatcagtgactactccgacgacggccacgtgacactacccgngaccgtaggttccgaggtcggtacgtagggtcggtacgtcgggtaactacggtaccttacaccgtttccgacctaaccgagttaccgaacgtccgaccgtaccgtagacggtccctaaggtaagttacgtttcgtaacgttaagtttttaccgttagttacggttcctacggtacgttaacgtaccggttaccgtacttaaccgtacccggttacccttaaaccgtacccggtttaacccgggaccgtaaacgggtaacccggtaacgtaaccgggttaacgggtaacgttaaccggtttaaaaccgggtacgtttacgggaccgttccgacgttaacccgaccgttagttaccgttacgttccctaccggttaccttccccccgg

SEQ ID NO: 90637 - DNA, 633 bp, Homo sapiens
  misc_feature: GYAE6OF02GV174.33.7.A07.1.454.CMB.1.raw
  modified_base (208)..(208): a, c, t, g, unknown or other
  misc_feature (208)..(208): n is a, c, g, or t
  modified_base (443)..(443): a, c, t, g, unknown or other
  misc_feature (443)..(443): n is a, c, g, or t
tcagtacacacactcacgaccggtgctcgatttagcacgtgtcgcagggggaggaactgctcagttaggacccagagggaaccatggaagccccagctcagcttctcttcctcctgctactctggcctcccagataccaccggagaaattgtgttgacacagtctccagcccacctgtctttgtctccaggagaagagcccaccctcncatgcgacgggccagtcaagagttattagctattcctttcgttcggcctggtaacccaacgaacgtaaaccgtggaccgaaggccctacccgagggtccctcccgtcactacccagaatcgactacttacaacgtaccggacctacgcgactacctacccgacgccgtaggtcgtacggtgcgtagggtcgggtcgagggtacacgtactacacttcactaccacgtacacgacncggtactaggacgtccgtaggtaacgttcttacgtcgtacgttaagttttagtacgtttcgacgtacgtcgtaccgtcgttacctaccgtacgtccgtccgtccgtcgtcccgtaccgttaccgacgtaagaccgtagtaggtagacgtactaacggacgtagcggtcgactaccgtcgtacctgttccg

SEQ ID NO: 90638 - DNA, 702 bp, Homo sapiens
  misc_feature: GYAE6OF02JRJHF.33.7.A07.1.454.CMB.1.raw
tcagtacacacactcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagcccaccctgtctttgtctccaggagaaagcgccaccctctcatcgacagggtccagtcagtagtattagcattcttcgtggcctaggtacctaacgacgtaaacctcggaccacggtcctacccgaggtcccttccttcttacgttactcgtaatcgcctacgtacccaccggacggaccctacgttcgaccacgtccccgaacggtccccgtaaggttccaggtacggacgtagggtcgggttcgaggggtacctacgttaccgtctaacgttccttaccgaaccttacgtccaacgtccgaacgtcccgtaaacggacctaccgttaggtaacgtttactttacggtacgttaagttttacttcgtttacgttacgtcgtacgtggtacgttaacgccgttaagtacccgtacctaaaccgttccgttacggaacccgtaagaaccgtacgacgtacgtaacggtaacgttaaacggtacttcggtacgacgttaccgaacgtacgtacgttaccgacgtttctaccttccg

SEQ ID NO: 90639 - DNA, 658 bp, Homo sapiens
  misc_feature: GYAE6OF02F5Z63.33.7.A07.1.454.CMB.1.raw
  modified_base (195)..(195): a, c, t, g, unknown or other
  misc_feature (195)..(195): n is a, c, g, or t
tcagtacacacactcacgaccggtgctcgatttagcacgtgtcgcaggggaggaactgctcagttaggacccagagggaaccatggaagccccagctcagcttctcttcctcctagctactctggcctccagataccaccggagaaattgtgttgactacagtctccggccaccctgtcttgtctccgagggaanagccacctctcttgtagggccagtccagagtgttagcagcaactactagcctggtaccaacaaaacctgaccagactccaggctcctcatctatgatgacactccaccgagggcctacgtggccatcccagaccgtaggttcgagtcggcgtaggtcggtcgtcggggacaggtaccttacgtacctcgtacaccgtctacagtccaggtaccctagtaccgccttaggaaagttagtttacgacgtttaacgtttacgttaaccgttcgttcttagtcctaggtaccgtacgtcctaacgttacgggacccttaaccgtacccgttccgggaccgtaacgggaccgtaaccgacgtagggtacttaacgtaaaccggtacgttaggtccggacgttaccgaccgtaaccctagttaccgttcgtttaccgttaccgtaaccgttccccgttacccgtacccg

SEQ ID NO: 90640 - DNA, 174 bp, Homo sapiens
  misc_feature: GYAE6OF01C69AE.39.57.F02.1.454.CMB.1.raw
  modified_base (173)..(174): a, c, t, g, unknown or other
  misc_feature (173)..(174): n is a, c, g, or t
tcagtcgcactagtcacgaccggtgctcgatttagctcgatatagttgggtttgggggaagaggaagactgacggtcccccaggagttcaggtgctgggcacagcggccctgggctgcctggtcaaggactacttccactagtgcgactgagcgggctggcaaggcgcatagnn

SEQ ID NO: 90641 - DNA, 180 bp, Homo sapiens
  misc_feature: GYAE6OF01CKN1R.39.57.F02.1.454.CMB.1.raw
  modified_base (174)..(180): a, c, t, g, unknown or other
  misc_feature (174)..(180): n is a, c, g, or t
tcagtcgcactagtcacgaccggtgctcgatttagctcgatatagttgggtttggggggaagaggaagactgacggtcccccaggagttcaggtgctgggcacagcggccctgggctgcctggtcaaggactacttccactagtgcgactgagcgggctggcaaggcgcatagnnnnnnn

SEQ ID NO: 90642 - DNA, 174 bp, Homo sapiens; identical to SEQ ID NO: 90640
  misc_feature: GYAE6OF01BN9V0.39.57.F02.1.454.CMB.1.raw
  modified_base (173)..(174): a, c, t, g, unknown or other
  misc_feature (173)..(174): n is a, c, g, or t

SEQ ID NO: 90643 - DNA, 173 bp, Homo sapiens
  misc_feature: GYAE6OF02GWK1B.39.57.F02.1.454.CMB.1.raw
  modified_base (173)..(173): a, c, t, g, unknown or other
  misc_feature (173)..(173): n is a, c, g, or t
tcagtcgcactagtcacgaccggtgctcgatttagctcgatatagttgggtttgggggaagaggaagactgacggtcccccaggagttcaggtgctgggcacagcggccctgggctgcctggtcaaggactacttccactagtgcgactgagcgggctggcaaggcgcatagn

SEQ ID NO: 90644 - DNA, 486 bp, Homo sapiens
  misc_feature: GYAE6OF01CZCN3.5.57.F02.1.454.CMB.1.raw
  modified_base (383)..(383): a, c, t, g, unknown or other
  misc_feature (383)..(383): n is a, c, g, or t
  modified_base (458)..(458): a, c, t, g, unknown or other
  misc_feature (458)..(458): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttagcctggtaccaacaaaaacctggccagcctcccagactcctcatttatcgttcatccaccagggccactgatgtcccaacagattcagtgcagagggtctgggacagacttcagtctcaccatcagcagcgtacngtctgaagacttggcagtttatactgtacaactaatgtgtcagtggcctgacgttcgcccaggccacagtgatancgaggcaactgtgctgcacatctgtctc

SEQ ID NO: 90645 - DNA, 495 bp, Homo sapiens
  misc_feature: GYAE6OF01DC0UI.5.57.F02.1.454.CMB.1.raw
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaacagattcagtggcagagggtctgggacagacttcagtctcaccatcagcagcgtacagtctgaagacttggcagtttatactgtcaacatgtgtcagtggcctcgaacgttcggcccagggaccacgagtggatatcgaggcgaactgtggctgcaccatctgtcttc

SEQ ID NO: 90646 - DNA, 501 bp, Homo sapiens
  misc_feature: GYAE6OF01EPU4Y.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaacagattcagtggcagagggtctgggacagacttcagtctcaccatcagcagcgtacagtctgaagacttggctagtttattactgtcaactaatgtgtcagtggcctcgaacgttcggcccagggaccacagtaggatatcgaggcgaacgtgacggctgcaccatctgtctc

SEQ ID NO: 90647 - DNA, 504 bp, Homo sapiens
  misc_feature: GYAE6OF01EDL8X.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccacctctcctgcagggccagtcagaacattggtagcaacttgcctggtaccaacaaaacctggccagcctcccagactcctcatttatcgttcatccaccaggccactgatcgtcccaaccagattcagtgcagagggtctgggacagacttcagtctcaccatcagcagcgtacagtctagaagtacttggactagtttatactgtacaactagtgtggtcagtgcctcgtaacgttcggcccaagggacccacagtcgatagtcgaggcgaactgtggctgcactatcttgtcttc

SEQ ID NO: 90648 - DNA, 496 bp, Homo sapiens
  misc_feature: GYAE6OF01EL23J.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtgtcagtgcctcgaacgttcggcccagggaccacgagtggatatcgaggcgaactgtggctgcacatctgtcttc

SEQ ID NO: 90649 - DNA, 502 bp, Homo sapiens
  misc_feature: GYAE6OF01AH6DP.5.57.F02.1.454.CMB.1.raw
  modified_base (329)..(329): a, c, t, g, unknown or other
  misc_feature (329)..(329): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaacctggccagcctcccagactcctcatttatcgttcatccaccagggccactgatgtcccaacngattcagtggcagaggtctgggacagacttcagtctcaccatcagcagcgtacagtctgaagcttggcagtttattactgtcaacatgtgtcagtgcctcgaacgttcggcccagggacccacgagtggatagtcgaggcgaacgtgtcggcttcggccaccatcctgtcttc

SEQ ID NO: 90650 - DNA, 494 bp, Homo sapiens
  misc_feature: GYAE6OF01AW837.5.57.F02.1.454.CMB.1.raw
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggancaacttgcctggtaccaacaaaacctggccagcctcccagactcctcatttatcgttcatccaccagggccactgatgtcccaacagattcagtggcagagggtctgggacagacttcagtctcaccatcagcagcgtacagtctgaagtcttggctagtttattactgtacaacaatgtgtcagtggcctcgaacgttcgcccagggaccacgagtgatagtcgaggcgaactgtggctgcacatctgtctc

SEQ ID NO: 90651 - DNA, 438 bp, Homo sapiens
  misc_feature: GYAE6OF01BQV0V.5.57.F02.1.454.CMB.1.raw
  modified_base (432)..(438): a, c, t, g, unknown or other
  misc_feature (432)..(438): n is a, c, g, or t
tcagatcagacacgcacgaccggtgctcgatttagctcgatatagttgggtttgggggaagaggaagactgacggtcccccaggagtccagagtgcgtcgcaagtattggcagtgtgaaatttgacaccttatatgcagactctgtgaggggccgcttcaccgtgtccagagacaactccaagaacgccgtctatttgcagatggacagcctgagagtcgacgacacgggcatctattattgtacggcggccgagcaatactctcttacttctggagtcaggagtccggtcactgtctcctcagcctccaccaagggcccatcggtcttccccctggccaccctcctccaagacgcacctctggggcacagcgcctggctgctgtcaggactactccgtgtctgatctgagcgggctggcaaggcgcatagnnnnnnn

SEQ ID NO: 90652 - DNA, 507 bp, Homo sapiens
  misc_feature: GYAE6OF01BE7I9.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctggtaccaacaaaaacctggccagcctcccagactcctcatttatcgttcatccaccagggccactgatgtcccaaccagattcagtgcagagggtctgggacagacttcagtctcaccatcagcagcgtacagtctgaagacttggactagtttattactgtacaactaatgtgtcagtggcctacgaacgttcgacccgagggaccacgagtggataatcgaggcgaacgtgtgcgtgcaccatctgtcttacg

SEQ ID NO: 90653 - DNA, 496 bp, Homo sapiens
  misc_feature: GYAE6OF01BUVSS.5.57.F02.1.454.CMB.1.raw
  modified_base (201)..(201): a, c, t, g, unknown or other
  misc_feature (201)..(201): n is a, c, g, or t
  modified_base (460)..(460): a, c, t, g, unknown or other
  misc_feature (460)..(460): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccagggccactgatgtcccaacagattcagtggcagagggtctgggacagacttcagtctcaccatcagcagcgtacagtctgaaagcttggctagttttatactgtacaataatgtagtcagtggcctagaacgttcgcccagggaccacgngtggatagtcgagcgaatgagctgcacatctgtctc

SEQ ID NO: 90654 - DNA, 608 bp, Homo sapiens
  misc_feature: GYAE6OF01D7IW6.5.57.F02.1.454.CMB.1.raw
  modified_base (203)..(203): a, c, t, g, unknown or other
  misc_feature (203)..(203): n is a, c, g, or t
  modified_base (317)..(318): a, c, t, g, unknown or other
  misc_feature (317)..(318): n is a, c, g, or t
  modified_base (320)..(320): a, c, t, g, unknown or other
  misc_feature (320)..(320): n is a, c, g, or t
tcagatcagacacgcacgaccggtgctcgatttagctcgatatagttagggtttgggggaggaactgctcagttaggacccagacggaaccatggaagccccagcgcagcttctcttcctcctgctactctggctcccagataccgttggggagatcgtgatgacgcagtctccagcccatcctgtctgtgtctccagggganagagcccaccctctcctgccagggccagtcagaacattggagcaacttagcctggtaccaacaaaaacctggccagcctcccagactcctcatttatcgttcatccaccgcgcnntntccaccacgatctcgaggtcgacgaggtggtcggtacggactagtacctagtacgttcaccaactcacgacgacgacgtaccgtaacgcgttacgtaaggtaacgttacggttacgtaccgtttaagttttacttacgttacgtaactaacgtagttggttacgtacgtacggtccgtacccgtaccggttacggtacccgaccggaaccggtacctaacggtacggtagtatacgtacggacggtagtacgtggtacgtcgacgtaccaactattcgtcgttctacc

SEQ ID NO: 90655 - DNA, 530 bp, Homo sapiens
  misc_feature: GYAE6OF01B4N3K.5.57.F02.1.454.CMB.1.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacnttggancaacttgcctggtaccaacaaaaacctggaccagcctcccagacctcctcatttatcgttcactccaccaggccactgactcgtacccaaccagacttcagtggcaggagggtctgggacagacttcagtctcaccatcagcagcgtacagtctagaagtcttggctagtttatactgtacaactatgtgtcagtcgcctacgtaacgttcgacccgagggaccagtagtggatacgtcgaggacgaacgttggtacggcttcggacctaccagttcctgttcttaccg

SEQ ID NO: 90656 - DNA, 494 bp, Homo sapiens
  misc_feature: GYAE6OF01EWYS1.5.57.F02.1.454.CMB.1.raw
  modified_base (488)..(488): a, c, t, g, unknown or other
  misc_feature (488)..(488): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttagcctggtaaccaacaaaaacctggccagcctcccagactcctcatttatcgttcatccaccagggccactgatgtcccaacagattcagtgcagagggtctgggacagacttcagtctcacatcagcagcgtacagtctagaagacttggctagtttattactgtacaactaatgtgtcagtggcctgaacgttcgcccagtcgaccacagtggatagtcaggcgaactgtgctgcaccntctgtc

SEQ ID NO: 90657 - DNA, 513 bp, Homo sapiens
  misc_feature: GYAE6OF01ETYQY.5.57.F02.1.454.CMB.1.raw
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtancaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggctagttttatactgtacaacaatgtggtcagtcggcctcggaacgtttcggacccagggacccacgagtggatatcgaggcgaacgtgtacggctggcaccattctgtcttac

SEQ ID NO: 90658 - DNA, 498 bp, Homo sapiens
  misc_feature: GYAE6OF01D080B.5.57.F02.1.454.CMB.1.raw
  modified_base (479)..(479): a, c, t, g, unknown or other
  misc_feature (479)..(479): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtgtcagtggcctgaacgtttcggcccagggaccacagtggatagtcaggcgaactgnggctgcacatctgtcttcg

SEQ ID NO: 90659 - DNA, 492 bp, Homo sapiens
  misc_feature: GYAE6OF01CRTXU.5.57.F02.1.454.CMB.1.raw
  modified_base (239)..(239): a, c, t, g, unknown or other
  misc_feature (239)..(239): n is a, c, g, or t
  modified_base (464)..(464): a, c, t, g, unknown or other
  misc_feature (464)..(464): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttgggagatcgtgatgacgcagtctccagccatcctgtctgtgtctccaggggagagagccaccctctcctgcagggccagtcagaacattggancaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagcttggctagtttattactgtcaactaatgtggtcagtgcctcgaacgttcggcccagggaccacgagtggatncgaggcaactgtgctgcacatctgtctc

SEQ ID NO: 90660 - DNA, 491 bp, Homo sapiens
  misc_feature: GYAE6OF01A16Z0.5.57.F02.1.454.CMB.1.raw
  modified_base (201)..(201): a, c, t, g, unknown or other
  misc_feature (201)..(201): n is a, c, g, or t
  modified_base (450)..(450): a, c, t, g, unknown or other
  misc_feature (450)..(450): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggtagcaacttagcctggtaccaacaaaaacctggccagcctcccagactcctcatttatcgttcatccaccaggccactgatgtcccaacagattcagtggcagaggtctgggacagactcagtctcaccatcagcagcgtacagtctgaagacttggcagtttatactgtcaacatgtgtcagtgctcgacgttcgcccagggaccacgngtggatagtcgaggcgaactgtggctgcaccatctgttctc

SEQ ID NO: 90661 - DNA, 498 bp, Homo sapiens
  misc_feature: GYAE6OF01DWH6R.5.57.F02.1.454.CMB.1.raw
  modified_base (201)..(201): a, c, t, g, unknown or other
  misc_feature (201)..(201): n is a, c, g, or t
  modified_base (459)..(459): a, c, t, g, unknown or other
  misc_feature (459)..(459): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaacaaaaacctggccagcctcccagactcctcatttatcgttcatccaccagggccactgatcgtcccaaccagattcagtggcagagggtctgggacagacttcagtctcaccatcagcagcgtacagtctagaagacttggactagtttatactgtacaacatgtgtcagtgcctcgtaacgttcggccagggaccagngtgatatcgaggcgaactgcggctgcacatctgtcttcg

SEQ ID NO: 90662 - DNA, 491 bp, Homo sapiens
  misc_feature: GYAE6OF01AW8R5.5.57.F02.1.454.CMB.1.raw
  modified_base (456)..(456): a, c, t, g, unknown or other
  misc_feature (456)..(456): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
  modified_base (475)..(475): a, c, t, g, unknown or other
  misc_feature (475)..(475): n is a, c, g, or t
  modified_base (478)..(478): a, c, t, g, unknown or other
  misc_feature (478)..(478): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatcgtcccaacagattcagtggcagagggtctggacagacttcagtctcacatcagcagcgtacagtctagaagacttggactagtttattactgtacaactaatgtgtcagtgcctcgacgttcgccgaggaccanagngatancgagcgaatgngcngcacatctgtctc

SEQ ID NO: 90663 - DNA, 505 bp, Homo sapiens
  misc_feature: GYAE6OF01DEUWN.5.57.F02.1.454.CMB.1.raw
  modified_base (201)..(201): a, c, t, g, unknown or other
  misc_feature (201)..(201): n is a, c, g, or t
  modified_base (296)..(296): a, c, t, g, unknown or other
  misc_feature (296)..(296): n is a, c, g, or t
  modified_base (476)..(476): a, c, t, g, unknown or other
  misc_feature (476)..(476): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaacaaaaacctggaccagcctccagactcctcatttancgttcatccaccagggccactgatcgtcccaaccagacttcagtggcagagggtctgggacagacttcagtctcaccatcagcagcgtacagtctagaagacttggctagtttataactgtacaactaatgtggtcagtggcctagaacgttcggccagggccagagtgatagtcgaggnaactggtaggcttagcacatctgtcttcg

SEQ ID NO: 90664 - DNA, 492 bp, Homo sapiens
  misc_feature: GYAE6OF01CDT72.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (474)..(474): a, c, t, g, unknown or other
  misc_feature (474)..(474): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagacattggancaacttgcctggtaccaacaaaaacctggccagcctcccagactcctcatttatcgttcatccaccagggccactgatgtcccaacagattcagtggcagagggtctgggacagacttcagtctcaccatcagcagcgtacagtctgaagacttggctagtttatactgtcaacatgtgtcagtgcctgaacgttcggcccagggaccacgagtggatatcgaggcaacgtgnggctgcacatctgtcttc

SEQ ID NO: 90665 - DNA, 491 bp, Homo sapiens
  misc_feature: GYAE6OF01DAFAM.5.57.F02.1.454.CMB.1.raw
  modified_base (367)..(367): a, c, t, g, unknown or other
  misc_feature (367)..(367): n is a, c, g, or t
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
  modified_base (474)..(474): a, c, t, g, unknown or other
  misc_feature (474)..(474): n is a, c, g, or t
tcagatcagacacgcacgaccggtgctcgatttagctcgatatagttgggtttgggggaggaactgctcagttaggactcagacggaaccatggaagccccagcgcagcttctcttcctcctgctactctggctcccagataccgttggggagatcgtgatgacgcagtctccagccatcctgtctgtgtctccaggggagagagccaccctctccctgcagggccagtcagaacattggtagcaacttagcctggtaccaacaaaaacctggccagcctcccagacctcctcatttatcgttcatcccaccagggccactgatcgtcccaaaccagattcagtgcagagggtctgggacagacttnagtctcaccatcagcagctacagtctgaagacttggctagtttatactgtacaanatgtgtnagtgctgaacgttcgccnggaccnagtggatagtcagcgaactgnggctgcaccatctgtcc

SEQ ID NO: 90666 - DNA, 492 bp, Homo sapiens
  misc_feature: GYAE6OF01DAVLK.5.57.F02.1.454.CMB.1.raw
  modified_base (200)..(200): a, c, t, g, unknown or other
  misc_feature (200)..(200): n is a, c, g, or t
  modified_base (455)..(455): a, c, t, g, unknown or other
  misc_feature (455)..(455): n is a, c, g, or t
  modified_base (475)..(475): a, c, t, g, unknown or other
  misc_feature (475)..(475): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagatcgtgatgacgcagtctccagccatcctgtctgtgtctccagggganagagccaccctctcctgcagggccagtcagaacattggagcaacttagcctggtaaccaacaaaaacctggccagcctcccagactcctcatttatcgttcatccaccagggccactgatcgtcccaaccagattcagtggcagagggtctgggacagacttcagtctcacatcagcagccgtacagtctagaagtacttggctagtttacttactgtacaactatgtgtcagtgcctgacgttcgccaggccangtgatatcgaggcaacgtgnggctgcacatctgtctc

SEQ ID NO: 90667 - DNA, 450 bp, Homo sapiens
  misc_feature: GYAE6OF01DHRB1.5.57.F02.1.454.CMB.1.raw
  modified_base (293)..(293): a, c, t, g, unknown or other
  misc_feature (293)..(293): n is a, c, g, or t
  modified_base (439)..(450): a, c, t, g, unknown or other
  misc_feature (439)..(450): n is a, c, g, or t
tcagatcagacacgcacgaccggtgctcgatttagctcgatatagttgggtttgggggaagaggaagactgacggtcccccaggagtccagagtgcgtcgcaagtattggcagtgtgaaatttgacaccttatatgcagactctgtgaggggccgcttcaccgtgtccagagacaactccaaagaacgccgtctatttgcagatggacagcctgagagtcgacgacacgggcatctaattatgacggcggccgagcaatactctcttacttctggagtcagggagtcccggtnactgtctcctcagccctcaccaagggcccatcggtcttccccctggccaccctcctccaagacgcacctctggggcacagcgccctggctgcctggtcaaggactacttccgtgtctgatctgagcgggctggcaaggcgcatagnnnnnnnnnnnn

SEQ ID NO: 90668 - DNA, 531 bp, Homo sapiens
  misc_feature: GYAE6OF01EDWOA.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggtagcaacttagcctggtaccaacaaaaacctggccagcctcccagactcctcatttatcgttcatccaccagggccactgatcgtcccaacagattcagtggcaggaggtctgggacagactcagtctcacatcagcagcgtacagtctagaagtacttggactagtttatactgtacaacatgtgtcagtcggcctacggaaccgttcgacccgagggacccacgagtcggatagtcgagggcgtaaacgtggtacggctacggccacccgattccgtggttccttaccg

SEQ ID NO: 90669 - DNA, 551 bp, Homo sapiens
  misc_feature: GYAE6OF01CK83B.5.57.F02.1.454.CMB.1.raw
  modified_base (153)..(153): a, c, t, g, unknown or other
  misc_feature (153)..(153): n is a, c, g, or t
  modified_base (205)..(205): a, c, t, g, unknown or other
  misc_feature (205)..(205): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatccctgtctgtgtctccgaaggggganagagcccaccctctcctgcagggccagtcagaacattggagcaaacttagcctggtaaccaacaaaaacctggaccacgcctccagactcctnatttancgttcatccaccaggcactgatcgaccaaccagattcagtggacaggacgggtctgggacagacttcagtctacaccatcagcagcgtacagtcagaagtactggctagttttaatacgtgtacaaactaagtgtaggtcaaggtcgaccgtcgaacgttcggacctagggaccacgagtggtactaatccgaggaccgaacgtggttacggcgttacgccgtaaccaattctcgggttctttaccc

SEQ ID NO: 90670 - DNA, 510 bp, Homo sapiens
  misc_feature: GYAE6OF01D6CCY.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaacaaaaacctggccagcctcccagactcctcatttatcgttcatccaccagggccactgatcgtacccaacagattcagtgcagagggtctgggacagactcacgtctcaccatcagcagctacagtctagaagacttggctagtttattactgtacaacatgtgtcagtcggcctacgtaacgttccgaccgacggaccacgaggtgatagtcgaggacgtaacgtggcgtcgcgtcacattctgtcttc

SEQ ID NO: 90671 - DNA, 498 bp, Homo sapiens
  misc_feature: GYAE6OF01CNK3Z.5.57.F02.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (486)..(486): a, c, t, g, unknown or other
  misc_feature (486)..(486): n is a, c, g, or t
tcagatcagacacgcacgaccggtgctcgatttagctcgatatagttgggtttgggggaggaactgttcagttaggacccagacggaaccatggaagccccagcgcagcttctcttcctcctgctactctggctcccagataccgttggggagatcgtgatgacgcagtctccagccatcctgtctgtgtctccagggganagagccaccctntcctgcagggccagtcagaacattggtagcaacttagcctggtaccaacaaaaacctggccagcctccagactcctcatttatcgttcatccaccagggccactgatgtcccaaccagattcagtggcagagggtctgggacagactcagtctcaccatcagcagcgtacagtctagaagcttggactagtttatactgtcaacaatgtgtcagtggctcgaacgttcggcccaggaccacagtgatatcaggcgaatggtggctgccacatntcgtcttctacg

SEQ ID NO: 90672 - DNA, 551 bp, Homo sapiens
  misc_feature: GYAE6OF01CK2UT.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (519)..(519): a, c, t, g, unknown or other
  misc_feature (519)..(519): n is a, c, g, or t
  modified_base (536)..(536): a, c, t, g, unknown or other
  misc_feature (536)..(536): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctaggtaaccaaacaaaaacctggaccacgcctcccagacctcctcaatttactcgttcactcccaaccagggccactgatcgtacccaaccagattcagtggacaggagggtctgggacaggacttcagtctacaccatacacgcagccgtacagtctaggaacgtacgttggactaagttttaacttactagtacaactaagttgtacggtactaggtcggtccctacggaaccgttccggaccgacgggaccaacgagtagattancgaggcgaactggcgcngccacatctgtcttc

SEQ ID NO: 90673 - DNA, 528 bp, Homo sapiens
  misc_feature: GYAE6OF01EFD7H.5.57.F02.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
  modified_base (388)..(388): a, c, t, g, unknown or other
  misc_feature (388)..(388): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctctcctgcagggccagtcagaacattggtancaacttagcctggtaccaacaaaaacctggccagcctcccagactcctcatttatcgttcatccaccaggccactgatcgtcccaaccagattcagtggcaggaggtctgggacagacttcagtctcaccatcagcagcgtacngtctagaagtacttggctagtttactactgtacaactaagttgtggtcaggttcggacctacggtaacgttccggcccaagggaccacgagtggatacgtcgaggtacgaactggtcgctcgacaccattctgttctacg

SEQ ID NO: 90674 - DNA, 491 bp, Homo sapiens
  misc_feature: GYAE6OF01DEWKB.5.57.F02.1.454.CMB.1.raw
  modified_base (239)..(239): a, c, t, g, unknown or other
  misc_feature (239)..(239): n is a, c, g, or t
  modified_base (483)..(483): a, c, t, g, unknown or other
  misc_feature (483)..(483): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttgggagatcgtgatgacgcagtctccagccatcctgtctgtgtctccaggggagagagccaccctctcctgcagggccagtcagaacattggancaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggctagtttattactgtcaacaatgtgtcagtggcctgaacgttcggccagggaccagagtggatatcgaggcaactgtggctgcacntctgtctc

SEQ ID NO: 90675 - DNA, 518 bp, Homo sapiens
  misc_feature: GYAE6OF01A8ODB.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggaccagcctcccagactcctcatttatcgttcatccaccagggccactgatcgtcccaaccagattcagtgcagagggtctgggacagacttcagtctcaccatcagcagcgtacagtctgaagacttggctagtttattactgtacaactaatgtaggtcaggttcggccttcggaacgtttccggacccagggaccagagtggatagtcgaggacgaactggtcgctgccaccgatctgtcttcc

SEQ ID NO: 90676 - DNA, 511 bp, Homo sapiens
  misc_feature: GYAE6OF01BKOFY.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcaggccagtcagaacattggagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctagaagacttggcaagtttattactgtacaactaatgtaggtctaagtgcctgtaacgttcggcccgagggaccacgagtgatatcgaggacgaactgtggctcggcacaatcgtgtcgttacc

SEQ ID NO: 90677 - DNA, 527 bp, Homo sapiens
  misc_feature: GYAE6OF01B2DY2.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagcccaccctctcctgcagggccagtcagaacattggagcaacttagcctaggtaaccaacaaaaacctggaccagcctccagacctcctcatttatcgttcactccaccacggccactgactcgtacccaacagacttcagtggcagtagggtctagggacagacttcagtctcaccatcagcagcgtacagtctgaagtacttggactagtttatactgtacaactatgtagtctaggtgtcctacgtaacgttccggacccagggaccacgtagtggatagcgaggacgaacgtgtacggctcgcacatcgtgtcttacc

SEQ ID NO: 90678 - DNA, 509 bp, Homo sapiens
  misc_feature: GYAE6OF01ECIJK.5.57.F02.1.454.CMB.1.raw
  modified_base (201)..(201): a, c, t, g, unknown or other
  misc_feature (201)..(201): n is a, c, g, or t
  modified_base (492)..(492): a, c, t, g, unknown or other
  misc_feature (492)..(492): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttgcctggtaccaacaaaaacctggccagcctcccagactcctcatttatcgttcatccaccagggccactgatcgtcccaaccagattcagtggcagagggtctgggacagacttcagtctcaccatcagcagcgtacagtctagaagacgttggctagtttattactgtacaactatgtgtcagtcgccgtacgtaacgttccggcccgagggaccacgagtggatagtcgacggtcgaacgtgnggctgcacatctgtctc

SEQ ID NO: 90679 - DNA, 496 bp, Homo sapiens
  misc_feature: GYAE6OF01BUGCR.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaacaaaaacctggccagcctcccagactcctcatttatcgttcatccaccagggccactgatgtcccaacagattcagtggcagagggtctgggacagacttcagtctcaccatcagcagcgtacagtctgaatcttggctagtttatactgtcaacatgtgtcagtgcctgaacgttcgcccagggaccacgagtgatagtcgaggcgaactgcggctgccaccatctgtcttaccg

SEQ ID NO: 90680 - DNA, 510 bp, Homo sapiens
  misc_feature: GYAE6OF01ADOSY.5.57.F02.1.454.CMB.1.raw
  modified_base (331)..(331): a, c, t, g, unknown or other
  misc_feature (331)..(331): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaaacaaaaacctggccagcctccagactcctcatttatcgttcatccaccagggccactgatgtcccaaccngattcagtggcagagggtctgggacagacttcagtctcacatcagcagcgtacagtctgaagtacgttggctagtttatactgtacaactaatgtggtcagtcggcctcgaacgttccggacccagggaccacgaggtgatatcgaggcgaactgtcggctgaccacatctgtcttacg

SEQ ID NO: 90681 - DNA, 499 bp, Homo sapiens
  misc_feature: GYAE6OF01AIXHK.5.57.F02.1.454.CMB.1.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacnttggancaacttagcctggtaccaacaaaaacctggccagcctcccagactcctcatttatcgttcatccaccaggccactgatgtcccaacagatttagtggcagagggtctgggacagacttcagtctcaccatcagcagcgtacagtctgaagcttggctagtttatactgtacaactatgtgtcagtgcctcgaacgttcggcccaggaccacgagtggatatcgaggcgaagtggtcggctgcaccatctgtcttctac

SEQ ID NO: 90682 - DNA, 508 bp, Homo sapiens
  misc_feature: GYAE6OF01BHCQO.5.57.F02.1.454.CMB.1.raw
  modified_base (363)..(363): a, c, t, g, unknown or other
  misc_feature (363)..(363): n is a, c, g, or t
  modified_base (421)..(421): a, c, t, g, unknown or other
  misc_feature (421)..(421): n is a, c, g, or t
  modified_base (488)..(488): a, c, t, g, unknown or other
  misc_feature (488)..(488): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttagcctggtaaccaacaaaaacctggccagcctcccagactcctcatttatcgttcatccaccagggccactgatcgtcccaacagattcagtggcagagggtctgggacagacttnagtctcaccatcagcagcgtacagtctagaagacttggctagtttattactgtacaanaatgtaggtcaggtgcctcgtaacgttcggacccagggaccagaggtggatagtcgaggcgaactgnggctgcaccatctgtctacc

SEQ ID NO: 90683 - DNA, 495 bp, Homo sapiens
  misc_feature: GYAE6OF01EO80R.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (477)..(477): a, c, t, g, unknown or other
  misc_feature (477)..(477): n is a, c, g, or t
  modified_base (487)..(487): a, c, t, g, unknown or other
  misc_feature (487)..(487): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtancaacttagcctggtaccaacaaaaacctggccagcctcccagactcctcatttatcgttcatccaccagggccactgatgtcccaaccagattcagtggcagaggtctgggacagactcagtctcaccatcagcagcgtacagtctgaagacttggctagtttattactgtcaacaatgtgtcagtgcctcgaacgttcgcccagggaccacgagtgatatcgaggcgaacgtgnggctgcacanctgtctcg

SEQ ID NO: 90684 - DNA, 540 bp, Homo sapiens
  misc_feature: GYAE6OF01A02X1.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (296)..(296): a, c, t, g, unknown or other
  misc_feature (296)..(296): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgcagggccagtcagaacnttggancaacttgcctggtaccaacaaaaacctggccagcctccagactcctcatttancgttcatccaccagggccactcgatgtacccaacagacttcagtggcagagggtctgggacagacttcagtctcacatcagcagcgtacagtctagaacgtacttggactagtttactacgtgtacaactagtgtgtcagtcgccgtacgtaacgttccggaccctagggacctacgaggtcggactacgtccgaggtacgtaacgtcggtacggctacggaccacgtagtctcgtcgttaccg

SEQ ID NO: 90685 - DNA, 452 bp, Homo sapiens
  misc_feature: GYAE6OF01DCBX1.5.57.F02.1.454.CMB.1.raw
  modified_base (441)..(441): a, c, t, g, unknown or other
  misc_feature (441)..(441): n is a, c, g, or t
  modified_base (447)..(452): a, c, t, g, unknown or other
  misc_feature (447)..(452): n is a, c, g, or t
tcagatcagacacgcacgaccggtgctcgatttagctcgatatagttgggtttgggggaagaggaagactgacggtcccccaggagtccagagtgcgtcgcaagtattggcagtgtgaaatttgacaccttatatgcagactctgtgaggggccgcttcaccgtgtccagagacaactccaagaacgccgtctatttgcagatggacagcctgagagtcgacgacacgggcatctattattgtacggcggccgagcaatactctcttacttctggagtcagggagtccggtcactgtctcctcagcctccaccaagggcccatcggtccttccccctggccaccctcctccaagacgcacctctggggccacacgccggccctgggctgcctggtcaagggactacttcccgtgtctgatctgagcgggctggcaagggcncatagnnnnnn

SEQ ID NO: 90686 - DNA, 520 bp, Homo sapiens
  misc_feature: GYAE6OF01EEFTS.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtancaacttagcctggtaccaacaaaaacctggccagcctcccagactcctcatttatcgttcatccaccagggccactgatgtcccaaccagattcagtgcagagggtctgggacagacttcagtctcacatcagcagcgtacagtctagaacgacgttggactagtttattactgtacaactatgtgtcagtcgcctacgtacgttcgccgaggaccacgagtcgagtatacgaggacgaacgtggtcgactcggtaccaccgtattcgtgtcttaccg

SEQ ID NO: 90687 - DNA, 504 bp, Homo sapiens
  misc_feature: GYAE6OF01EACVS.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (487)..(487): a, c, t, g, unknown or other
  misc_feature (487)..(487): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctctcctgcagggccagtcagaacattggancaacttagcctggtaaccaacaaaaaacctggccagcctcccagactcctcatttatcgttcatccaccaggccactgatgtcccaaccagattcagtgcagagggtctgggacagacttcagtctcaccatcagcagcgtacagtctagaagacttggactagtttatactgtacaacaatgtggtacaggtgcctcgaacgttccggcccagggtaccacagtagagtatcgaggagaactggngctgcacatctgtcttc

SEQ ID NO: 90688 - DNA, 539 bp, Homo sapiens
  misc_feature: GYAE6OF01BRVZS.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatcgtcccaaccagattcagtggcagagggtctgggacagacttcagtctcaccatcagcagcgtacagtctagaagtacttggactagtttattactgtacaatatgtgtcaggtcgcctacgtaccggttcggacccgagggacccagacgtaggactagtcgacggacgaaccgtggtcggtcgtcggaccacccagttcgttcgttcgtttacccg

SEQ ID NO: 90689 - DNA, 671 bp, Homo sapiens
  misc_feature: GYAE6OF01C72M1.5.57.F02.1.454.CMB.1.raw
  modified_base (203)..(203): a, c, t, g, unknown or other
  misc_feature (203)..(203): n is a, c, g, or t
  modified_base (217)..(217): a, c, t, g, unknown or other
  misc_feature (217)..(217): n is a, c, g, or t
  modified_base (247)..(247): a, c, t, g, unknown or other
  misc_feature (247)..(247): n is a, c, g, or t
tcagatcagacacgcacgaccggtgctcgatttagctcgatataggttgggtttgggggaggaactgctcagttaggacccagacggaaccatggaagccccagcgcagcttctcttcctcctgctactctggctcccagataccggttgggagatcgtgatgacgcagtctccagccatcctgtctgtgtctccaggggganagacgcccaccctntcctgccagggccagtcagaacagttgganctaacttgcctggtaaccaacaaaacctggccagcctacccagacctcctctatttactcgttcatccacgaggccacgtgactcgtacccaacgagtacttcgaggtcggcgagggtacgggtcgtagggactacggtacttacgtagtcctaccgacctactacgacgccgaggcccgtaacacgttcctaggaacgtacgttgggtacctttaaggttttacttacgtacgtactaaacgtacgtttcggtcggttacgtaaggttccgggtaccgttaccgggtaaaccggtttcccgggaacccggtaacggggtaacccgtaaccggtagggtacgtaacgtaacgtcgggaacggtaccggtaacggttcgggacggtccgtacgtaccctaaccgtattccgttgttccgttaccg

SEQ ID NO: 90690 - DNA, 555 bp, Homo sapiens
  misc_feature: GYAE6OF01EBPL6.5.57.F02.1.454.CMB.1.raw
  modified_base (154)..(154): a, c, t, g, unknown or other
  misc_feature (154)..(154): n is a, c, g, or t
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccagggganagacgcccaccctctccngcagggccagtcagacnttggancaacttgcctggtaccaaacaaaaacctggccagcctacccagacctcctctatttatccgttcatcccaccagggcccactgatcgtaccccaaccagattcgagtggacaggagggtcgtgggacagtacttcacgtctcaccatcagcagtccgtacagtctagaagtacgttggacttagtttattactgtacaatagtgttggctaggtcggaccttacgtaaccgttccggacccgagggaccctacgagtacggtatacgtgacggtcgaaccgtggacgtctacgacacctatctgttcctacc

SEQ ID NO: 90691 - DNA, 505 bp, Homo sapiens
  misc_feature: GYAE6OF01AO3DC.5.57.F02.1.454.CMB.1.raw
  modified_base (427)..(427): a, c, t, g, unknown or other
  misc_feature (427)..(427): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctagaagacttggctagtttattactgtcaacatgtgtnagtggcctacgaacgtttccggcccagggaccacgagtggatagtcgaggcgaactggtgctgcaccatctgtcttcg

SEQ ID NO: 90692 - DNA, 650 bp, Homo sapiens
  misc_feature: GYAE6OF01CTR1R.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgcagggccagtcagaacnttggtagctaacttagcctaggtaacccaaacaaaaacctggaccacgccctacccagtacctcctactaatttactcgttcactccaccagggccactgactcgtacccaacagtacttcgagtcggacaggagggtcgtagggactaggtaccttacgacgttctaccgaacctactcgaacgtccaaggaccgtaacgacgtaccgtaggtaaacgtacgttacgggtactaaggtttttacttaacgtggttaacctaaacgtaagttacggttcgggtaacgttaagggtcggtacccgtttacggaaaccggtttccgggacccgtaacgggtaccaaccggtagtaccggagtataccggacggtacgaacgttggcggactacgaccgactagtactgtccttac

SEQ ID NO: 90693 - DNA, 499 bp, Homo sapiens
  misc_feature: GYAE6OF01BABXW.5.57.F02.1.454.CMB.1.raw
  modified_base (418)..(418): a, c, t, g, unknown or other
  misc_feature (418)..(418): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctagaagacttggcagtttatactgtcaanaatgtgtcagtgcctcgtaacgttcggcccagggaccacgagtggatagtcgaggcgaactgtggctgcacatctgtcttc

SEQ ID NO: 90694 - DNA, 755 bp, Homo sapiens
  misc_feature: GYAE6OF01D59M6.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtcctcggaggggagagacgccctaccctctccgtgacggacggcctagtacgaacgtaactagttaggacgactaacgttacgccgttacggtaaacccaaaacgtaaaaccgtcggaccaccgtccctaccgacgtaccttcctactttaactttacgtccgttactacctaccccgaacggaccggtaccctacgtacgtacttcccgtaaccccaacgtagtacttacgaggtcggacgtaaggggtacgggttcggtacgggaacctaacggttaccttacgaccgttacctaccaacctacgtaccgaacggtaccgtaacggtaccgttaacgtacgttaccgtaaggtaaacggttacggtttcggaaccttttaagttttaaccttacgtacgttaacctaaagttaggtttcgggtacggtacgtacgggtccgtacccgttaacgggttaccggttccggaccccgtaacgggtaccacggtaggtagtaacttacgacggtacggtaccgtaaggttcggcgtctacgacctacgtatttcgttcgtccttacg

SEQ ID NO: 90695 - DNA, 521 bp, Homo sapiens
  misc_feature: GYAE6OF01AVN5N.5.57.F02.1.454.CMB.1.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (467)..(467): a, c, t, g, unknown or other
  misc_feature (467)..(467): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacnttggagcaacttagcctggtaccaacaaaaacctggccagcctcccagactcctcatttatcgttcatccaccaggccactgatgtcccaaccagattcagtgcaggacggtcgtagggacagtacttcgacgtctcacatcagcagcgtacagtctagaacgtacgttcgctagtttattactgtacaactatgtgtcagtcgcctacgtacgttcgccgacggaccacgngtcgatacgtacgaggtacgacgtgtcgggctcgccacctatcttgttcttccg

SEQ ID NO: 90696 - DNA, 561 bp, Homo sapiens
  misc_feature: GYAE6OF01B8OD0.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgaggggagagacgcccaccctctcctgcagggccagtcagaacattggtagcaacttgcctggtaaccaaacaaaaacctggaccagcctcccagacctcctcatttatcgttcatccaccaggccactgatcgtccccaaaccagacttcagtggcaggagggtctgggacagacttcagtctcacatcagcagcgtacagtcagaacgtcttggactagtttatacgtgtacaactatgtagtcaggtcgcctacgtaaccggttccggacccaggggacccagtacggtagtatacgtccgagggtcgaaaccgttgggtacggtctacggaccctaaccgtattccgttgttccgttacccg

SEQ ID NO: 90697 - DNA, 493 bp, Homo sapiens
  misc_feature: GYAE6OF01CM14J.5.57.F02.1.454.CMB.1.raw
  modified_base (469)..(469): a, c, t, g, unknown or other
  misc_feature (469)..(469): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagatcgtgatgacgcagtctccagccatcctgtctgtgtctccaggggagagagccaccctctcctgcagggccagtcagaacattggagcaacttagcctggtaaccaacaaaaacctggccagcctcccagactcctcatttatcgttcatccaccagggccactgatgtcccaaccagattcagtgcagagggtctgggacagacttcagtctcaccatcagcagcgtacagtctgaagtacttggctagtttattactgtcaacatgtgtcagtgcctcgaacgttcggcccagggaccagagtgatatcgaggnaactgtgctgcaccatctgtcttc

SEQ ID NO: 90698 - DNA, 495 bp, Homo sapiens
  misc_feature: GYAE6OF01EF1NO.5.57.F02.1.454.CMB.1.raw
  modified_base (388)..(388): a, c, t, g, unknown or other
  misc_feature (388)..(388): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaaccaacaaaaacctggccagcctcccagactcctcatttatcgttcatccaccagggccactgatcgtacccaaccagattcagtggcagagggtctgggacagacttcagtctcaccatcagcagctacngtctgaagcttggctagtttattactgtacaacatgtgtcagtggcctgtacgttcggcccagggaccacgagtgatatcgaggcaagtgtgctgcacatctgtctc

SEQ ID NO: 90699 - DNA, 509 bp, Homo sapiens
  misc_feature: GYAE6OF01AOD5N.5.57.F02.1.454.CMB.1.raw
  modified_base (390)..(390): a, c, t, g, unknown or other
  misc_feature (390)..(390): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaacctggccagcctcccagactcctcatttactcgttcatccaccagggccactgactcgtaccccaaccagacttcagtggcaggaggtctgggacagacttcagtctcaccatcagcagcgtanagtctagaagacttggactagtttattactgtacaacatgtgtcagtgcctcgtaacgttccgccacgggaccagagtgatatcgaggcgaactcggtgctcgccacatcttgtcttac

SEQ ID NO: 90700 - DNA, 495 bp, Homo sapiens
  misc_feature: GYAE6OF01DTMJB.5.57.F02.1.454.CMB.1.raw
  modified_base (200)..(200): a, c, t, g, unknown or other
  misc_feature (200)..(200): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagatcgtgatgacgcagtctccagccatcctgtctgtgtctccagggganagagccaccctctcctgcagggccagtcagaacattggagcaacttagcctggtaaccaacaaaaacctggccagcctcccagactcctcatttatcgttcatccaccagggccactgatgtccccaacagattcagtggcagagggtctgggacagacttcagtctcaccatcagcagcgtacagtctgaagacttggactagtttattactgtcaacatgtgtcagtgcctgtaacgttcggcccagggaccagagtggatatcgaggcgaactgtgctgcacatctgtcttc

SEQ ID NO: 90701 - DNA, 552 bp, Homo sapiens
  misc_feature: GYAE6OF01AQQSM.5.57.F02.1.454.CMB.1.raw
  modified_base (298)..(298): a, c, t, g, unknown or other
  misc_feature (298)..(298): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggtagcaacttagcctggtaccaacaaaacctggccagcctcccagacctcctcatttancgttcactccaccgagggccactgactcgtacccaaccagacttcagtggcaggagggtctgggacagtacttcagtctacaccatcagcagcgtacacgtctagaagtacttggactagtttatactgtacaataagttgtggtcaggttcggcctacggtaacgttccggacccgagggacccagtaggtgattacgcgaggaccgtaacgtggtcggtactcggacctaaccgtattccttgtccttaccg

SEQ ID NO: 90702 - DNA, 505 bp, Homo sapiens
  misc_feature: GYAE6OF01BJTED.5.57.F02.1.454.CMB.1.raw
  modified_base (201)..(201): a, c, t, g, unknown or other
  misc_feature (201)..(201): n is a, c, g, or t
  modified_base (419)..(419): a, c, t, g, unknown or other
  misc_feature (419)..(419): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggaccagcctcccagactcctcatttatcgttcactccaccaggccactgatcgtcccaacagattcagtgcagaggtctgggacagacttcagtctcaccatcagcagctacagtctagaagtacttgctagtttattactgtacaanagtgtgtcagtcgcctcgaacgttcggacccagggaccacgagtgatatcgaggacgaacgtggaggctcgctacatctgtcttac

SEQ ID NO: 90703 - DNA, 612 bp, Homo sapiens
  misc_feature: GYAE6OF01C4LXS.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggagcaacttagcctggtaaccaacaaaaacctggaccagcctaccagactcctcatttatcgttcactccaccagggccactgatcgtacccaaccagtattcaagtggacaggtagggtctagggactaggaccttcgacgtctcaaccatacagacagtaccgtaacaggttctagtaacgtacgtttgggaccttaagttttactacgttgtaccaaactaagttggtggttacaggttcggtacccgttacggtaaccggttccgggacccgtaacggggacccaacgtacgggttaggaccttagtaccggacgggtaccgtaactcgggcggtactaggaccctaaccagttcctggttccttaccg

SEQ ID NO: 90704 - DNA, 493 bp, Homo sapiens
  misc_feature: GYAE6OF01BT89P.5.57.F02.1.454.CMB.1.raw
  modified_base (240)..(240): a, c, t, g, unknown or other
  misc_feature (240)..(240): n is a, c, g, or t
  modified_base (459)..(459): a, c, t, g, unknown or other
  misc_feature (459)..(459): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagacattggancaacttgcctggtaccaacaaaaacctggccagcctccagactcctcatttatcgttcatccaccagggccactgatcgtcccaacagatcagtggcagagggtctgggacagactcagtctcacatcagcagcgtacagtctagaagacttggctagtttattactgtacaactatgtgtcagtggcctcgacgttcggccaggaccacagtgatacncgacggcaacgtgtggctcgcaccatctgtcttc

SEQ ID NO: 90705 - DNA, 561 bp, Homo sapiens
  misc_feature: GYAE6OF01BCI8K.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (385)..(385): a, c, t, g, unknown or other
  misc_feature (385)..(385): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcccaccctctcctgcagggccagtcagaacnttggancaattgcctggtaccaacaaaaacctggccagcctcccagacctcctcatttatcgttcactccaccagggccactgatcgtcccaacagattcagtgcagagggtctgggacagacttcagtctcaccatcagcagcgtacngtctagaagtctggctagtttatactgtacaacatgtgtcagtcgcctacgtaacgttccggacccgagggtaccacgtacggtagtaacttaacgtaccgaagggtaccgtaaacggttgggttaccgggcttacggaccctaaccgtaagtttcccgttggtttcctttacccg

SEQ ID NO: 90706 - DNA, 561 bp, Homo sapiens
  misc_feature: GYAE6OF01CSWSQ.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagacattggtagcaacttagcctaggtaaccaacaaaaacctggaccagcctcccagacctcctcatttatccgttcactcccaccagggcccactgactcgtaccccaacagacttcaagtcggacaggtagggtctagggacagtacttcagtctcacatcagcagcgtacagtacagaagtcttagctagtttactactgtacaactaagtgtagtcagtggtccttacgtaacgttccggacccgtaagggacccaacgagtaggactacgtccgaagggtaccgaacgttggtacggcttagcccgaactactcgtcgttcttaccg

SEQ ID NO: 90707 - DNA, 504 bp, Homo sapiens
  misc_feature: GYAE6OF01EVB6F.5.57.F02.1.454.CMB.1.raw
  modified_base (300)..(300): a, c, t, g, unknown or other
  misc_feature (300)..(300): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaaccaacaaaaacctggaccagcctcccagacctcctcatttancgttcatccaccaggccactgatcgtcccaaccagacttcagtggcagagggtctgggacagacttcagtctcaccatcagcagcgtacagtctgaagacttggcagtttattactgtacaacaatgtagtcagtgcctcgaacgttcgtacagggaccacgagtgatatcgaggcgaactggtgcgtgccacatctgtcttcg

SEQ ID NO: 90708 - DNA, 498 bp, Homo sapiens
  misc_feature: GYAE6OF01BX1OU.5.57.F02.1.454.CMB.1.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (350)..(350): a, c, t, g, unknown or other
  misc_feature (350)..(350): n is a, c, g, or t
  modified_base (410)..(410): a, c, t, g, unknown or other
  misc_feature (410)..(410): n is a, c, g, or t
  modified_base (479)..(479): a, c, t, g, unknown or other
  misc_feature (479)..(479): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacnttggagcaacttagcctggtaccaacaaaaacctggccagcctcccagactcctcatttatcgttcatccaccagggccactgatcgtcccaacagattcagtggcagagggtcngggacagacttcagtctcaccatcagcagcgtacagtctgaagcttggctagtttatacngtacaactaatgtgtcagtcgcctacgacgttcgccagggaccacgagtgatagtcgagggtcaagtgngctgccactatctgtcttc

SEQ ID NO: 90709 - DNA, 512 bp, Homo sapiens
  misc_feature: GYAE6OF01CPIVJ.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagatcgtgatgacgcagtctccagccatcctgtctgtgtctccgaggggagagagcccaccctctcctgcagggccagtcagaacattggagcaacttagcctggtaaccaacaaaaacctggccagcctcccagactcctcatttatcgttcatccaccagggccactgatcgtcccaaccagtactcagtggcagagggtctgggacagacttcagtctcaccatcagcagcgtacagtctgaagtactggctagtttattactgtacaactaatgtgtcagtgcctacgtacgttccggacccagggaccacgagtggatatcgaggtcaacgtggagctgaccactatctgtcttacg

SEQ ID NO: 90710 - DNA, 559 bp, Homo sapiens
  misc_feature: GYAE6OF01AG07Z.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagccttccagactcctcatttatcgttcatccaccagggccactgatcgtcccaaccagattcagtggcagagggtctgggacagacttcgagtctcaccatcagcagcgtacagtctgaagtcttggactagtttatactgtacaactaatgtggtacagtcggcctcggtaacgtttccggcccgtacgggaccacgtaggtggtaactagtaccgaagggtaccgaaacgttgggtacggccttaggacccgtaacctacgttccgttggttcctttacccg

SEQ ID NO: 90711 - DNA, 624 bp, Homo sapiens
  misc_feature: GYAE6OF01BXQDE.5.57.F02.1.454.CMB.1.raw
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagccaccctctcctgcagggccagtcagaacnttggancaacttgcctaggtaaccaaacaaaaacctggaccacgcctacccagacctcctacactttatcgttcactccaccgaggccactgactcgtacccaacagacttcaagtgcaggagggtcgtagggacagtacttcgagtctacaccatcagcagcgtacagtctagaacgtacgttaggacttagttttacttactacgtactaaacgtaagttggttaggtactaggttcggtacccgtaccgggtaaaccggtttccggacccgaacggggtacccaacgttaggtaacggtacgttaacgtacggtaacgggtacggtaacgttcggtacggtaccgttacggacccgtaaccgtacttccgttcgttcctttaccg

SEQ ID NO: 90712 - DNA, 491 bp, Homo sapiens
  misc_feature: GYAE6OF01EEC6W.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (475)..(475): a, c, t, g, unknown or other
  misc_feature (475)..(475): n is a, c, g, or t
  modified_base (478)..(478): a, c, t, g, unknown or other
  misc_feature (478)..(478): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctggtaccaacaaaaacctggccagcctccagactcctcatttatcgttcatccaccagggccactgatcgtcccaacagattcagtgcagaggtctgggacagacttcagtctcacatcagcagcgtacagtctagaagacttggctagtttatactgtacaactaatgtgtcaggtcgctcgacgttcgccagggaccacgagtgatatcgaggcgaactggngcngcacatctgtctc

SEQ ID NO: 90713 - DNA, 626 bp, Homo sapiens
  misc_feature: GYAE6OF01CN799.5.57.F02.1.454.CMB.1.raw
  modified_base (235)..(235): a, c, t, g, unknown or other
  misc_feature (235)..(235): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagatcgtgatgacgcagtctccagccatcctgtctgtgtctccaggggagagagcccaccctctcctgcagggccagtcagaacnttggagcaacttagcctaggtaccaaacaaaaacctggccagcctcccagactcctcatttactcgttcatcccaccagggccactgatcgtaccccaaccagattcaggtggcaggagggtctggggacaggacttcagttctacaccatcagcagcgtacagtctagaagtacttgggacttagtttattactgtacaactaattggtaggtacgtagtcgggtacccttacgggtaaccgtttccgggaccccgtaacgggggacccctaacggtacggttcggaaaccgttagtacccggtaacggggtacccgtaaacggttcggttacggggaccttacggacccgtaaacccgttagtttcccgttcgggtttcctttaccccg

SEQ ID NO: 90714 - DNA, 500 bp, Homo sapiens
  misc_feature: GYAE6OF01EMQ6O.5.57.F02.1.454.CMB.1.raw
  modified_base (201)..(201): a, c, t, g, unknown or other
  misc_feature (201)..(201): n is a, c, g, or t
  modified_base (380)..(380): a, c, t, g, unknown or other
  misc_feature (380)..(380): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttgcctggtaccaacaaaaacctggccagcctcccagactcctcatttatcgttcatccaccagggccactgatgtcccaacagattcagtgcagagggtctgggacagacttcagtctcacatcagcagcgtangtctagaagtacttggactagtttatactgtacaactatgtgtacagtcgcctcgtaacgttccggacccagggaccacgagtgatatcgaggcgactgtcgctcgcacatctgtcttac

SEQ ID NO: 90715 - DNA, 530 bp, Homo sapiens
  misc_feature: GYAE6OF01EG7RO.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagacgcccacctctcctgcagggccagtcagaacattggancaacttgcctaggtaaccaacaaaaacctggccagcctcccagactcctcatttatcgttcatccaccaggccactgactcgtacccaaccagacttacagtcgcgaggagggtctgggacagtacttcagtctacacatcagcagcgtacagtctagaagtactggactagtttattctagtacaactatgtgtacagtcgacctacgtaacgttcggacccgagggaccacgtaggtggtataagtcgaggacgaacgtgcggcaggtccactattctgtctaccg

SEQ ID NO: 90716 - DNA, 494 bp, Homo sapiens
  misc_feature: GYAE6OF01EWSEB.5.57.F02.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
  modified_base (457)..(457): a, c, t, g, unknown or other
  misc_feature (457)..(457): n is a, c, g, or t
  modified_base (488)..(488): a, c, t, g, unknown or other
  misc_feature (488)..(488): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagacctcctcatttancgttcatccaccagggcccactgatgtcccaacagattcagtgcagagggtctgggacagacttcagtctcaccatcagcagcgtacagtctgaagacttggacagtttattactgtacaactaatgtgtcagtgcctgaacgttcgctcgaggaccanagtgatagtcaggcgactgtggctcgcaccntctgtc

SEQ ID NO: 90717 - DNA, 597 bp, Homo sapiens
  misc_feature: GYAE6OF01A7BJJ.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctggtaaccaacaaaaacctggaccagcctcccagactcctctatttatcgttacactcccaccgacgggccacgtgactcgtacccaaacagtacttcagtcggacaggagggtcgtgggacagtactcgagtctacacctatacagcagcgtactagtctagaacgtacgttaggactaagtttacttactgtacaaacgtagttgtggtacgtaggtcggtaccctacggtaaccggttccggacccgaacgggaccacgtagtacggtatacgttacgacgggtaccgaacgttcgggtacggtcgtacggtaccaccgtaacgttcgttccgttcttacccg

SEQ ID NO: 90718 - DNA, 613 bp, Homo sapiens
  misc_feature: GYAE6OF01APIGV.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcagggccagtcagacattggancaacttgcctggtaccaacaaaacctggaccagcctcccagactcctctatttatcgttcactccaccgacgggccactgactcgtacccaaccagtacttcaggtcggcgaggtagggtctaggggacaggtaccttacgacgtctactaccatcacgcagcgtacgagtctagaacgtcgttaggactagttttactacgtgtacaacgtagttgtacgtcgaggttcggccgttacgtaaccggtttccggacccgaacgggtaccctacgtacggtacggtacttacgtaccgtacgggacctaacggttcgggtacggtaccttacggaccctaccgtaagttccgttggttccctttaacccgg

SEQ ID NO: 90719 - DNA, 628 bp, Homo sapiens
  misc_feature: GYAE6OF01ANUSI.5.57.F02.1.454.CMB.1.raw
  modified_base (360)..(360): a, c, t, g, unknown or other
  misc_feature (360)..(360): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatccctgtctgtgtctccgaggggagagagcccaccctctcctgcagggccagtccaagaacagttgggtagcaacttacgcctagggtaacccaaacaaaaaccctcggaccagccctacccagacctcctctatttatccgttcactcccaccgacgggccactgactcgtacccaaaccngacttcgagtcggacgaggagggtctagggactaggtacttcgagtctcacctatcagcagcgtacagtctagaacgtcgttggactagtttattactgtacaactagtgtaggtctaggttcggtcctacggtaaccggttccggacccgaacggggacccaacgtaggtacggacttaacggtccggtaacgggtcccggtaaacgttgggtaccggtaccgttaccgaccgtaacccgtagttcccgttcggtttaccttacccg

SEQ ID NO: 90720 - DNA, 593 bp, Homo sapiens
  misc_feature: GYAE6OF01CF8FZ.5.57.F02.1.454.CMB.1.raw
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagcccaccctctcctgcagggccagtcagaacattggancaacttagcctaggtaaccaaacaaaaacctggaccagcctcccagacctcctcatttactcgttcactccaccagggccactgatcgtaccccaacagacttcagtggcaggagggtcgtggacagacttcagtctcaccatcagcagcgtacagtcagaacgtacttggactagtttacttactgtacaactagtgtagtcaggtcggtcccgtacggtaacgttccgggacccgaacggggtacccaacggaggtacggaacttacgaccggtaacgggtaccggtaaacgttgggtacgggtacctcggtaccctacccgtagttcccgttggttccctttacccg

SEQ ID NO: 90721 - DNA, 500 bp, Homo sapiens
  misc_feature: GYAE6OF01BKW83.5.57.F02.1.454.CMB.1.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctctcctgcagggccagtcagaacattggancaacttgcctaggtaaccaacaaaaacctggaccagcctcccagactcctcatttatcgttcatccaccaggccactgatcgtcccaacagattcagtgcagaggtctgggacagacttcagtctcaccatcagcagcgtacagtctagaagtacttggctagtttatactgtacaatatgtgtcagtcgacctgtaacgttcgaccagggaccagagtgatagtcgaggcgaactgtcgctgcacatctgtcttcg

SEQ ID NO: 90722 - DNA, 584 bp, Homo sapiens
  misc_feature: GYAE6OF01CLM3R.5.57.F02.1.454.CMB.1.raw
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagcccaccctctcctgcgagggccagtcagaacattggancaacttagcctaggtaaccaaacaaaaacctggaccacgccctcccagacctcctctatttactccgttcactccaccgacggccactgactcgtacccaacagacttcagtcgcaggtacgggtctaggggactagtacttcgagtctacacctatcagcacggcgtaacagttactagaacgtacgttaggcttaagtttatactgtaacaactagtgtgtcaaggtcggacctacggtaccgttcggacccgagggaccacgtaggtaggactagtaccgaaggtaccgaacgttgggtacggctacggactaaccctgttccttggttcccttacg

SEQ ID NO: 90723 - DNA, 521 bp, Homo sapiens
  misc_feature: GYAE6OF01ER4CL.5.57.F02.1.454.CMB.1.raw
  modified_base (201)..(201): a, c, t, g, unknown or other
  misc_feature (201)..(201): n is a, c, g, or t
  modified_base (360)..(360): a, c, t, g, unknown or other
  misc_feature (360)..(360): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttgcctggtaccaacaaaaacctggccagcctcccagactcctcattatcgttcatccaccagggccactgatgtcccaaccagattcagtgcagagggtctgggacagacttnagtctcaccatcagcagcgtacagtctagaacgtacttggctaagtttattactgtacaactaatgtgtcagtggcctcgtaacgttcggacccagggacccacgaggtcggatagtcgaaggcgaacgtggtacggctcgccacctagtctgtccttacc

SEQ ID NO: 90724 - DNA, 503 bp, Homo sapiens
  misc_feature: GYAE6OF01DF0IU.5.57.F02.1.454.CMB.1.raw
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (374)..(374): a, c, t, g, unknown or other
  misc_feature (374)..(374): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (486)..(486): a, c, t, g, unknown or other
  misc_feature (486)..(486): n is a, c, g, or t
  modified_base (495)..(495): a, c, t, g, unknown or other
  misc_feature (495)..(495): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacnttggancaacttagcctggtaaccaacaaaaacctggaccacgcctcccagactcctcatttactcgttcatccaccagggcccactgatcgtacccaaccagattcagtggcaggaggtctgggacagacttcagtcncacatcagcagctaacngtcngaanacttggctagtttatactgtacaatatgtgtcagtcgcctacgaacgttcggacccaggacacagtcggatagtcgaggacaagtgnggctgcacntctgtctc

SEQ ID NO: 90725 - DNA, 517 bp, Homo sapiens
  misc_feature: GYAE6OF01AQ39E.5.57.F02.1.454.CMB.1.raw
  modified_base (201)..(201): a, c, t, g, unknown or other
  misc_feature (201)..(201): n is a, c, g, or t
  modified_base (480)..(480): a, c, t, g, unknown or other
  misc_feature (480)..(480): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaaacaaaaacctggccagcctcccagacctcctcatttatcgttcatccaccgaggccactgactcgtacccaaccagattcagtggcagagggtctgggacagacttcagtctcaccatcagcagcgtacagtctagaacgacttggctagtttatactgtacaactatgtagtcagtcggcctcggtaacgttcggacccagggacccagagtggtatancgacggcaacgtggtcgactgccacatcgtgttctcg

SEQ ID NO: 90726 - DNA, 569 bp, Homo sapiens
  misc_feature: GYAE6OF01CKJOY.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (405)..(405): a, c, t, g, unknown or other
  misc_feature (405)..(405): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgaggggganagacgcccaccctctccngcagggccagtcagaacnttgganctaacttagcctaggtaaccaaacaaaaacctggccagcctcccagacctcctctatttatcgttcatcccaccgagggccactgatcgtacccaaccagtacttcagtggcaggagggtctgggacagacttcgagtcctacaccatcagcagcgtanagtcagaagtacgttggacttaagtttacttactgtactaacgaattggtacggtacagggttcggaccttacggtaaccgtttccggacccgaacgggaccacgtaggtgtatacgtcgagggaccgtacgtggtcggccgtgacctacagtctgttcttacc

SEQ ID NO: 90727 - DNA, 557 bp, Homo sapiens
  misc_feature: GYAE6OF01BQSXI.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (389)..(389): a, c, t, g, unknown or other
  misc_feature (389)..(389): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgcagggccagtcagaacattggancaacttgcctggtaccaacaaaaacctggccagcctcccagactcctcatttatcgttcactccaccagggccactgatcgtcccaaccagattcagtggcagtagggtctgggacagtacttcagtctcacatcagcagcgtacngtctagaagtcttgctagtttattactgtacaactatgtagtcgaggtcggacccgttacggaacggtttccggacccgtacgggacctaacgtaggtaggactaacgttcgaggtaccggaacgttcggtcggcgtcgtaccgaacctatccgttcgttcttacccg

SEQ ID NO: 90728 - DNA, 495 bp, Homo sapiens
  misc_feature: GYAE6OF01DSELP.5.57.F02.1.454.CMB.1.raw
  modified_base (199)..(199): a, c, t, g, unknown or other
  misc_feature (199)..(199): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttgggagatcgtgatgacgcagtctccagccatcctgtctgtgtctccagggganagagccaccctctcctgcagggccagtcagaacattggagcaacttagcctggtaccaacaaaaacctggccagcctcccagactcctcatttatcgttcatccaccaggccactgatgtcccaaccagattcagtggcagagggtctgggacagacttcagtctcaccatcagcaagcgtacagtctgaagacttggctagtttattactgtacaacatgtgtcagtggcctgaacgttcggacccagggaccacgagtggatatcgaaggcaactgaggctgcacatctgtctc

SEQ ID NO: 90729 - DNA, 491 bp, Homo sapiens
  misc_feature: GYAE6OF01DZ2IG.5.57.F02.1.454.CMB.1.raw
  modified_base (200)..(200): a, c, t, g, unknown or other
  misc_feature (200)..(200): n is a, c, g, or t
  modified_base (240)..(240): a, c, t, g, unknown or other
  misc_feature (240)..(240): n is a, c, g, or t
  modified_base (338)..(338): a, c, t, g, unknown or other
  misc_feature (338)..(338): n is a, c, g, or t
  modified_base (345)..(345): a, c, t, g, unknown or other
  misc_feature (345)..(345): n is a, c, g, or t
  modified_base (421)..(421): a, c, t, g, unknown or other
  misc_feature (421)..(421): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagatcgtgatgacgcagtctccagccatcctgtctgtgtctccagggganagagccaccctctcctgcagggccagtcagaacattggancaacttagcctggtaaccaacaaaaacctggccagcctcccagactcctcatttatcgttcatccacagggccactgatgtcccaaccagattcagtncgggganagggtctgggacagacttcagtctcaccatcagcagcgtacagtctgaagacttggcagtttatactgtcaacatntggtcagtgcctgaacgttcgcccagggaccacagtgatatcgaggcaatgtggctgcacatctgtctac

SEQ ID NO: 90730 - DNA, 572 bp, Homo sapiens
  misc_feature: GYAE6OF01BBYXC.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgccaccctctcctgcagggccagtcagacnttggancaacttgcctggtaccaacaaaaacctggaccaagcctcccagactcctcattatcgttcatccaccagggcccactcgactgtaccccaaccagattccagtggacagagggtctgggacagtcttcagtctcacatcagcagcgtacagtctagaagctaggtctagtttatactgtactaacagttgtagtcgagtacggtccttacgtaaccgttccggacccgtacgggaccctaacgacggtacggtactaacgtacgacggtaccgtaaacgtcggtagggtcctacggacccgtaccctagttccttgtcccgttttacccg

SEQ ID NO: 90731 - DNA, 515 bp, Homo sapiens
  misc_feature: GYAE6OF01DKKOL.5.57.F02.1.454.CMB.1.raw
  modified_base (201)..(201): a, c, t, g, unknown or other
  misc_feature (201)..(201): n is a, c, g, or t
  modified_base (496)..(496): a, c, t, g, unknown or other
  misc_feature (496)..(496): n is a, c, g, or t
  modified_base (505)..(505): a, c, t, g, unknown or other
  misc_feature (505)..(505): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaacaaaaacctggccagcctcccagactcctcatttatcgttcatccaccaggccatgatcgtacccaaccagacttcagtggcaggtagggtctgggacagacttcagtctacaccatcagcagcgtacagtctagaagtacttggactagtttatactgtacaactaatgtgtcaggtcgccgtcgtaaccgttcggcccaggggaccacgtaggtgactatcgaggacgaatggngctgcactntctgtcttac

SEQ ID NO: 90732 - DNA, 499 bp, Homo sapiens
  misc_feature: GYAE6OF01BKR4F.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtancaacttgcctggtaccaacaaaaacctggccagcctcccagactcctcatttatcgttcatccaccagggccactgatgtcccaacagattcagtgcagagggtctgggacagacttcagtctcaccatcagcagcgtacagtctgaagtacttggctagtttattactgtacaactatgtgtcagtggcctcggaacgttcggcccagggaccacgaggtggatatcgaggcgaactgtggctgcacatctgtctc

SEQ ID NO: 90733 - DNA, 495 bp, Homo sapiens
  misc_feature: GYAE6OF01ETTJB.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaaacaaaaacctggccagcctcccagactcctcatttatcgttcatccaccagggccactgatcgtcccaaccagattcagtggcagagggtctgggacagacttcagtctcaccatcagcagcgtacagtctgaagcttggcagtttatactgtacaacaatgtgtcagtgcctcgaacgttcggcccagggaccagagtgatatcgaggcaactgtgctgcaccatctgtcttc

SEQ ID NO: 90734 - DNA, 679 bp, Homo sapiens
  misc_feature: GYAE6OF01CYY3L.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgccaccctctcctgcgagggccagtcagaacattgganctaacttgcctggtaaccaaacaaaaactggaccacgcctacccacgacctcctactatttactcgttcactccaccgacggcctactgactcgtacccaacagtacttcgagtgacgaggacgggtctagggaacaggtacttcgagttctacgacactcacgcacgtcgtaacagtactagtaacgtacgttgacttaagttttactaacgttgtaacctaaataagttcggttaggtactacggtacggtacccgttacgggtaacccggttccgggaacccgtaacggggacctaaaccggtacgggttacgggtaacttaaccggtaccggtaaacggggtacccggtaaacggttcgggttacgggtacccgttacggtaaccccgtaacccggttagtttaaccgttccggtttaccctttaacccg

SEQ ID NO: 90735 - DNA, 565 bp, Homo sapiens
  misc_feature: GYAE6OF01BX6WQ.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (300)..(300): a, c, t, g, unknown or other
  misc_feature (300)..(300): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcccaccctntcctgcagggccagtcagaacattggtagcaacttagcctggtaaccaaacaaaaacctggccagcctcccagactcctcatttancgttcatccaccaggccactgatcgtacccaacagattcagtggcagagggtctgggacagacttcagtctcaccatcagcagcgtacagtctagaaacgtcttggactagttttatacgtgtacaactaattgtaggtacaggttcggacctacggtaacgttccggacccaaggggacccacgtaggtaggtaactacgtacgagggtaccgaacgttggtcgggtactcggtacctaaccgtaatccgttggttccttaccg

SEQ ID NO: 90736 - DNA, 495 bp, Homo sapiens
  misc_feature: GYAE6OF01AI10L.5.57.F02.1.454.CMB.1.raw
  modified_base (235)..(235): a, c, t, g, unknown or other
  misc_feature (235)..(235): n is a, c, g, or t
  modified_base (242)..(242): a, c, t, g, unknown or other
  misc_feature (242)..(242): n is a, c, g, or t
  modified_base (416)..(416): a, c, t, g, unknown or other
  misc_feature (416)..(416): n is a, c, g, or t
  modified_base (457)..(457): a, c, t, g, unknown or other
  misc_feature (457)..(457): n is a, c, g, or t
  modified_base (459)..(459): a, c, t, g, unknown or other
  misc_feature (459)..(459): n is a, c, g, or t
  modified_base (478)..(478): a, c, t, g, unknown or other
  misc_feature (478)..(478): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacnttggtancaacttagcctggtaccaacaaaaacctggccagcctcccagacctcctcatttatcgttcatccaccagggccactgatcgtacccaaccagattcagtggcaggagggtctgggacagacttcagtctcaccatcagcagcgtacagtctgaagcttggctagtttattacngtacaacatgtgtcagtcgctcgacgttcgccaggaccagngngatacgcgaggcgaactgngctgcacatctgtctac

SEQ ID NO: 90737 - DNA, 528 bp, Homo sapiens
  misc_feature: GYAE6OF01CQBH6.5.57.F02.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (243)..(243): a, c, t, g, unknown or other
  misc_feature (243)..(243): n is a, c, g, or t
  modified_base (296)..(296): a, c, t, g, unknown or other
  misc_feature (296)..(296): n is a, c, g, or t
  modified_base (344)..(344): a, c, t, g, unknown or other
  misc_feature (344)..(344): n is a, c, g, or t
  modified_base (513)..(513): a, c, t, g, unknown or other
  misc_feature (513)..(513): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctntcctgcagggccagtcagaacattggtancaacttagcctggtaccaacaaaacctggccagcctccagactcctcatttancgttcatccaccaggccactgatcgtcccaacagacttcagtggcagnggtctgggacagacttcagtctcaccatcagcagcgtacagtctagaagacttggactagtttattactgtacaactattgtagtcaggtcggccttcggaacgtttccggacccgaagggacccagaggtgatagtcgaggacgtaacgtggtcggctggccaacctnttacctgttccttcg

SEQ ID NO: 90738 - DNA, 519 bp, Homo sapiens
  misc_feature: GYAE6OF01D5DBQ.5.57.F02.1.454.CMB.1.raw
  modified_base (378)..(378): a, c, t, g, unknown or other
  misc_feature (378)..(378): n is a, c, g, or t
  modified_base (410)..(410): a, c, t, g, unknown or other
  misc_feature (410)..(410): n is a, c, g, or t
  modified_base (493)..(493): a, c, t, g, unknown or other
  misc_feature (493)..(493): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgaggggagagacgcccaccctctcctgcagggccagtcagaacattggagcaacttagcctggtaaccaacaaaaacctggaccagcctcccagacctcctctatttactcgttcactcccaccgacgggccactgactcgtcccaaccagacttcagtggcaggaggtctgggacagacttnagtctcacatcacgcagcgtacagtctagaancttggctagtttattactgtacaactatgtgtcagtcgccgtcgtaacgttcggccacggaccacgagtggatagtcgacggnaacgtgcgctgcacatctgtcttacg

SEQ ID NO: 90739 - DNA, 588 bp, Homo sapiens
  misc_feature: GYAE6OF01A5G9T.5.57.F02.1.454.CMB.1.raw
  modified_base (201)..(201): a, c, t, g, unknown or other
  misc_feature (201)..(201): n is a, c, g, or t
  modified_base (351)..(351): a, c, t, g, unknown or other
  misc_feature (351)..(351): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggagcaacttagcctggtaccaacaaaaacctggccagcctccagactcctcatttatcgttcatccaccgaggccactgatcgtcccaacagatcagtcggcaggagggtcngggacagacttcagtctcaccatcagcagcgtacagtctaggaacgtacttggcttagtttacttactgttacaacgtatgtcggtacagttcggcctacggtaaccgtttccgggacccgtaagggaccctaacgaggttacggactaacgtcggaacgggtaccggaaacgttcgggttacggccgttaacggcccgtaacccgttaaagttcccgtttgttcccgtttaacccg

SEQ ID NO: 90740 - DNA, 516 bp, Homo sapiens
  misc_feature: GYAE6OF01EFUN2.5.57.F02.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctntcctgccagggccagtcagaacattggtancaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcctagtttattactgtactaacaatgtgtacaggtggcctcggaactttcgggaccctagggaccacgagtggatagttcgaggcgaactgtacggctgcacatctgtcttacg

SEQ ID NO: 90741 - DNA, 509 bp, Homo sapiens
  misc_feature: GYAE6OF01B0HM8.5.57.F02.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (421)..(421): a, c, t, g, unknown or other
  misc_feature (421)..(421): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccagggganagagcccaccctctcctgcagggccagtcagaacnttggancaacttagcctggtaccaacaaaaacctggaccagcctcccagacctcctcatttatcgttcatccaccaggccactgatgtcccaaccagattcagtgcagagggtctgggacagacttcagtctcaccatcagcagcgtacagtctagaagcttggactagtttatactgtacaanaatgtaggtcagtcggcctcggtaacgttcggacccagggaccagaggtggatactcgaggacgaactgtgctgcacatctgtcttac

SEQ ID NO: 90742 - DNA, 529 bp, Homo sapiens
  misc_feature: GYAE6OF01B68FV.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (376)..(376): a, c, t, g, unknown or other
  misc_feature (376)..(376): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccaggggganagagcccaccctctcctgcagggccagtcagaacattggancaacttgcctggtaccaaacaaaaacctggaccagcctccagacctcctcatttactcgttcactccaccagggccactgatcgtaccccaacagacttcagtggcaggagggtctgggacagacttcagtcncaccatcagcagctacagtctagaagtacgttggctaagtttacttactgtacaataatggtagtcaggtcgacctcgtaacgttccggaccgacgggaccacgaggtgatactcgacggacgaacgtgtcggctcgacacatctgtcttacg

SEQ ID NO: 90743 - DNA, 538 bp, Homo sapiens
  misc_feature: GYAE6OF01CLNO3.5.57.F02.1.454.CMB.1.raw
  modified_base (201)..(201): a, c, t, g, unknown or other
  misc_feature (201)..(201): n is a, c, g, or t
  modified_base (378)..(378): a, c, t, g, unknown or other
  misc_feature (378)..(378): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggagcaacttagcctggtaccaacaaaaacctggccagcctcccagactcctcatttatcgttcatccaccagggccactgatcgtacccaaccagacttcagtggcaggagggtctgggacaggacttcagtctcaccntcagcagcgtacagtactagaagtacttggactagttttattactgttacaaactatgtagtctagtcggcctacggaacgttcggacccgtagggaccaacgagtcggatagtcgacggtacgaacgttggacggctgaccaccattcctgttcttacg

SEQ ID NO: 90744 - DNA, 511 bp, Homo sapiens
  misc_feature: GYAE6OF01DDS79.5.57.F02.1.454.CMB.1.raw
  modified_base (201)..(201): a, c, t, g, unknown or other
  misc_feature (201)..(201): n is a, c, g, or t
  modified_base (243)..(243): a, c, t, g, unknown or other
  misc_feature (243)..(243): n is a, c, g, or t
  modified_base (425)..(425): a, c, t, g, unknown or other
  misc_feature (425)..(425): n is a, c, g, or t
tcagatcagacacgcacgaccggtgctcgatttagctcgatatagttgggtttgggggaggaactgctcagttaggactcagacggaaccatggaagccccagcgcagcttctcttcctcctgctactctggctcccagataccgttggggagatcgtgatgacgcagtctccagccatcctgtctgtgtctcgagggganagagccaccctctcctgccagggccagtcagaacattggtancaacttagcctggtaccaacaaaaacctggccagcctcccagactcctcatttatcgttcatccaccagggcccactgatcgtcccaaaccagattcagtgcaggagggtctgggacagacttcagtctcaccatcagcagcgtacagtctagaagtacttggctagtttatactgtacaanatgtgtacagtcgcctcgacgttcgacccgaggtaccactagtggtatacgtcgtaggcgaactggtggctgccacatctgttacc

SEQ ID NO: 90745 - DNA, 491 bp, Homo sapiens
  misc_feature: GYAE6OF01DRSM7.5.57.F02.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (387)..(387): a, c, t, g, unknown or other
  misc_feature (387)..(387): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctntcctgcagggccagtcagaacattggagcaacttagcctggtaaccaacaaaaacctggccaagcctcccagactcctcatttatcgttcatccaccaggccactgatgtcccaacagattcagtgcagaggtctgggacagacttcagtctcaccatcagcagcgtacagtcngaagacttggctagtttatactgtcaacatgtgtcagtgcctcgaagttcggccagggccagagtggatatcgaggcgaactggtggctgcaccatctgtctac

SEQ ID NO: 90746 - DNA, 531 bp, Homo sapiens
  misc_feature: GYAE6OF01CY1D7.5.57.F02.1.454.CMB.1.raw
  modified_base (153)..(153): a, c, t, g, unknown or other
  misc_feature (153)..(153): n is a, c, g, or t
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
  modified_base (336)..(336): a, c, t, g, unknown or other
  misc_feature (336)..(336): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagcccatcctgtctgtgtctccgaggggganagagcccaccctctcctgcagggccagtcagaacattggancaacttagcctaggtaccaacaaaaaacctggaccagcctcccagacctcctcatttatcgttcatccaccaggccactgatgtcccaacngattcagtgcagaggtctgggacagacttcagtctcaccatcagcagcgtacagtctgaagacttggctagtttatactgtacaacaattgtagtcaggtggtcctacgaaacgttccggaccaacgggaccaaccgagtaggactagtcgaggacgaaccgtggaggctacgcaaccctatccttgtccttacg

SEQ ID NO: 90747 - DNA, 505 bp, Homo sapiens
  misc_feature: GYAE6OF01ETGWO.5.57.F02.1.454.CMB.1.raw
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggtancaacttgcctggtaccaacaaaaacctggccagcctcccagactcctcatttatcgttcatccaccagggccactgatgtcccaaccagattcagtggcagaggtctgggacagacttcagtctcaccatcagcagcgtacagtctgaagacttggctagtttattactgtacaacaatgtgtcagtggcctcgaacgttccggcccagggacccacgagtcggatatcgaggcgaactggcggctgccacatctgtcttac

SEQ ID NO: 90748 - DNA, 497 bp, Homo sapiens
  misc_feature: GYAE6OF01ET586.5.57.F02.1.454.CMB.1.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (294)..(294): a, c, t, g, unknown or other
  misc_feature (294)..(294): n is a, c, g, or t
  modified_base (325)..(325): a, c, t, g, unknown or other
  misc_feature (325)..(325): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacnttggancaattagcctggtaccaacaaaaacctggccagcctccagactcctcatttancgttcatccaccaggccactgatgtccaacngattcagtggcagagggtctgggacagacttcagtctcacatcagcagcgtacagtctagaagcttggctagtttatactgtacaacatgtggtcagtggccctagaacgttcggaccagggaccacgagtggattagtcgaggcgaactggtagctgcacatctgtctacg

SEQ ID NO: 90749 - DNA, 514 bp, Homo sapiens
  misc_feature: GYAE6OF01A1KSF.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctagaagacttggctagtttatactgtacaactaatgtgtcagtcggcctcggtaacgttccggacccagggaccacgagtggatatcgaggcgaacgtggtacggctcgcaccatctgtccttcg

SEQ ID NO: 90750 - DNA, 553 bp, Homo sapiens
  misc_feature: GYAE6OF01C3G6E.5.57.F02.1.454.CMB.1.raw
  modified_base (383)..(383): a, c, t, g, unknown or other
  misc_feature (383)..(383): n is a, c, g, or t
  modified_base (435)..(435): a, c, t, g, unknown or other
  misc_feature (435)..(435): n is a, c, g, or t
  modified_base (540)..(540): a, c, t, g, unknown or other
  misc_feature (540)..(540): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggtagcaacttagcctaggtaaccaacaaaaacctggaccagcctacccagactcctcatttactcgttcactccaccgagggccactgatcgtacccaaccagacttcgagtggacaggagggtctgggacacgacttcagtcncaccatcagcagccgtacagtctagaacgtacgttggctagtttattacgtntacaataattgtggtcaggttcggacctacgtaccggttccgacccgacgggaccacgtacggtggactagtcgaggaccgaagttggcggtctcgtaccacctntactgtcttaccg

SEQ ID NO: 90751 - DNA, 509 bp, Homo sapiens
  misc_feature: GYAE6OF01DGJVB.5.57.F02.1.454.CMB.1.raw
  modified_base (501)..(501): a, c, t, g, unknown or other
  misc_feature (501)..(501): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttagcctggtaccaacaaaaacctggccagcctccagactctcatttatcgttcatccaccagggccactgatgtcccaaccagattcagtgcagagggtctgggacagacttcagtctcaccatcagcagcgtacagtctgaagacttggctagtttatactgtacaactaatgttggtcaagtggaccttcgaacgttcggcccagggaccacgagtggattagtcgaggcgtaactggtcggctagcaccatcngttcttcg

SEQ ID NO: 90752 - DNA, 716 bp, Homo sapiens
  misc_feature: GYAE6OF01C4FAG.5.57.F02.1.454.CMB.1.raw
  modified_base (238)..(238): a, c, t, g, unknown or other
  misc_feature (238)..(238): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgcccaccctctcctgcagggccagtcagaacnttggagctaacttagcctaggtaaccaaacaaaaacctggaccacgccctacccagacctcctctatttactcgttcactccaccgacggccactgatcgtacccaacagtacttcaggtcggacgaggagggtcgtggggaacaggtacttcgacgttacctccgaacctataccagaccgacggtacgtaacctagtacgtacggtaaagtaccgtttagggacctttaagtttttaacttaccgttagtaacctaaaccgttaaggttcgggtttacgggttaccgtaagggttaccgggtaccccgtttaaccgggttaaacccggtttcccggggaccccggtaacggggtacccgtaaccgttaaggggttacgggaaactttacggtacggaaaccgggtaccggtaaacgttgggtaccggggtacctcgtacccgtaacccctagtttcccgtggtttaccctttaccg

SEQ ID NO: 90753 - DNA, 629 bp, Homo sapiens
  misc_feature: GYAE6OF01CJKQL.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttgcctggtaccaacaaaaacctggccagcctcccagacctcctcatttatcgttcatcccaccagggccactgatcgtccccaacagattcgagtggcaggagggtctggggacaggtacttcgagtcctcaccatcagcagtcgtacagtctaggaacgtacgttggactaggttttaacttacgtgtaccaactaattggttaggtcgtaacggtcggtcccgttaccggtaaaccggtttccgggaccccgtaacggggacccctaacgtacgggtttacgggaacttaacgttaccggaacgggggtaccgtaaacggtttgggtacggtccgtttacggaccctaaccccgtattccggttcgtttcccgtttacccg

SEQ ID NO: 90754 - DNA, 502 bp, Homo sapiens
  misc_feature: GYAE6OF01EIHWJ.5.57.F02.1.454.CMB.1.raw
  modified_base (201)..(201): a, c, t, g, unknown or other
  misc_feature (201)..(201): n is a, c, g, or t
  modified_base (386)..(386): a, c, t, g, unknown or other
  misc_feature (386)..(386): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacngtctgaagacttggctagtttatactgtcaacattgtggtcagtggcctacggaacgtttcggcccagggacccacagtggatagtcgaggcaatggagctgcacatctgtcttac

SEQ ID NO: 90755 - DNA, 501 bp, Homo sapiens
  misc_feature: GYAE6OF01D5U6V.5.57.F02.1.454.CMB.1.raw
  modified_base (201)..(201): a, c, t, g, unknown or other
  misc_feature (201)..(201): n is a, c, g, or t
  modified_base (332)..(332): a, c, t, g, unknown or other
  misc_feature (332)..(332): n is a, c, g, or t
  modified_base (495)..(495): a, c, t, g, unknown or other
  misc_feature (495)..(495): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggtagcaacttagcctggtaccaacaaaaacctggccagcctcccagactcctcatttatcgttcatccaccagggccactgatgtcccaaccngattcagtgcagagggtctgggacagacttcagtctcaccatcagcaagcgtaacagtctagaagacttggctagtttattactgtacaacaatgtgtcaagtggcctgaacgttcggcccagggaccacagtggatatcgagcgaactgagctgcacatctntcttac

SEQ ID NO: 90756 - DNA, 767 bp, Homo sapiens
  misc_feature: GYAE6OF01DYE49.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgcccaccctctcctgcagggccaggtcagaacngttgganctaaacttgcctaggtaaccaaacaaaaaccgtggaccaacgccctaccagacctcctactactttactccgttacactccaccgacgggccctactgactcgtacccaaacctagtacttacgaggtcgacgaaggtacgggtctaggggaacaggtaccttcacggtcctacaacctactcgaagccagtaccgtaactacggtacctaggtaaacgtacgtttcggactttaagtttacttacgttagtaactaaacgtaagttcggtacggtactaacggttacggtacccgttaccgggtaaaccggtttcccgggaaccccggtaaacggggtaccccgtaaaccggtaacgggttacgggtaaaccgttaacggtaacccggtaaccggggggtaccgttaaaaccggttcggggtttaacccggggtaacccgttacccggggtaacccccgtaaaccccgtttaaccggttttcccccggtttaagggttttcccccttttaaacccccgg

SEQ ID NO: 90757 - DNA, 518 bp, Homo sapiens
  misc_feature: GYAE6OF01ARLY2.5.57.F02.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (395)..(395): a, c, t, g, unknown or other
  misc_feature (395)..(395): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgccaccctctcctgcagggccagtcagaacnttggancaacttgcctggtaccaacaaaaacctggaccagcctccagactcctcatttatcgttcactccaccgagggccactgactcgtaccccaacagacttcagtgacaggaggtcgtgggacagactcagtctcacatcagcagcgtacagtcngaagtcgttgactagtttatacgtgtacaactagttgtgtacaggtcgccgtacgtaccgtcggacccgagggaccacgaggtagactagtcgaggacaagtcggtgctgcacatctgtctac

SEQ ID NO: 90758 - DNA, 554 bp, Homo sapiens
  misc_feature: GYAE6OF01DEWB2.5.57.F02.1.454.CMB.1.raw
  modified_base (391)..(391): a, c, t, g, unknown or other
  misc_feature (391)..(391): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggagcaacttagcctggtaaccaacaaaaacctgccagcctcccagactcctcatttatcgttcactccaccacgggccactgatcgtacccaaccagattcagtggacaggagggtctgggacagacttcagtctcacatcagcagctaacngtactgaatacgttggactagtttattacctgtacctaactaattggtaggttcaaggttcggccttaccgggtaacgtttccggacccgtaagggacccacgtacgtggacttagcgacgggtcaacgtggtaggctaggccacctatccgtgttccgttac

SEQ ID NO: 90759 - DNA, 521 bp, Homo sapiens
  misc_feature: GYAE6OF01AXUDD.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (389)..(389): a, c, t, g, unknown or other
  misc_feature (389)..(389): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggancaacttgcctggtaccaacaaaaacctggccagcctcccagacctcctcatttatcgttcactccaccacgggccactgatcgtacccaacagattcagtcgcaggagggtctgggacagacttcagtctcaccatcagcagcgtangtctagaagtacttggactagtttatactgtacaactatgtgtcagtcgcctacggtacgttcggaccagggaccacgagtaggatagtcgacggacaacgtggcgtctcgtacacctatcgttgttcctac

SEQ ID NO: 90760 - DNA, 525 bp, Homo sapiens
  misc_feature: GYAE6OF01CVHYC.5.57.F02.1.454.CMB.1.raw
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccacctctcctgcagggccagtcagaacattggancaacttagcctggtaccaacaaaaacctggccagcctccagactctcatttatcgttcatccacacgggccactgatgtacccaaccagattcagtggcaggagggtctgggacaggacttcagtctcaccatcagcagcgtacagtctagaagacttggctagtttatacgtgtacaactatgtggtctaagtcggcctacggacgttccggcccagggaccaacgtagtgatagtacgaggacgtaacgtggtcggcgtgccaacctattctggtcttacg

SEQ ID NO: 90761 - DNA, 513 bp, Homo sapiens
  misc_feature: GYAE6OF01BKRQG.5.57.F02.1.454.CMB.1.raw
  modified_base (203)..(203): a, c, t, g, unknown or other
  misc_feature (203)..(203): n is a, c, g, or t
  modified_base (429)..(429): a, c, t, g, unknown or other
  misc_feature (429)..(429): n is a, c, g, or t
  modified_base (470)..(470): a, c, t, g, unknown or other
  misc_feature (470)..(470): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccaggggganagagcccaccctctcctgcagggccagtcagaacattggtagcaacttagcctggtaccaacaaaaacctggccagcctacccagactcctcatttatcgttcatccaccagggccactgactcgtacccaaccagattcagtggcagagggtctgggacagactcagtctcacatcagcagacgtacagtctagaagtacttggactagtttatacgtgtacaanatgtgtcagtggcctcgtacgttcgaccgaggaccacgagnggatatcgaggcgtaactgtcggctacgcacatcgtgtcttcg

SEQ ID NO: 90762 - DNA, 523 bp, Homo sapiens
  misc_feature: GYAE6OF01ENTRG.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (386)..(386): a, c, t, g, unknown or other
  misc_feature (386)..(386): n is a, c, g, or t
  modified_base (397)..(397): a, c, t, g, unknown or other
  misc_feature (397)..(397): n is a, c, g, or t
  modified_base (431)..(431): a, c, t, g, unknown or other
  misc_feature (431)..(431): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttgcctggtaccaacaaaacctgccagcctcccagactcctcatttatcgttcactccaccacgggccactgatcgtacccaaccagattcagtggcaggaggtctgggacagacttcacgtctcaccatcagcagcgtangtctagaagtnttggactagtttattactgtacaactattgtgtnagtcgcctgtaacgttcggacccaggacccagagtaggatagtacgacgggacgtaacgtggtacgtctacgccacctattcctgtcttacg

SEQ ID NO: 90763 - DNA, 494 bp, Homo sapiens
  misc_feature: GYAE6OF01BJ595.5.57.F02.1.454.CMB.1.raw
  modified_base (200)..(200): a, c, t, g, unknown or other
  misc_feature (200)..(200): n is a, c, g, or t
  modified_base (240)..(240): a, c, t, g, unknown or other
  misc_feature (240)..(240): n is a, c, g, or t
  modified_base (411)..(411): a, c, t, g, unknown or other
  misc_feature (411)..(411): n is a, c, g, or t
  modified_base (473)..(473): a, c, t, g, unknown or other
  misc_feature (473)..(473): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttgcctggtaccaacaaaaacctggccagcctcccagactcctcatttatcgttcatccaccagggccactgatgtcccaacagattcagtgcagagggtctgggacagacttcagtctcaccatcagcagctacagtctgaagcttggctagtttatactgtcaanatgtgtcagtggcctcgaacgttcggcccagggaccacgagtgatagtcgaggcgaacgtgnggctcgcacatctgtcttacg

SEQ ID NO: 90764 - DNA, 549 bp, Homo sapiens
  misc_feature: GYAE6OF01CNAA4.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaaacttgcctggtaaccaacaaaaacctggaccagccctacccagacctcctacatttatcgttcatcccacacgggccactgactcgtacccaacagattcagtgcaggagggtctgggacagacttcagtctcaccatcagcagcgtacagtctagaagacttggactagtttattactgtacaactaatggttacgtcaagtcggacctacggtaaccgttccggacccgagggtaccagtacggtagactagtcgaacgggtagaacgttggtggacctgccactagttctgttcttaccg

SEQ ID NO: 90765 - DNA, 529 bp, Homo sapiens
  misc_feature: GYAE6OF01D76VT.5.57.F02.1.454.CMB.1.raw
  modified_base (244)..(244): a, c, t, g, unknown or other
  misc_feature (244)..(244): n is a, c, g, or t
  modified_base (402)..(402): a, c, t, g, unknown or other
  misc_feature (402)..(402): n is a, c, g, or t
  modified_base (480)..(480): a, c, t, g, unknown or other
  misc_feature (480)..(480): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccaggggagagagcccaccctctcctgcagggccagtcagaacattggtancaacttgcctggtaaccaaacaaaaacctggaccagcctcccagactcctctatttactcgttcatcccacgacgggccactgactcgtacccaaccagacttcagtggcaggaggtcgtagggacagtacttcacgtctcacatcagcagcgtaacngtctagaagtacttggactagtttattactgtacaactatgtgtcagtcgcctacgtaacgttccgaccaggaccagngtgatatcgaggtacgagtcgaggtctagacctactatctgtcttaccg

SEQ ID NO: 90766 - DNA, 515 bp, Homo sapiens
  misc_feature: GYAE6OF01BMEZR.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagcccatcctgtctgtgtctccgagggganagagcccaccctntcctgccagggccagtcagaacnttggagcaattgcctggtaccaacaaaaacctggccagcctcccagactcctcatttatcgttcatcccaccagggccactgatcgtcccaaccagattcagtggcagagggtctgggacacgacttcagtctcgaaccagtcagcagcgtacagtctgaagtacttggctagtttatctgtacaanatgtgtnagtgcctacgtaacgtcggcccgagggaccacgagtggatagtcgaggcgaacgtggcggcgtgccgacagtctgtcgttac

SEQ ID NO: 90767 - DNA, 490 bp, Homo sapiens
  misc_feature: GYAE6OF01DVKRS.5.57.F02.1.454.CMB.1.raw
  modified_base (464)..(464): a, c, t, g, unknown or other
  misc_feature (464)..(464): n is a, c, g, or t
  modified_base (469)..(469): a, c, t, g, unknown or other
  misc_feature (469)..(469): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
  modified_base (485)..(485): a, c, t, g, unknown or other
  misc_feature (485)..(485): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagacgccaccctctcctgcagggccagtcagaacagttggtagcaacttagcctggtaaccaacaaaaacctggccagcctcccagactcctctatttactcgttcactccacacgggccactgactcgacccaaccagattcagtggcaggagggtctggacagacttcagtctcacatcagcagctacagtctagaagacttgctagtttatctgacaacatgtgtcagtcgctagacgttcgccgaggccagagtgactncgagnactgcgntgcacntcngtctc

SEQ ID NO: 90768 - DNA, 532 bp, Homo sapiens
  misc_feature: GYAE6OF01C4R4S.5.57.F02.1.454.CMB.1.raw
  modified_base (200)..(200): a, c, t, g, unknown or other
  misc_feature (200)..(200): n is a, c, g, or t
  modified_base (391)..(391): a, c, t, g, unknown or other
  misc_feature (391)..(391): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagatcgtgatgacgcagtctccagccatcctgtctgtgtctccagggganagagcccaccctctcctgcagggccagtcagaacattggtagcaacttagcctggtaacccaaacaaaaacctggaccagcctcccagacctcctcatttatcgttcatccaccagggccactgactcgtacccaaccagacttcagtgcagagggtctgggacagacttcagtctcacatcagcagctanagtctagagtactgctagtttatacgtgtacaactaatgtgtcagtcgccctgtaacgttcggccctaaggccacgtaggtgacttagacgaggtccgaacgttgggacggtctcggccaaccattccctggttccttacc

SEQ ID NO: 90769 - DNA, 479 bp, Homo sapiens
  misc_feature: GYAE6OF01BCSEY.5.57.F02.1.454.CMB.1.raw
  modified_base (413)..(413): a, c, t, g, unknown or other
  misc_feature (413)..(413): n is a, c, g, or t
  modified_base (445)..(445): a, c, t, g, unknown or other
  misc_feature (445)..(445): n is a, c, g, or t
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttagcctggtaccaacaaaaacctggccagcctccagactcctcatttatcgttcatccaccagggccactgatcgtcccaacagattcagtgcagaggtctgggacagacttcagtctcaccatcagcagcgtacagtctgaagacttggctagtttatactgtcaanatgtgtcagtgcctgaacgttcgccaggcacngtgatatcgagnaactgngncgcacatctgtctc

SEQ ID NO: 90770 - DNA, 546 bp, Homo sapiens
  misc_feature: GYAE6OF01B62U2.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaaccaacaaaaacctggaccagcctcccagacctcctcatttatcgttcatccaccagggccactgatcgtcccaacagattcagtgcagaggtctgggacagacttcagtctcaccatcagcagcgtacagtctgaagcttggctagtttattactgtacaactaatgtacggtacaggttcggtcccgtacggtaaccggtttccggaccccgaaggggtacccaacgaggtggatacgtcgacggacgaacgttggtaggctggacctaccgatcttgttcttaccg

SEQ ID NO: 90771 - DNA, 699 bp, Homo sapiens
  misc_feature: GYAE6OF01BZ6YY.5.57.F02.1.454.CMB.1.raw
  modified_base (204)..(204): a, c, t, g, unknown or other
  misc_feature (204)..(204): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgaggggganacgccaccctcctcctcgcgacggccgacgtacgacgaaacgtattggtaggactaacttacgtaccgtacggttaaccgaaaaccaaaaaccgtacggccacgacctacccacgacctcctactatttacttcgttcactaccaccgacggaccactgactcgtacccaaccagtactctagcggtcgagacgggtgtcgganacgactcngtctcaacactcagacgtacgccgtaagacgtcgtagtaagtaacgttcggacttaagttttacttacgtacgtaacgtaaactaagttcggttggttaaccgacggttcgggacccttaccgggtaaccgggtttcccgggaccccgaaacggggaccctaaccggtaacgggttacgggtacttaacgtacgaaaccggggtaccggtaaaccgttcgggttagggcccgttaacgacccgtaacccgaactttcggttaaccctttgttcccttaacccg

SEQ ID NO: 90772 - DNA, 807 bp, Homo sapiens
  misc_feature: GYAE6OF01DI5TD.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgccaccctntcctgcaggccagtcagaacattggancaacttgcctaggtaaccaaacaaaaacctggaccacgcctacccagacctcctctatttactcgttcactccaaccgacgggccactcgactcgtaccccaaaccagtacttcgaggtcggacgaagggtacggggtcgtaggggaacacggtaaccgtttcgacgttaccttaccaaaccctacttaccgaacggcctaacgggtaccggttaaaccgaagggtttaccctaagggtaaaacgttaccgttttacggggtaccttaaacgggttttttaactttaaccgttacggttaaccctaaaaccgtaagtttacgggttacgggtttaaccgtaagggtttccgggtaccccgtttaccggggtaaaacccgggttttcccggggaaccccgtaacgggggtaacccctaaaccgggtacggttacgggtaaacgttaacggttaccgggtaaaccggggtaccggtaaaaccggtttgggtaaccgggggtaccctttaacgggaacccgttaaccccgtaagttttcccgttaccggtttacccgttttaacccg

SEQ ID NO: 90773 - DNA, 526 bp, Homo sapiens
  misc_feature: GYAE6OF01DJ8OP.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (374)..(374): a, c, t, g, unknown or other
  misc_feature (374)..(374): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgcagggccagtcagaacattggagcaacttagcctggtaaccaacaaaaacctggccagcctcccagactcctcatttatcgttcatccaccagggccactgatcgtaccccaaccagattcagtggcaggagggtctgggacagacttcagtcncaccatcagcagcgtacagtctagaagacttggctagtttatactgtacaactatgtggtcagtgcctcgaccgttcggcccagggaccacgagtcggatacgtcgaggtcgaacgtggtcggctcggcaccgattcctgttccctttaccg

SEQ ID NO: 90774 - DNA, 763 bp, Homo sapiens
  misc_feature: GYAE6OF01BGQFZ.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctcctcgtgcgacgggccagtacaacgaactagttggacgactaaacgttacgccgttacggtaaacccaaaaacctaaaaaccgtcggacccacgtccctacccgaacgtacccttcctacttaacttttacgttccgttaccaccttaccccgaaccggtaccgggaccctacgtaggtacttcccggtaacccccaaaaccgagttaccttacgacggttacggacgtaaggggtacggggttccggtaggggaacctaacggttaccttacgtaacgttcctaaccaaccgtatacgaacgtacgacggtaccgtaacgtacgttacgtaggaaacggtacgtttacggactttaagttttacttaacggtcgttaaccaaagttagttcggttacgtacgtacgggttaccggtacccgttaacgggtaacccggttcccgggaacccgtaacgggaccctaaggtagggtagtactacgtacggacgggtaccgtaacgtgggtacgcgtcggaccctaacgtacgttccttcgttccttaaccgg

SEQ ID NO: 90775 - DNA, 639 bp, Homo sapiens
  misc_feature: GYAE6OF01BLCLK.5.57.F02.1.454.CMB.1.raw
  modified_base (245)..(245): a, c, t, g, unknown or other
  misc_feature (245)..(245): n is a, c, g, or t
  modified_base (370)..(370): a, c, t, g, unknown or other
  misc_feature (370)..(370): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgcccaccctctcctgcagggccagtcagaacattggtancaacttgcctaggtaaccaaacaaaaacctggaccacgcctacccagacctcctactatttactcgttacactcccaacgacggaccacgtgactcgtaccccaaacagtattcgagtgcaaggngggtcgtagggacagtactacacgtctacacatcacgcagctactagtactagaagtcgttaggacttaaggtttacttacgtacgtacaaacgtaagttggtacgtacgtaaggttcggtaccccgttaacgggtaacccgttccgggacccgaacgggtaccctaacgaacgggttaacgggaattaaccgttacggaacgggtaccggtaaacggttcgggacggtcgttacgacgttaacctagtttcgtccggtttacttaccc

SEQ ID NO: 90776 - DNA, 581 bp, Homo sapiens
  misc_feature: GYAE6OF01BJPPL.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (387)..(387): a, c, t, g, unknown or other
  misc_feature (387)..(387): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcccacctctcctgcagggccagtcagaacattggancaacttgcctaggtaaccaaacaaaaacctggaccagccctcccagacctcctctatttactcgttacactccaccgagggccactgactcgtacccaaccagacttcagtgcaggagggtctgggacagtactcagtctacaccntcagcagcgtacagtctagaagtacttggacttagtttactacgtgtacaatagtggtgtactaggtcggtacccttacggtaaccgttccggaccgacgggacctaacgtaggtacgtactacgtacggaacggtaccgtaacgttcgggtacggtacgtcgaccctacccgtattccgttcgttccttaccg

SEQ ID NO: 90777 - DNA, 554 bp, Homo sapiens
  misc_feature: GYAE6OF01D5AN4.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaaccaaacaaaaacctggaccagcctacccagacctcctcatttatcgttcatcccaccgagggccactgatcgtacccaacagattcagtggcagagggtctagggacagacttcagtctcaccatcagcagcgtacagtctagaaagacgttggactagttttattactgtacaactaagttgtaggtctaagtcggtccctacggtaaccgttccggacccgaacgggacccacgtacgtggatagtacgacggacgaacgtgtcggctcggtacaccgtattcgtgtcttaccg

SEQ ID NO: 90778 - DNA, 603 bp, Homo sapiens
  misc_feature: GYAE6OF01A1AWM.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtancaacttagcctggtaaccaacaaaaacctggccagcctcccagactcctcatttatcgttcactccaccagggccactgactcgtacccaaccagattcagtggcaggaggtctgggacagacttcagtctcaccatcagcagcgtacagtctagaagtacttggactagtttattactgtacaactaagttgtggtacaaggtcggcccgtacggtaaccggtttccgggaccccgtaaggggaccccaacgtacgggttacggaacttaacgttaccggaacggggtaccggtaaacgttcgggtacgggtaccgttacggacccgtacccgaatttcccgtggtttccctttaacccg

SEQ ID NO: 90779 - DNA, 514 bp, Homo sapiens
  misc_feature: GYAE6OF01DVD15.5.57.F02.1.454.CMB.1.raw
  modified_base (201)..(201): a, c, t, g, unknown or other
  misc_feature (201)..(201): n is a, c, g, or t
  modified_base (500)..(500): a, c, t, g, unknown or other
  misc_feature (500)..(500): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaaccaacaaaaacctggccagcctcccagactcctcatttatcgttcatccaccagggccactgatcgtcccaaccagattcagtggcaggagggtctgggacagacttcagtctcaccatcagcagccgtacagtctgaagacttggctagtttatactgtcaactatgtgtcagtcggcctcgaacgttcggccgagggaccacgagtggatagtcgaggcgaacgtggtcggctggcaacnttcctgtcttaccg

SEQ ID NO: 90780 - DNA, 610 bp, Homo sapiens
  misc_feature: GYAE6OF01AVCDD.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccgaggccactgatcgtacccaaccagacttcagtggcaggagggtctgggacagacttcagtctcaccatcagcagctacagtctagaagtcttggactagtttacttacgtagtacaactaagttgtacggtactaggtcgggtaccttacggtaaaccggtttccgggaccccgtaacggggaccccaacgtacgggttacggtaaacttacggtaccgaagggtacccggtaaacgttgggttaccgggcgttacggacccgtaacccgtaagtttcccgttcggttcccgtttacccg

SEQ ID NO: 90781 - DNA, 582 bp, Homo sapiens
  misc_feature: GYAE6OF01ALBBI.5.57.F02.1.454.CMB.1.raw
  modified_base (204)..(204): a, c, t, g, unknown or other
  misc_feature (204)..(204): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (383)..(383): a, c, t, g, unknown or other
  misc_feature (383)..(383): n is a, c, g, or t
  modified_base (427)..(427): a, c, t, g, unknown or other
  misc_feature (427)..(427): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgaggggganagacgcccaccctctcctgcagggccagtcagaacnttggtancaacttagcctggtaccaaacaaaaacctggccagcctcccagactcctcatttatcgttcatccaccagggccactgactcgtacccaaccagattcagtggcaggagggtctgggacagtactcagtctcaccntcagcagcgtacagtctaggaagtcttggctagtttacttacgngtacaactagtgtacgggtactaggtcggtaccctacggtaaccggtttccgggacccctaggggaccctacggaggttcggaacttacgtcgacgggtaccgtaacgttggtacgggtactcgggtaccaccgtagttcttcggttccttaccg

SEQ ID NO: 90782 - DNA, 513 bp, Homo sapiens
  misc_feature: GYAE6OF01ATXEK.5.57.F02.1.454.CMB.1.raw
  modified_base (388)..(388): a, c, t, g, unknown or other
  misc_feature (388)..(388): n is a, c, g, or t
  modified_base (433)..(433): a, c, t, g, unknown or other
  misc_feature (433)..(433): n is a, c, g, or t
  modified_base (465)..(465): a, c, t, g, unknown or other
  misc_feature (465)..(465): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggtagcaacttgcctggtaccaacaaaaacctggccagcctcccagactcctcatttatcgttcatccaccagggccactgatgtccccaaccagattccagtggcagagggtctgggacagacttcagtctcaccatcagcagcgtacngtctgaagcttggactagtttacttactgtacaactatgtgtacngtggcctacgaacgttcgcccgagggccacgngtcggatagtcgaggacgtaactggtcgctgacacatctgtcttaccg

SEQ ID NO: 90783 - DNA, 536 bp, Homo sapiens
  misc_feature: GYAE6OF01AXFHZ.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (400)..(400): a, c, t, g, unknown or other
  misc_feature (400)..(400): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagccaccctctcctgcagggccagtcagaacagttggtagctaacttagcctaggtaaccaaacaaaaacctggaccagcctcccagactcctcatttatcgttcactccaccacgggccactgatcgtaccccaaccagacttcagtggcaggagggtctgggacagacttcagtctacaccatcagcagctacngtctagaagtacttggactagtttatactagtacaataagtgtcggtcaggtcgccgtacgtaacggttccggaccgacgggaccacgaggtggactagtacgaggcgaactggtcgctcgacacatctgtcttcc

SEQ ID NO: 90784 - DNA, 530 bp, Homo sapiens
  misc_feature: GYAE6OF01D5KFN.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (457)..(457): a, c, t, g, unknown or other
  misc_feature (457)..(457): n is a, c, g, or t
  modified_base (509)..(509): a, c, t, g, unknown or other
  misc_feature (509)..(509): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgcagggccagtcagaacattggancaacttgcctaggtaaccaaacaaaaacctggaccagccctcccagacctcctctatttactcgttcactccaccgagggccactgactcgtaccccaaccagattcagtggcaggagggtcgtgggactaggacttcgagtctcaaccatcagcagcgtaacagtctagaagtacgttggacttaagtttacttactgtacaatatgtggtanagtgcctacgtacgttcgccgaggaccagagtgatatcgacggtgaactggngcgtcgacacatctgtcttac

SEQ ID NO: 90785 - DNA, 542 bp, Homo sapiens
  misc_feature: GYAE6OF01ASSNM.5.57.F02.1.454.CMB.1.raw
  modified_base (330)..(330): a, c, t, g, unknown or other
  misc_feature (330)..(330): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttagcctggtaccaacaaaacctggccagcctcccagactcctcatttactcgttcatccaccagggccactgatcgtcccaacngattcagtggacagagggtctgggacagacttcagtctcaccatcagcagcgtacagtctagaagtacttggactagtttattactgtacaactaagtgtaggtctaggtcggccctcggaaccgttcggaccctaggggacccaacgacgtggattacgtcgaggtacggaacttggtacggccttggccaaccagtcgtcgtccttaccg

SEQ ID NO: 90786 - DNA, 749 bp, Homo sapiens
  misc_feature: GYAE6OF01CRN1W.5.57.F02.1.454.CMB.1.raw
  modified_base (155)..(155): a, c, t, g, unknown or other
  misc_feature (155)..(155): n is a, c, g, or t
  modified_base (733)..(733): a, c, t, g, unknown or other
  misc_feature (733)..(733): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgaggggagagacgcccaccctctccgtgccgacgggccaggtccaagaacctagtttagggacacctaaacgtttacgacccgttaaggtaaacccaaaacgtaaaaaccgtcgggaacccaaccggtccctacccaagtacccttacctacttaacttttaactccgttacctaacctcccgaacccgacgggtaccctaacgtcggtaacttacccggaacccctaaccgtaagtacgttacgaggttacggacgtaagggtacgggtcgtagggaacgtacggtaccttcgacgtcctacaacctagtaccgacgtaccgaagtcgtaaccgtaggtactaaggtaaacgttacgttacgggtactttaaagttttacttaacgtacgtaactaaacgttagtgggttacggtacgtacggtaccgggtccgtaacggtaacccggttccggacccggtaaggacccgaagtcgggtacggtactacgtaccggaacgggtacgtaacgtggttaccgcgtacgcctaacgttnttactcgttcttaccc

SEQ ID NO: 90787 - DNA, 522 bp, Homo sapiens
  misc_feature: GYAE6OF01AGBZ6.5.57.F02.1.454.CMB.1.raw
  modified_base (201)..(201): a, c, t, g, unknown or other
  misc_feature (201)..(201): n is a, c, g, or t
  modified_base (296)..(296): a, c, t, g, unknown or other
  misc_feature (296)..(296): n is a, c, g, or t
  modified_base (410)..(410): a, c, t, g, unknown or other
  misc_feature (410)..(410): n is a, c, g, or t
  modified_base (468)..(468): a, c, t, g, unknown or other
  misc_feature (468)..(468): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggagcaacttgcctggtaccaacaaaaacctggccagcctcccagactcctcatttancgttcatccacaggccactgatgtacccaacagattcagtggcagaggtctgggacagtacttcagtctcaccatcagcagcgtacagtctagaacgcttggctagtttatacngtacaacaagtgtgtctagtcggcctacggtaaccgttccggcccgtagggacccaanggtgactatcgaggtacgaacgtggtcggcacgccaaccatctgttccttaccg

SEQ ID NO: 90788 - DNA, 516 bp, Homo sapiens
  misc_feature: GYAE6OF01EC1ND.5.57.F02.1.454.CMB.1.raw
  modified_base (202)..(202): a, c, t, g, unknown or other
  misc_feature (202)..(202): n is a, c, g, or t
  modified_base (492)..(492): a, c, t, g, unknown or other
  misc_feature (492)..(492): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccagggganagagccaccctctcctgcagggccagtcagaacattggtagcaacttagcctaggtaaccaacaaaaacctggaccagcctcccagacctcctctatttatcgttcatcccaccgacgggccactgactcgtacccaaccagtacttcagtggcaggaggtcgtgggacaggtacttcagtctcaccatcagcagcgtacagtctagaagtacttggactagtttatactgtacaactatgtgtcagtcgcctacgacgttcgaccgagggaccacgagtgatatcgagngactgtggctgcacatctgtctac

SEQ ID NO: 90789 - DNA, 523 bp, Homo sapiens
  misc_feature: GYAE6OF01C2FL2.5.57.F02.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
  modified_base (514)..(514): a, c, t, g, unknown or other
  misc_feature (514)..(514): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctctcctgcagggcccagtcagaacattggancaacttgcctggtaccaacaaaaacctgccagcctccagactcctcatttatcgttcactccaccagggccactgatcgtaccccaaccagtacttcaggtggacgaggagggtctgggacaggactttcagtctcaccatcagcacgcgtacagtctagaacgtacgttaggctagtttattactgtacaactaatgtgtcagtggacctcggacgttcggacccagggaccagtacgtggatatcgacggcagtcggtggctgcaccntctgttctc

SEQ ID NO: 90790 - DNA, 506 bp, Homo sapiens
  misc_feature: GYAE6OF01EARLJ.5.57.F02.1.454.CMB.1.raw
  modified_base (201)..(201): a, c, t, g, unknown or other
  misc_feature (201)..(201): n is a, c, g, or t
  modified_base (485)..(485): a, c, t, g, unknown or other
  misc_feature (485)..(485): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagtcaccctctcctgcagggccagtcagaacattggtagcaacttagcctggtaccaacaaaaacctggccagcctcccagactcctctatttatcgttcactccaccagggccactgatgtcccaacagattcagtggcagagggtctgggacagacttcagtctcaccatcagcagcgtacagtctagaagtacttggctagtttattactgtacaactatgtgtcagtcgcctacgacgttcgccagggaccacgagtggatatcgaggcgaacgtggnggctcgcacctatctgtcttc

SEQ ID NO: 90791 - DNA, 575 bp, Homo sapiens
  misc_feature: GYAE6OF01CXK3C.5.57.F02.1.454.CMB.1.raw
  modified_base (201)..(201): a, c, t, g, unknown or other
  misc_feature (201)..(201): n is a, c, g, or t
  modified_base (410)..(410): a, c, t, g, unknown or other
  misc_feature (410)..(410): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccgtgggagatcgtgatgacgcagtctccagccatcctgtctgtgtctccgagggganagacgcccaccctctcctgcagggccagtcagaacagttggagcaactttagacctggtaacccaaacaaaaacctggaccaagccctcccagacctcctacatttatccgttcactccaccacgggccactcgatcgtacccaaccagtacttcgagtggctagagggtctagggacaggacttcagtcacaccatcagcagctaacngtctagaatacttggctagtttactactgtactaactaatcgtgtctaagtcggtacctacggaacgtttccggaccccgtaaggggacccaaggtaacgtacggaactagtcggaaacgggtccaaacgtcggtcggctagccgaactatcgtgttcgttaccg

SEQ ID NO: 90792 - DNA, 598 bp, Homo sapiens
  misc_feature: GYAE6OF01EQG3X.5.57.F02.1.454.CMB.1.raw
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacnttggancaacttgcctggtaccaaacaaaaacctggcccagcctcccagacctcctctatttatcgttcatcccaccagggccactgatcgtccccaaccagacttcagtcggcaggaggggtctggggacaggtacttcagtcctcaccatccagcagtcgtacagtctagaagtacttggctaaggttttattacgtgtacaactattggtgtacaggtcggcccgttacggtaaacggtttccggacccgtaagggaccctaacgaggtacggtactaacgtacgaacgggtaccggaaaccgttgggtcgggtaccgttacggtaccaacccgtagttccgttcggttcctttacccg

SEQ ID NO: 90793 - DNA, 547 bp, Homo sapiens
  misc_feature: GYAE6OF01BOP1W.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagacctcctcatttatcgttcatccaccagggcccactgactcgtccccaaccagattcagtcggcaggagggtctgggacagtacttcacgtctcaccatcagcagcgtacagtcagaacgtacgttggcttagttttaacttactgttacaactaagttgtaggtctaaggtcggcctacggtaacggttccgccgacgggaccacgagtcgatagtacgaggtacgaacgtgtacggcttcgacctacattctgtccttacg

SEQ ID NO: 90794 - DNA, 730 bp, Homo sapiens
  misc_feature: GYAE6OF01D5PRT.5.57.F02.1.454.CMB.1.raw
  modified_base (203)..(203): a, c, t, g, unknown or other
  misc_feature (203)..(203): n is a, c, g, or t
  modified_base (354)..(354): a, c, t, g, unknown or other
  misc_feature (354)..(354): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagagccaccctctcctgcagggccagtcaagaactagttggtagctaaacttaggcctaggtaaccaaacaaaaacctggaccagccctacccagacctcctctatttactcgttcactcccaccgaggccactgactcgtacccaacagnttacaggtcggcaggacggggtcgtaggacaggtacctttcgaacgtcctaccaactactaccgaacgtacaacggtccgttaacgaggttacgtaaggtaaaacgtaccgtttagggaaccctttaagggttttaacttacggtaacgttacctaaagtaagtttgggttaccgggtacgtacggggttaccggtacccgttaaccgggtaaccgggtttcccgggacccggtaaccgggtaacccgaacggtacggtacgggtaacttaacggttacggaacccggggtacgtaaacggttttccgggacgggttccgaaccgggttaaccccaacccgttaggtttccccgtttacgtcccggttttaacccc

SEQ ID NO: 90795 - DNA, 553 bp, Homo sapiens
  misc_feature: GYAE6OF01ALX8R.5.57.F02.1.454.CMB.1.raw
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagccaccctctcctgcagggccagtcagaacnttggtagcaacttagcctaggtaaccaaacaaaaacctggaccagccctcccagacctcctcatttactcgttcactccaccgagggccactgactcgtaccccaaccagtacttcaggtggcaggagggtctagggacagtacttcagtctcacatcagcagcgtacagtctagaagtacgttgactagttttactactgtacaatatgtgtacaggtcgcctacggtaccgttccggacccgagggaccacgtagtggtatacgtacgaggaccgtaagtcggagtcgtacgaccaccgtatcgtgtccttaccg

SEQ ID NO: 90796 - DNA, 538 bp, Homo sapiens
  misc_feature: GYAE6OF01DQBIK.5.57.F02.1.454.CMB.1.raw
  modified_base (242)..(242): a, c, t, g, unknown or other
  misc_feature (242)..(242): n is a, c, g, or t
  modified_base (396)..(396): a, c, t, g, unknown or other
  misc_feature (396)..(396): n is a, c, g, or t
  modified_base (526)..(526): a, c, t, g, unknown or other
  misc_feature (526)..(526): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggancaacttagcctggtaaccaaacaaaaacctggaccagcctcccagactcctctatttatcgttcactccaccagggccactgatcgacccaaccagacttcagtggacaggaggtctgggacaggtactcagtctacaccatcagcagctaacngtctgaacgtacgttggctagtttattactgtacaactagtgtagtcagtcggcctacggaacgttcgacccgtagggaccagagtaggatacgtcgacggacgaacgtggtcggctacggccaaccgtntctgttcttacg

SEQ ID NO: 90797 - DNA, 629 bp, Homo sapiens
  misc_feature: GYAE6OF01B0PTI.5.57.F02.1.454.CMB.1.raw
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccgaggggnagacgcccaccctctccngcagggccagtcagactagttggancaacttgcctaggtaaccaacaaaaacctggaccacgccctacccagtacctcctactactttactcgtttacactccacgacggccactcgatcgtacccaacgagtacttcgagtcgacaggtacggtcgtaggacgagtactcgacgtctacacgatcacgtacacgtacgtacagtctagaacgtacgttaggaccttaaggttttactacgttacgtaactaagtaacgttggttacggtacgtggtttacggtacccgttaacggtaacccgggttccggacccgttaacgggacctaacgtacggtaggactacgtcggaacggtaccgaacgttcggtacgcttacggaccctacgtagttccgtcgtttcttacccg

SEQ ID NO: 90798 - DNA, 599 bp, Homo sapiens
  misc_feature: GYAE6OF01AO538.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttgcctggtaccaacaaaaacctggccagcctccagactcctcatttatcgttcatccaccagggccactgatcgtacccaaccagacttcagtgcagacgggtctggacagacttcagtctcactatcagcagtctacagtctagaacgacttggactagtttactaacgtcgtacaactaagtgttacgtacagtacgggcccttacggtaaaccggttccggtacccgaacgggtaccctaacgtacggttaggtaacgttaacgtaccggaacgggtaccgtaaacggttcgggtacgggtaccgttacgaccctaacccgtaacgttccgttagttcccgtttaacccg

SEQ ID NO: 90799 - DNA, 528 bp, Homo sapiens
  misc_feature: GYAE6OF01CCJM0.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggancaacttgcctggtaccaaacaaaaacctggccagcctcccagacctcctcatttatcgttcatccaccagggccactgatcgtacccaacagattcagtgcagagggtctgggacagacttcagtctcaccatcagcagcgtacagtctagaagcttggctagtttatactgtacaactaatgtgtcagtcggcctacggtaacgttcggacccgagggaccaacgagtggactagtccgaggtacaacgttggtacggcctcgaccacctatcttgtccttaccg

SEQ ID NO: 90800 - DNA, 535 bp, Homo sapiens
  misc_feature: GYAE6OF01DYGD2.5.57.F02.1.454.CMB.1.raw
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (401)..(401): a, c, t, g, unknown or other
  misc_feature (401)..(401): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagccaccctctcctgcagggccagtcagaacnttggancaacttgcctggtaaccaaacaaaaacctggaccagcctcccagacctcctcatttatcgttcatccaccgagggccactgactcgtaccccaaaccagacttcagtcggcaggagggtctgggacagtacttcagtctacaccatcagcacgcgtacngtctagaagtcttggactagtttatactgtacaactatgtggtcaggtcgccgtacggtaacgttccggacccgagggaccacgagtgactagtacgacggcaacgtgtcggctcgacacctatctgttctacc

SEQ ID NO: 90801 - DNA, 546 bp, Homo sapiens
  misc_feature: GYAE6OF01APGWG.5.57.F02.1.454.CMB.1.raw
  modified_base (359)..(359): a, c, t, g, unknown or other
  misc_feature (359)..(359): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaacctggccagccctcccagacctcctcatttatcgttcactccaccagggccactgatcgtaccccaaccagtattcagtggcaggacgggtcngggacagacttcagtctcaccatcagcagcgtacagtctagaagtacttgggactagtttattactgtacaactatgtgtcaggttcgcctcggaaccgttccggcccgtaagggaccacgtagtcggatacgtcgaggcgtaacgtggtcgggacttcggacctaccagttcttcgttccttaccg

SEQ ID NO: 90802 - DNA, 891 bp, Homo sapiens
  misc_feature: GYAE6OF01BESNE.5.57.F02.1.454.CMB.1.raw
  modified_base (153)..(153): a, c, t, g, unknown or other
  misc_feature (153)..(153): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatccgtgtcgtgtctcctacggagggagagaccgaccctacctcctccgtcgacggacggaccgtacgtacgaacgaacttaggttaggactaacctaacgtacgccgttaacgaaaccaaaaccgtaaaccggcgaccaccgtccctaccgaacgtacccttacctactttaactttaccgttccgttacctacccgtacccgaaccggtaccggaccctacgtacgtacgttaccccgtaaaccccaacgtacgttacgtaccgtagggtaccgaacggtaaggggtacgggttacggtacgggaacgtaaacgtttaccgttaccggtaccgttacccgtaaccccgtaaacgtacgttaccgaacggtaccgtaaccgggttaacccgttaagttaccggtttacgtaaacgggtaacgtttcgggttaacggtaacgtttttaacgttttaaccgttacgttaccgtaaaacttaaagttcggtttcggggtacgttaacggtccggtttacccggtaccccggttaaaccggggtttacccggttcccgggaaacccgggtaacggtaacccgtaagggttacggggttaaaccgtacgttaaccggaacggggtaacccggttaacgggtaacgttcggggtaaaccggtcccttaaaccggaccccttaacgttacccggtttcgttaccccgtttcctaaccccg

SEQ ID NO: 90803 - DNA, 608 bp, Homo sapiens
  misc_feature: GYAE6OF01BGZGT.5.57.F02.1.454.CMB.1.raw
  modified_base (202)..(202): a, c, t, g, unknown or other
  misc_feature (202)..(202): n is a, c, g, or t
  modified_base (219)..(219): a, c, t, g, unknown or other
  misc_feature (219)..(219): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgccaccctctccngcagggccagtcagacattggagcaacttagcctacggtaaccaacaaaaacctggaccacgcctacccagactcctctatttatcgttcactccaccagggccactgactcgtacccaaccgagtacttcgaggtcggacgagggacggtcgtagggacacggtacttcgtacgtcctacaaccatcgacgacacgtcgtacacgtctaggaagtacgttcggtactaagttttacttacgtgttacaactaagttcgtaggtcgtaggtcggtacctacgggtaaccggttccggacccgacgggaccacgtaggtacggtatacgtacgacggtacgacgttcggtacggtcgtacgactacctaagttcgtacgttccgttaccg

SEQ ID NO: 90804 - DNA, 676 bp, Homo sapiens
  misc_feature: GYAE6OF01C6APT.5.57.F02.1.454.CMB.1.raw
  modified_base (244)..(244): a, c, t, g, unknown or other
  misc_feature (244)..(244): n is a, c, g, or t
  modified_base (389)..(389): a, c, t, g, unknown or other
  misc_feature (389)..(389): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgcccaccctctcctgcagggccagtcagaacattggancaacttagcctggtaaccaaacaaaaacctggaccagccctccagacctcctctatttactccgttcactccaccgacgggcccactgactcgtaccccaacacgattcagtcggcaggagggtctgggacagacttcgacgtcncaccatcagcagctacagtctagaacgacgtttggaccttagttttacttacttagtactaaacgtaagttcggtaggttaccgagggttccggtacccgtttaccgggtaaaccggttttccccggggaacccctaacgggggtaacccctaaccggtaacggggttagggtaaactttaccggttaccggaaccgggggtacgtaaaacccggtttgggtaccggggtaccgttaccggtacccgtaaccccgttaagtttcccgttcggtttccctttaacccg

SEQ ID NO: 90805 - DNA, 577 bp, Homo sapiens
  misc_feature: GYAE6OF01BTIS6.5.57.F02.1.454.CMB.1.raw
  modified_base (152)..(152): a, c, t, g, unknown or other
  misc_feature (152)..(152): n is a, c, g, or t
  modified_base (203)..(203): a, c, t, g, unknown or other
  misc_feature (203)..(203): n is a, c, g, or t
  modified_base (252)..(252): a, c, t, g, unknown or other
  misc_feature (252)..(252): n is a, c, g, or t
  modified_base (263)..(263): a, c, t, g, unknown or other
  misc_feature (263)..(263): n is a, c, g, or t
  modified_base (371)..(371): a, c, t, g, unknown or other
  misc_feature (371)..(371): n is a, c, g, or t
  modified_base (431)..(431): a, c, t, g, unknown or other
  misc_feature (431)..(431): n is a, c, g, or t
tcagatcagacacgcacgaccggtgctcgatttagctcgatatagttgggtttgggggagaactgctcagttaggacccagacggaaccatggaagccccagcgcagcttctcttcctcctgctactctggctcccagataccgttgggganatcgtgatgacgcagtctccagccatcctgtctgtgtctccgaaggggganacgacgccctaccctctccgtgccagggcccaaggttccaaggaaaccnttttgggaacncctaaactttgccttaggtaaacccaaacaaaaacctggaccaacgccctccaagcctccctctattttacgtcttcactccgaccgaggtccactgatcgccaaccngacttcagtgctaggagggtctgggacagacttcgagtctacaccagtcagctagctacngtctagaagcttggctagttttactactgtaccaatattgtcggtacagtcggcctacgaaccgttcgaccccgtagggaccctagaagtggataacgtcggaagcggtaactgggagttcgcgaccacgtatccttgtaccttcg

SEQ ID NO: 90806 - DNA, 526 bp, Homo sapiens
  misc_feature: GYAE6OF01D1CFF.5.57.F02.1.454.CMB.1.raw
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (400)..(400): a, c, t, g, unknown or other
  misc_feature (400)..(400): n is a, c, g, or t
  modified_base (507)..(507): a, c, t, g, unknown or other
  misc_feature (507)..(507): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagagcccaccctntcctgcagggccagtcagaacattggtagcaacttagcctaggtaaccaaacaaaaacctggccagcctccagactcctctatttatcgttcatccaccgagggccactgactcgtacccaaccagacttcgagtggcaggagggtctgggacagtacttcagtctacaccatcagcagctacngtctagaagacttggactagtttatacgtgtacaatatgtggtcaggtcgcctacggtacgttccgccgagggaccagagtggatacgcgacggacaacgtggtgcngccacgattctgtcttacg

SEQ ID NO: 90807 - DNA, 533 bp, Homo sapiens
  misc_feature: GYAE6OF01AR1EU.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaactattggagcaacttgcctggtaccaacaaaaacctggccagcctcccagactcctcatttatcgttcatccaccagggccactgatcgtcccaaccagacttcagtcgcagagggtctgggacagacttcacgtctcgaccatcagccagcgtacagtctgaagacttgactacgtttatactgtacaactagtgtcgtcgagtcgtaccgtcgtaacgttcggcccaggaccacgagtggatagtacacggtacgacgtaggtcggacgtcggtaccacgtatccgtgtccgttaccg

SEQ ID NO: 90808 - DNA, 518 bp, Homo sapiens
  misc_feature: GYAE6OF01CDRGR.5.57.F02.1.454.CMB.1.raw
  modified_base (200)..(200): a, c, t, g, unknown or other
  misc_feature (200)..(200): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggnagagccaccctctcctgcagggccagtcagaacattggtagcaacttagcctggtaccaacaaaaacctggccagcctcccagactcctcatttatcgttcactccaccagggccactgatcgtcccaaccagacttcagtggcaggagggtctgggacagacttcagtctcacatcagcagcgtacagtctagaagcttggctagtttattactgtacaactatgtgtcagtgcctacggtaacgttcggacccagggaccacgaggtggatacgtcgaggactaagtcggtggctgaccaccagttctgtccttcg

SEQ ID NO: 90809 - DNA, 513 bp, Homo sapiens
  misc_feature: GYAE6OF01BJBIH.5.57.F02.1.454.CMB.1.raw
  modified_base (213)..(213): a, c, t, g, unknown or other
  misc_feature (213)..(213): n is a, c, g, or t
  modified_base (242)..(242): a, c, t, g, unknown or other
  misc_feature (242)..(242): n is a, c, g, or t
  modified_base (373)..(373): a, c, t, g, unknown or other
  misc_feature (373)..(373): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctntcctgcagggccagtcagaacattggtancaacttgcctggtaccaacaaaaacctggccagcctcccagacctcctcatttatcgttcatccaccagggccactgatcgtcccaaccagattcagtggcagagggtctgggacagacttcagtctcacntcagcagcgtacagtcagaagcttggactagtttatactgtacaactaatgtgtcagtggcctcgaaccgttcggcccagggaccacaggtggatacgtcgagggcaacgtgtaggctcggacaccatcctgttcttacg

SEQ ID NO: 90810 - DNA, 833 bp, Homo sapiens
  misc_feature: GYAE6OF01C9R0L.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgtccaccctctcctgcgagggcccagtccaagaactagttcggtagctaaacgtttacgaccgttcggtaaaccaaaccaaaaaaccgttcggacccaacgccctacccaagtacctcctactaattttacgtcgtttaccacgttacccaacccgacgggtccctaacgtacgaacgttccggtaacccccaaaccgtaacggtacttccgtaaggttcggaccgaagggtaacggggtcgttacggggaactacggtaacctttaccgaacggttcctaaccgtaaccctaagttaccgaacgacccgtaacggtacccggttaaaccgaacggtttaccgtaagggtaaaaccgttaccggtttacgggttaaccggttaacgttttttaacgtttaaccgtttacgtaaaccgtaaagttaacgttcgggtttacggtaccgttaacgggttaccgggtacccggtttaaccgggtaacccggtttacccgggaccccggtaacggggtaccctaaaccggtagggtttacggaaccgttaacgtaccggaacggggtaaccgttaacggtggtccgggtaccgtcgtacccgaaccgtatttcccgtcgtttccttaacccg

SEQ ID NO: 90811 - DNA, 603 bp, Homo sapiens
  misc_feature: GYAE6OF01DWW87.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (248)..(248): a, c, t, g, unknown or other
  misc_feature (248)..(248): n is a, c, g, or t
  modified_base (561)..(561): a, c, t, g, unknown or other
  misc_feature (561)..(561): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgcccaccctctcctgcagggccagtcaagaactgttggacnctaacttgcctaggtaaccaaacgaaaaacctggaccagccctacccagacctcctactactttactcgttacactcccaccgacgggccacgtgactcgtacccaacctagtacttcaggtcgacaggtagggtactagggacacgtacttcgacgtcacaccatcagtcacgtacgtacagtactagaacgtcgttggacttaagtttatacgtagtacaatgtaggtgtacgaggtcgtaccctacggtaacgttccggaccacgggaccacgtaggtacgacttacgacgtacgggacgtaacgtcggnggtaccttacggacctaaccgtattccgttacgtcttacccg

SEQ ID NO: 90812 - DNA, 512 bp, Homo sapiens
  misc_feature: GYAE6OF01A7ZTJ.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggganagagccaccctctcctgcagggccagtcagaacattggagcaacttagcctggtaccaacaaaaacctggccagcctcccagactcctcatttatcgttcatccaccagggccactgatcgtccccaaccagattcagtggcagagggtctgggacagacttcagtctcaccatcagcagcgtacagtctagaagacgttggctagttttattactgtacaacaatgtggtcagtggcctacgacgttcgcccagggaccacgagtgatagtcgaggcgaacgtggtcggctgaccaccatcctgtcttc

SEQ ID NO: 90813 - DNA, 511 bp, Homo sapiens
  misc_feature: GYAE6OF01BWNIY.5.57.F02.1.454.CMB.1.raw
  modified_base (242)..(242): a, c, t, g, unknown or other
  misc_feature (242)..(242): n is a, c, g, or t
  modified_base (391)..(391): a, c, t, g, unknown or other
  misc_feature (391)..(391): n is a, c, g, or t
  modified_base (433)..(433): a, c, t, g, unknown or other
  misc_feature (433)..(433): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagcccaccctctcctgcagggccagtcagacattggancaacttgcctggtaccaacaaaacctggccagcctccagactcctcatttatcgttcatccaccgagggccactgactcgtaccccaacagattcagtcggcaggacgggtctagggacagacttcagtctcacctatcagcagcgtanagtctgaagtcttggctagtttatactgtacaatagtgtgtnagtgcctcgtacgttcgccaggaccagagtgatacgtcgaggtcgaactggtcgctgaccaccattctgtccttaccg

SEQ ID NO: 90814 - DNA, 649 bp, Homo sapiens
  misc_feature: GYAE6OF01CPK2Y.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagcccatcctgtctgtgtctccgagggganagacgcccacccttctccctgcacgggccagtcagaacattggagctaacttagcctaggtaaccaaacaaaaactcggaccacgccctcccagacctcctctatttactcgttacactccaccagggccatgactcgacccaacagatcagtgcaggaggtctgggacagcttcagtctacacctatcgagacacggtacgtactagtacctaggaaacgtacgttacggtacttaacggtttttaattaaccgttaggttaacctaaacgttaagttggtacggttacaacgggtcggttacccgttaacgggtaaccggtttccgggaaccccaagggggtacccaacgggtaacggtaggtaacgtacgtacggaacgggacgttaaacgttcgggtacgtaccgtacgtacgtaaccctatttaccgttgtcctttacccg

SEQ ID NO: 90815 - DNA, 608 bp, Homo sapiens
  misc_feature: GYAE6OF01ASEGD.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgccagggccagtcagaacagttggancaacttgcctaggtaccaacaaaacctggccagcctacccagacctcctcatttactcgttcactccaccaggccactgactcgtaccccaacagtacttcaggtcggacaaggtacgggtctaggggacagtacttacgagtctcgaccatccagaccagaccgtacaggtcctagaaacgtcgttaggaccttagttttacttactgtacaactaagttggtagtactaggtcggtccgttacggtaaccggttccggacccgaacgggaccaccgtaggttcgaacttacgacgacgggtaccaacggttcgggtcgcttacggaccctaccgtaagtccgttacgttccgtttaacccg

SEQ ID NO: 90816 - DNA, 695 bp, Homo sapiens
  misc_feature: GYAE6OF01DZ5NH.5.57.F02.1.454.CMB.1.raw
  modified_base (417)..(417): a, c, t, g, unknown or other
  misc_feature (417)..(417): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagatcgtgatgacgcagtctcagccatcctgtctgtgtctccgaggggagagagcccaccctctcctgcagggcccagtcaagaactagttggtacgactaacgttacgccgttacggtaacccaaaacctaaaaaacccgtggacccaacgccctacccgagtacctcctactatttactccgttacactccaccgacggccactcgatcgtacccaacagtacttcgagtggacaggagggtcgtgggacagtacttcagttccncaaccatacacgcacggccgttaacagttacgtaggaagtacttggaccttaagtttaacttaccgttagtaccaaacgtaagttcggttacggtcgtaaggttcggtacccgttaacggtaccggtttccgggacccccgaagggggtaacccctaacggtaacgggttcgggtaaacttacggtaccgtaaacggggtacccgtaaacgggttcggtacgggtacccgtacggtaccctaacccgttaacgtttccgttcgtttcccgtttaaccg

SEQ ID NO: 90817 - DNA, 618 bp, Homo sapiens
  misc_feature: GYAE6OF01D83PF.5.57.F02.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctctcctgcagggccagtcagaacnttggtagcaacttagcctggtaaccaaacaaaaacctggccagcctcccagacctcctctatttatcgttcactccaccgagggccactgatcgtacccaacagattcagtggcaggaggtctgggacagacttcagtctcaccatcagcagtcgtaacagtctagaacgtacgtttggaccttaagttttacttacgtgtacctaactaagttgtcggtactagggttcggcccttacgggtaaccggtttcccgggacccgtaacggggtaccctaacggaggttacgggacttaacgtaccggaacgggtaccgtaacggttcgggtcgggtacctacggtccctaaaccgtacgtttccgttcggtttccttacccg

SEQ ID NO: 90818 - DNA, 705 bp, Homo sapiens
  misc_feature: GYAE6OF01CI8YI.5.57.F02.1.454.CMB.1.raw
  modified_base (152)..(152): a, c, t, g, unknown or other
  misc_feature (152)..(152): n is a, c, g, or t
  modified_base (201)..(201): a, c, t, g, unknown or other
  misc_feature (201)..(201): n is a, c, g, or t
  modified_base (247)..(247): a, c, t, g, unknown or other
  misc_feature (247)..(247): n is a, c, g, or t
tcagatcagacacgcacgaccggtgctcgatttagctcgatatagttggggttgggggaggaactgctcagttaggacccagacggaaccatggaagcccagcgcagcttctcttcctcctgctactctggctcccagataccgttgggganatcgtgatgacgcagtctccagccatcctgtctgtgtctccgagggganagacgccacctctcctgcgacgggccagtcaagaactagttggganctaacgttagcctaggtaaccaaacaaaaccgtggaccagcctaccagtacctcctactactttactccgttacactaccgaaccgacgggtacctacgtgactacggtaccccaacagtacttacgacggttggaccgtaggtacgggtcgtacggggaactacggtactttcgaagttccgtacaacctacgtccgaagtccgaacggtaccgtaacgtacgttccgtaaaggtaaacgtacgttagggtactaaggtttttaactacgtacgtactaaactagttacgtacgggtactaggtccgtaccgttaccggtaaccggtttaccggaccggtaacggggtaccacggttaagggtacgtaacgtaacgtacggtaacggggacttaaaccgggtggttaacgggcccgttagcccgtaaaccgtagttcccgtttggtccctttaaccg

SEQ ID NO: 90819 - DNA, 580 bp, Homo sapiens
  misc_feature: GYAE6OF01BTUPQ.5.57.F02.1.454.CMB.1.raw
  modified_base (202)..(202): a, c, t, g, unknown or other
  misc_feature (202)..(202): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagccaccctctcctgcagggccagtcagacattggancaacttgcctggtaaccaacaaaacctggaccagcctcccagactcctcatttatcgttcactccaccgagggccactgactcgtacccaacctagacttcgagtcggacaggacgggtcgtgggaacagtaccttcagtcctacgaaccatcagcagaccgtacagtctagaacgtacttggacttagtttattacgtgtacaatatgtaggtcaggtcgccgtacggtaaccgttccggacccgtacgggacccacgtagtggaactacgtacgacgggtacgtaacggttgggtacggtcgtacggaccctaacctagtcttcggttccttacccg

SEQ ID NO: 90820 - DNA, 508 bp, Homo sapiens
  misc_feature: GYAE6OF01DZRPT.5.57.F02.1.454.CMB.1.raw
  modified_base (349)..(349): a, c, t, g, unknown or other
  misc_feature (349)..(349): n is a, c, g, or t
  modified_base (391)..(391): a, c, t, g, unknown or other
  misc_feature (391)..(391): n is a, c, g, or t
  modified_base (436)..(436): a, c, t, g, unknown or other
  misc_feature (436)..(436): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttgcctggtaaccaaacaaaaacctggaccagcctcccagactcctctatttatcgttcatccaccagggccactgatcgtaccccaacagattcagtgcaggngggtctgggacagacttcgagtctcaccatcagcagctaacngtctagaagtacttgggactagtttatactgtacaactatgtgtnagtgcctacggacgttccgccgaggaccagagtgatatcgaggcgaagtgcggctcgacaccatctgtctac

SEQ ID NO: 90821 - DNA, 719 bp, Homo sapiens
  misc_feature: GYAE6OF01A4F7S.5.57.F02.1.454.CMB.1.raw
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgcccaccctctcctgcagggccagtcagacngttggancaacttgcctaggtaaccaaacaaaaccgtggaccacgcctacccagacctcctctactttactcgttcactcccaccgacgggccactgactcgtaccccaacagtacttccgaggtcggacgaagggtacgggtcgtaggggaacctaggtacttcgacgttcctacgaaccctagtccgaacgcgtaacggtaccgtaacgacgttaccgtaggaaacgttaccgttacgggtacctttaaggtttttaacttaccgtacgtaacctaaacgttaagttcggttacgggttacgtacggttccgggtaccccgttacgggtaacccgggtttcccgggaccccgtaacgggggtaccctaacgggtacggtacgggtaaacttacggtaccggaacgggtaccggtaaaccggttgggttacgggaccgttacggaccctaaccgtagtttccgttcggtttcccttaccg

SEQ ID NO: 90822 - DNA, 557 bp, Homo sapiens
  misc_feature: GYAE6OF01DQXXM.5.57.F02.1.454.CMB.1.raw
  modified_base (203)..(203): a, c, t, g, unknown or other
  misc_feature (203)..(203): n is a, c, g, or t
  modified_base (243)..(243): a, c, t, g, unknown or other
  misc_feature (243)..(243): n is a, c, g, or t
  modified_base (397)..(397): a, c, t, g, unknown or other
  misc_feature (397)..(397): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgcccacctctcctgcagggccagtcagacattggancaacttagcctaggtaaccaacaaaacctggaccagcctcccagactcctctatttactcgttcactccaccagggccactcgatcgtacccaacagacttcagtggacaggagggtctagggacagtactcagtctcacatcagcagcgtacngtactagaagacttggacttagtttattacgtgtactaactagttcgtggtacgaggttcggacccttacggtaaccggttccggacccgaagggaccacgaggtggatacgtacgacggacgtaacgtggtacgctcggacaccgtatcctgtcttacg

SEQ ID NO: 90823 - DNA, 552 bp, Homo sapiens
  misc_feature: GYAE6OF01B80EU.5.57.F02.1.454.CMB.1.raw
  modified_base (243)..(243): a, c, t, g, unknown or other
  misc_feature (243)..(243): n is a, c, g, or t
  modified_base (374)..(374): a, c, t, g, unknown or other
  misc_feature (374)..(374): n is a, c, g, or t
  modified_base (397)..(397): a, c, t, g, unknown or other
  misc_feature (397)..(397): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggtancaacttagcctggtaccaaacaaaaacctggaccagcctcccagacctcctacatttactcgttcactccaccagggccactgatcgtaccccaacagtactcagtggcagagggtctagggacagacttnacgtctcaccatcagcagcgtanagtctagaacgtacttggactagtttattactagtacaactaattgtgtactagtcggtacctacggtaacgttccggacccgagggaccacgtaggtgatacgtacgaggacgaacggtggacggtcctacgctacctagttcctgtcttaccg

SEQ ID NO: 90824 - DNA, 533 bp, Homo sapiens
  misc_feature: GYAE6OF01BSC1P.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctctcctgcagggccagtcagaacattggancaacttgcctggtaccaacaaaaacctggccagcctcccagactcctcatttatcgttcactccaccaggccactgatcgtcccaaccagattcagtcggcagagggtctgggacagacttcagtctcaccatcagcagcgtacagtctagaagcgttgctagtttatactgtacaactaatgtagtcagtgcctacggtaacgttccggcccgaagggacccacgtaggtgtatacgtacgaggtacgaacgtggtacggccttcggacctacattccgtgttccttaccg

SEQ ID NO: 90825 - DNA, 509 bp, Homo sapiens
  misc_feature: GYAE6OF01CL81G.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggagcaacttagcctaggtaaccaaacaaaaacctggccagcctcccagactcctcatttatcgttcatccaccaggccactgactcgtaccccaacagattcagtggcagagggtctgggacagacttcagtctcaccatcagcagcgtacagtctagaacgtacttggctagtttattactgtacaactatgtgtcagtcgcctacgacgttcgcccagggaccagagtggatagtcgaggacaactggtagctgacacatctgtcttc

SEQ ID NO: 90826 - DNA, 726 bp, Homo sapiens
  misc_feature: GYAE6OF01CDSIW.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctggcgagggccagtccaagaactagtttgggaacactaaacgttagcccgttaggtaacccaaaacgaaaaaccctggaccaacgccctacccgaagtacctcctactaattttacgtccgttaccactcccaaccgacgggccctactgtactccgtaccccaaaccgagtacttacgaggtcggacgaggtacgggtcgtaggactagtacgttcgagtcctacgaaccatacgacgcgtacggtaccgtaacctaggttaccgtaaggtaaacgttacgtttacgggaactttaaggtttttaacttacgtacgtaactaaacgtaagttcggtacggtacggtagttaccgggtacccgttaacggtaacccggtttcccgggaacccgtaaccgggggaaccctaacggtagggttaaccgggaacttaacggtaccggtagggtacccgaagttcgggtcggaccttacggacccaaccgttagttcctagttccgttacc

SEQ ID NO: 90827 - DNA, 579 bp, Homo sapiens
  misc_feature: GYAE6OF01BMNJM.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgcagggccagtcagaacnttggagcaacttgcctggtaccaacaaaaacctggccacgcctcccagactcctcatttatcgttcactccaccaggccactgactgtcccaacagattcagtgcagaggtctgggacagactcagtctcacatcagcagcgtacagtctagaacgtacgttgacttagtttaacttactgtacaactaagttgtacggtacagtcggcctacggtaaccggttccggacccgtacgggacccacgtacgtaggtactaagtccggaacgggtacccgtaaacggttcggtacgggtccgtaggaccctaaccgtacgttccgttaggtttcccttaacccg

SEQ ID NO: 90828 - DNA, 509 bp, Homo sapiens
  misc_feature: GYAE6OF01BO3CE.5.57.F02.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctntcctgcagggccagtcagaacattggtancaacttagcctggtaccaacaaaaacctggccagcctcccagactcctcatttatcgttcatccaccagggccactgatcgtcccaaccagattcagtggcagagggtctgggacagacttcagtctcaccatcagcagcgtacagtctagaagtcttggctagtttattactgtacaactatgtgtcagtcgcctacgtaacgttcggacccgagggacccagagtggatagtcgaggcgaactggcgctgcaccatctgtcttcg

SEQ ID NO: 90829 - DNA, 524 bp, Homo sapiens
  misc_feature: GYAE6OF01EVZSB.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagacgcccaccctctcctgcagggccagtcagacattggancaacttgcctggtaccaacaaaaacctggaccagcctcccagactcctcatttatcgttcatccaccagggccactgatcgtcccaacagattcagtgcagagggtctgggacagactcagtctcacatcagcagcgtacagtctagaagacttggacctagtttacttacgtgtacaactaagtgtggtacaggtggaccctacggtaaccgttccggacccgtagggaccacgagtggatatcgaggcaacgtgtaggctcgacaccatcctgtcttacg

SEQ ID NO: 90830 - DNA, 500 bp, Homo sapiens
  misc_feature: GYAE6OF01BZMOO.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagatacctttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaattgtgtcagtggcctcgaacgttcggccagggaccacagtgatatcgaggcgaactggtgctggcaccatctgtcttacg

SEQ ID NO: 90831 - DNA, 669 bp, Homo sapiens
  misc_feature: GYAE6OF01AWHKW.5.57.F02.1.454.CMB.1.raw
  modified_base (151)..(151): a, c, t, g, unknown or other
  misc_feature (151)..(151): n is a, c, g, or t
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
tcagatcagacacgcacgaccggtgctcgatttagctcgatatagttgggtttggggagaactgctcagttaggacccagacggaaccatggaagccccagcgcagcttctcttcctcctgctactctggctcccagataccgttgggganatcgtgatgacgcagtctccagccatcctgtctgtgtctccgagggganagacgccaccctntcctgcaggccagtcagacnttggtancaattgcctggtaccaacaaaacctggccagcctccagacctctcatttatcgttcatccacgacggacctacgtcgattcggtacccaacgtagtacttcaggtcggacacgggtggtacctaggggacctaggtacctttcgacgttcctaccgaaccgtagttacacggtaccaacggtaccgttaaccgagttaccgtaggaaacttacggttaggtacctaggttttaacttaccgtacgtaccaacttaacgtggttacggtactaggttacgtacccgttacggtaaccggttaccggacccgtaggggtaccctaggtacggtacggtaacgttacgaccggtacgggtaccgtaacggttgggtaccggtaccgttacggacccgttaccgtagtttcccgtcggttacccgtttacccg

SEQ ID NO: 90832 - DNA, 609 bp, Homo sapiens
  misc_feature: GYAE6OF01DZECQ.5.57.F02.1.454.CMB.1.raw
  modified_base (200)..(200): a, c, t, g, unknown or other
  misc_feature (200)..(200): n is a, c, g, or t
  modified_base (239)..(239): a, c, t, g, unknown or other
  misc_feature (239)..(239): n is a, c, g, or t
  modified_base (290)..(290): a, c, t, g, unknown or other
  misc_feature (290)..(290): n is a, c, g, or t
  modified_base (448)..(448): a, c, t, g, unknown or other
  misc_feature (448)..(448): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggnagagccaccctctcctgcaggccagtcagaacattggancaacttgcctaggtaaccaaacaaaaacctggaccagcctccagactcctnatttatcgttcatccacgaggccactgactcgtaccccaaaccgtagtacttacaaggttggaccaggtagggtccgtaggggacaaggtacctttcgaagttcctacgacctagtcagcaggctacagtctagaatcgtggactagtttactacgtntacgaataagtgtgtactacgtggtccgtagtaaccgtttcgggaccctaacggggtacccaacggtagtacggtagtaaccgtacggtaacgggaccgtaacggttcggtacgggaccgttagacccgtacctaatttcccgttagttcccgtttaaccc

SEQ ID NO: 90833 - DNA, 627 bp, Homo sapiens
  misc_feature: GYAE6OF01DAMD5.5.57.F02.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
  modified_base (486)..(486): a, c, t, g, unknown or other
  misc_feature (486)..(486): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccacctctcctgcgagggccagtcagaactattgggancaaacttagcctaggtaacccaaaacaaaaaaccgtggaccaacgccctacccaagacctcctactaattttaactcgtttcaacttcccaaccgacgggcccaacgtgaacttccgtaccccaaaccagtacttacgaaggtggacaaggacggggttcgaggggaacacggaacttcagtctacaccatcagcacgactacagtctagaagtacttggactagtttatactagtacaanaattggtacgctaggtcgaccgtacggtaaacggttcccggacccgaacgggaccaaccgtaggtacgggtactaatcggacgggtagaaaccttgggtggaccgttaggacctaacccaagttccttaggtcctttaacg

SEQ ID NO: 90834 - DNA, 523 bp, Homo sapiens
  misc_feature: GYAE6OF01C96KD.5.57.F02.1.454.CMB.1.raw
  modified_base (202)..(202): a, c, t, g, unknown or other
  misc_feature (202)..(202): n is a, c, g, or t
  modified_base (306)..(306): a, c, t, g, unknown or other
  misc_feature (306)..(306): n is a, c, g, or t
  modified_base (380)..(380): a, c, t, g, unknown or other
  misc_feature (380)..(380): n is a, c, g, or t
  modified_base (501)..(501): a, c, t, g, unknown or other
  misc_feature (501)..(501): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagccaccctctcctgcagggccagtcagaacattggagcaaacttgcctaggtaaccaaacaaaaaacctggaccaagccctacccagacctcctcatttancgttcatcccaccacggccactgatcgtaccccaaaccagacttcagtggcaggagggtctagggacagacttnagtctacaccatcagcagcgtacagtctagaaagcttggactagttttatactgtacaaactatgtgtcagtcgacctcgaacgttccgccgaggaccacagtgatatcgaggacgactgnggctgacaccatcttgtcttac

SEQ ID NO: 90835 - DNA, 569 bp, Homo sapiens
  misc_feature: GYAE6OF01D185J.5.57.F02.1.454.CMB.1.raw
  modified_base (201)..(201): a, c, t, g, unknown or other
  misc_feature (201)..(201): n is a, c, g, or t
  modified_base (416)..(416): a, c, t, g, unknown or other
  misc_feature (416)..(416): n is a, c, g, or t
tcagatcagacacgcacgaccggtgctcgatttagctcgatatagttgggtttgggggaggaactgctcagttaggacccagacggaaccatgtaagccccagcgcagcttctcttcctcctgctactctggctcccagataccgttggggagatcgtgatgacgcagtctccagccatcctgtctgtgtctccagggganagagcccaccctctcctgcagggccagtcagaacattggtagcaacttagcctaggtaacccaaacaaaaaccctggccaacgccctacccagacctcctactatttactccgttcactcccaccgaggcctactgactcgtaccccaaccagtacttcgagtggcaggtagggtcgtgggacagtacttcagtcctacaccatcagcagctacngtactgaagtacgttggcttagtttattactgtacaactaagtgtggtcaggtcggtacctacggtaaccgttccggacccgtagggaccacgagtaggatatcgacggacgtaacgtggtacggctacgccactattccgtgttccttaccg

SEQ ID NO: 90836 - DNA, 609 bp, Homo sapiens
  misc_feature: GYAE6OF01DPKNK.5.57.F02.1.454.CMB.1.raw
  modified_base (152)..(152): a, c, t, g, unknown or other
  misc_feature (152)..(152): n is a, c, g, or t
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
  modified_base (357)..(357): a, c, t, g, unknown or other
  misc_feature (357)..(357): n is a, c, g, or t
  modified_base (477)..(477): a, c, t, g, unknown or other
  misc_feature (477)..(477): n is a, c, g, or t
  modified_base (590)..(590): a, c, t, g, unknown or other
  misc_feature (590)..(590): n is a, c, g, or t
tcagatcagacacgcacgaccggtgctcgatttagctcgatatagttgggttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggtanagacgccaccctctccgtgcgacgggccagtacagaactnttggtacactaactagcctaggtaaccaaacaaaacctggaccacgcctccagtcctcctatatttactcgttacactaccgacgacgggcctacgtagtactcgtacccaaacngtacttcgaggtcggacgagggtcgggtacgtgggaacagtacttcgacgtcctaccgacactcgagacgtacgcgtactaggttacctagtaacgtcgttaggacttagtttatacgtntactaactgtagtcggtactggccgtaccgtacggtacggttccgaccgtacggaccacggtagtacgtactacgtacggacggacgtacgtcggcgtacctgaccctacgtnttcccgtgttcccttaccg

SEQ ID NO: 90837 - DNA, 694 bp, Homo sapiens
  misc_feature: GYAE6OF01BC6LA.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccacctctcctgcaggccagtccaagacattgganctaacttgcctaggtaaccaaacaaaaccgtggaccacgcctaccagacctcctctatttactcgttacactccaccaggccactcgatacgtacccaacagtacttcgagtcggaccgaggtacgggtcgtagggaacctagtaccttcgagttcctacaccgtatacgagcaacgtcgtaacacgtacgtacgtaaacggtacgttcggtactaggtttttaataccgtacgttacctaaactaagtttacggtcggttacgtaacggttccgggtacccgttaccggttaacccgggtttcccggaaccccggtaacggggtaccccgaaacggtaacggttacggaaacgttacgttaaccggaaccgggtaccggtaaacgtttcgggtacggtaccgttaccggtaccctaaccgtacgttccggttcgttacccgttttacccg

SEQ ID NO: 90838 - DNA, 649 bp, Homo sapiens
  misc_feature: GYAE6OF01CPUQ0.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctggtaccaacaaaaacctggccagcctcccagactcctcatttatcgttcatccaccagggccactgatcgtacccaacagattcagtggcagacgggtctgggacagacttcagtctcacatcagcagcgtacagtcagaacgacttggactagtttaacttactgtaccaactaagtgttcggtctaacggtggtaccccgttaccggtaaaccggtttcccgggaccccgtaacggggggtacccctaacgtaacggggttacgggtaacgttacgttaccggaaacggggtacccgttaaaaacccggttgggttaccggggtacccgtttaacgggtcccgtaaaaccccccgttaggttttaaccccgttgggtttacccctttttaacccg

SEQ ID NO: 90839 - DNA, 537 bp, Homo sapiens
  misc_feature: GYAE6OF01BA504.5.57.F02.1.454.CMB.1.raw
  modified_base (153)..(153): a, c, t, g, unknown or other
  misc_feature (153)..(153): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagagcccaccctctcctgcagggccagtcagaacagttggagctaaacttagcctaggtaacccaaacaaaaacctggaccagcctcccagacctcctctatttactcgttcatccacgaggccactgatcgtacccaaccagtattcgagtcggacaggagggtctgggacagtacttcacgtctacacatcagcagcgtacagtctagaagcttggcttaagtttatactgtacaataagtgtagtcagtcgctacggtacgttcggccagggaccacgtagtgatacgtcgacggtacgactcggtgacgtgaccactatcgtgtcttaccg

SEQ ID NO: 90840 - DNA, 628 bp, Homo sapiens
  misc_feature: GYAE6OF01E0NQ5.5.57.F02.1.454.CMB.1.raw
  modified_base (155)..(155): a, c, t, g, unknown or other
  misc_feature (155)..(155): n is a, c, g, or t
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
  modified_base (381)..(381): a, c, t, g, unknown or other
  misc_feature (381)..(381): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgcccaccctctcctgcagggccagtcagaacattgganctaacttacgcctaggtaaccaaacaaaaaccgtggaccacgcctacccagacctcctactatttactcgttcactcccaccgacgggccactgactcgtaccccaacagacttcagtcggacaggacgggtcgnggacacgtactcagtctacaccatacagacagtccgtactgtctagaacgtacgttggtactagtttactacgtgtactaactaagtcggtaggtctaggtcggtacccttacggtaaccggtttcccggaccgtaacggggaccaacgtaggtacggtaactacgtcggtaacgggtaccgtaaacggttcgggtacggaccgttacggacccgtaccgtaacgtttccgttacgttctttacccg

SEQ ID NO: 90841 - DNA, 528 bp, Homo sapiens
  misc_feature: GYAE6OF01AL7X2.5.57.F02.1.454.CMB.1.raw
  modified_base (202)..(202): a, c, t, g, unknown or other
  misc_feature (202)..(202): n is a, c, g, or t
  modified_base (492)..(492): a, c, t, g, unknown or other
  misc_feature (492)..(492): n is a, c, g, or t
tcagatcagacacgcacgaccggtgctcgatttagctcgatatagttgggtttgggggaggaactgctcagttaggacccagacggaaccatggaagccccggcgcagcttctcttcctcctgctactctggctcccagataccgttggggagatcgtgatgacgcagtctccagccatcctgtctgtgtctccaggggganagagccaccctctcctgcagggccagtcagaacattggtagcaacttagcctggtaaccaacaaaaacctggaccagcctcccagactcctcatttatcgttcatccaccaggccactgactcgtacccaacagattcagtggcaggaggtctgggacagacttcagtctcaccatcagcagcgtacagtctagaagtacttggactaggtttacttacgtgtacaactaagttgtaggtccaggtcggaccctacggaacgttcggacccgaggaccagagtggatacncgaggcaagtggcgctcgcaccatcgtcgtcttgac

SEQ ID NO: 90842 - DNA, 895 bp, Homo sapiens
  misc_feature: GYAE6OF01BPD9V.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgccaccctctcctgcgagggccagtcaagactagttggtagcaacttagcctacggtaaccaaacaaaaaccgtggacccaacgtccctacccgaagtacctcctactatttactccgttacactcccaccgacggcctacgtcgactccgtaccccaaaccagtactcgaaggtcggactaagggtacggggtctaggggaacctacggtaccttacgacgttacccttacgaaccctagttaccgacgtaccgacggtaccggttaacacggttacgtaacggaaacgttcgtttaacggggaacctttaacggtttttaaacgtttaacccgttaggttaaaccgttaaacgtaaacgggtttacgggttaacgggtttacccgtaacgggggtttacccgggttaaccccggtttaacccggggttaaaccccggggttttacccccggggaaaccccgggtaaaccccgggggttaaccccggtaaacccgggttaaaggggtttaaccggggtaaaccgtttaaaacccgggtttacccgggaaaccggggggttaaaccccggttaaaacccgggttacgggggtttacgggggtaccccttaaacccggggttacccctaaaccccggggtttacccttttaacccggttttccgggtttaaccccccttttttaacccgg

SEQ ID NO: 90843 - DNA, 532 bp, Homo sapiens
  misc_feature: GYAE6OF01ASKM7.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggtagcaacttagcctggtaccaaacaaaaacctggccagcctcccagactcctcatttatcgttcatccaccagggcccacgtgactcgtccccaaccagattccagtggcaggagggtctaggggacagacttcgagtctacaccatcacgcagcgtacagtctgaacgacgttggactagtttattactgtacaacgattgtacggtcagtcgcctcggtaaccgtcggacccagggaccacgagtgatacgtcgacggtcgaacgtgtcgctcgaccacatctgtcttcc

SEQ ID NO: 90844 - DNA, 665 bp, Homo sapiens
  misc_feature: GYAE6OF01B5P75.5.57.F02.1.454.CMB.1.raw
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgcccaccctctcctgcagggccagtcagacattggancaacttagcctggtaaccaaacaaaaacctggaccacgccctaccagacctcctctatttactcgttcactccaccgacggccactgactcgtaccccaaaccagtacttcgaaggtcggacgaggtacgggtcgtaggggacacggtacttacgacgttcctacaacctatcgacgtaccgacggtaccgttaacgacgtcgtaaggaaacggtacgtttcgggaactttaaggttttacttaacgtacggttaacaaacgttaagttggttaccggtacgtacggttcgggtacccttaccggtaaccggttccgggaccccgaagggaccctaagtacggtaggtaaatacgtacggacggtacgaacgttcgggtacggtccgtacgtcccgaaccttagttccgttgttccttaccg

SEQ ID NO: 90845 - DNA, 510 bp, Homo sapiens
  misc_feature: GYAE6OF01DRAD5.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (479)..(479): a, c, t, g, unknown or other
  misc_feature (479)..(479): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtancaacttagcctggtaaccaacaaaaacctggccagcctcccagactcctctatttatccgttcactccaccagggccactgatcgtacccaaccagattcagtcgcaggagggtctgggacagacttcagtctcaccatcagcagcgtaacagtctagaagacgttgactagtttattactgtcaacattgtgtcagtcggcctacggacgttcggacccagggccacgagtgatancgaggcgaactgcggctggcacatctgtctc

SEQ ID NO: 90846 - DNA, 559 bp, Homo sapiens
  misc_feature: GYAE6OF01BEW1H.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggaccagcctcccagactcctcatttatcgttcactccaccgagggcctactgactcgtaccccaacagacttcgagtggacagagggtctgggacagtactcagtctcacatcagcagcgtacagtctagaagtcttgacggtatttatactgtacaactatgtaggtctaggtcggtccgtacgtaacgttccggacccgaacgggaccctaacgagtcggaagttacgtaccgagggtaccgaacgttggtcggactcggacacccgtatccgttgttcccttacg

SEQ ID NO: 90847 - DNA, 760 bp, Homo sapiens
  misc_feature: GYAE6OF01ELF43.5.57.F02.1.454.CMB.1.raw
  modified_base (153)..(153): a, c, t, g, unknown or other
  misc_feature (153)..(153): n is a, c, g, or t
  modified_base (221)..(221): a, c, t, g, unknown or other
  misc_feature (221)..(221): n is a, c, g, or t
  modified_base (248)..(248): a, c, t, g, unknown or other
  misc_feature (248)..(248): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagacgcccaccctctccgngcgacggccagtcaagaactgttgganactaacgttcgccgtacggtaaccaaaccaaaaaccgtggaccacgccctacccacgacctcctactatttactcgttcactcccaccgacggcctactcgtactccgtaccccaacgtagtacttcgagtcggacgtaagggtacggtcgtacgggacaagtacttcgacgtctaccactactcgacgtcacgtaccttaacgagttcgtaggtaaacgtacgtttggacctttagttttaaccttaacgtacgtaaactaaccgtaagttcggttacggtaccgttagggttaccggttaccccgttaaccgggttaacccggtttaccccgggtaaccccggtaaacggggtaacccctaacggttaacgggtaggtttaaaccgtacgttaaccggggaacgggtaacccggttaaacgggttcgggttaacccggggtaccgttaccgggtaaaccccctaaccgttttaagttaccccggtttcgtttaacccgttttaaccccgg

SEQ ID NO: 90848 - DNA, 508 bp, Homo sapiens
  misc_feature: GYAE6OF01DRYJC.5.57.F02.1.454.CMB.1.raw
  modified_base (202)..(202): a, c, t, g, unknown or other
  misc_feature (202)..(202): n is a, c, g, or t
  modified_base (426)..(426): a, c, t, g, unknown or other
  misc_feature (426)..(426): n is a, c, g, or t
  modified_base (475)..(475): a, c, t, g, unknown or other
  misc_feature (475)..(475): n is a, c, g, or t
  modified_base (488)..(488): a, c, t, g, unknown or other
  misc_feature (488)..(488): n is a, c, g, or t
  modified_base (499)..(499): a, c, t, g, unknown or other
  misc_feature (499)..(499): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctctcctgcagggccagtcagaacattggagcaacttagcctggtaccaaacaaaaacctggccagcctccagacctcctcatttatcgttcactccaccgacgggccactgactcgtccccaaccagacttcagtgcagtagggtctgggacagacttcagtctcacatcagcagcgtacagtctagaacgtacttggactagtttattactntacaactaatgtgtcagtgcctcgacgttcggccaggccagagtgatancgaggacgactgngctcgacactntctgtcttc

SEQ ID NO: 90849 - DNA, 828 bp, Homo sapiens
  misc_feature: GYAE6OF01EMA7A.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgcccaccctctcctgcagggccagtcagaactnttggtancaacttagcctaggtaaccaacaaaacctggccagcctccagacctcctctatttatcgttcatcccacgacggaccacgtcgatccgtaccccaaaccagtacttaccgaggtcggccgaaggtacggggtcgtacggggaactacggtaccgtttctaacggttccttaccgaacctagttaccgaacggtaccgtaacggtacccggttaactacggtttcgttaacggtaaacggttaaccgttttgggaaaccctttaagggttttttaacttaaccggtttcgtttaaaccctaaacgttaaacgttttacgggttacgggtttaaccgtaacggggttacccggtaccccgtttaaccggggttaaacccgggttttaccccggggaaccccccggtaaaggggggtaaacccccttaaccggtaacgggttaaccggggtaacttaaccggtttaacccgggaaacggggttacccggttaaaaccgggttcggggtttaccgggtaccgtttaccgggaaccccgttaacccgtacgttttacccgtttccggtttaccccgttttaacccg

SEQ ID NO: 90850 - DNA, 514 bp, Homo sapiens
  misc_feature: GYAE6OF01B2I1C.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (468)..(468): a, c, t, g, unknown or other
  misc_feature (468)..(468): n is a, c, g, or t
  modified_base (477)..(477): a, c, t, g, unknown or other
  misc_feature (477)..(477): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctctcctgcagggccagtcagaacattggtagcaacttagcctaggtaccaaacaaaaacctggccagcctcccagacctcctcatttatcgttcatccaccgagggccactgactcgtcccaaccagacttcagtggcaggacgggtctgggacagacttcagtctcaccatcagcagcgtacagtctagaagacttggactagtttattactgtacaactatgtagtcagtcgctcgaacgttcgaccaggacacngtacgatancgaggcgaacgtgcggctgaccactatctgtcttacg

SEQ ID NO: 90851 - DNA, 730 bp, Homo sapiens
  misc_feature: GYAE6OF01DM91H.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcgacgggccagtcagaactgttggtagactaacttcgcctaggtaacccaaacaaaaaccgtggaccacgccctaccacgaccttcctactatttactaccgttcacttacccaaccgagggaccctactacgactccgtaccccaaacgagtacttacgacggtacggcgaaggtacgggtcgtagggacaggtaccttcgtacgtcctaccgaactacgtacgacgccgacgaccgttacacggttcgtaaggaaacgttacgttaggtaacctttaagttttaacgttaaccgtagttaaccgtaaacgtaaggtttacgttaccgggtacgtaacgggttccggtacccgtttaaccggggtaaccggtttccccgggaacccgttaacggggaaccctaacggtacggtacgggtaaccttaggtaccggtacgggacggttaacgttgggaccgggttctacggtacccggaacccttaggttcccttggttaccctttaccg

SEQ ID NO: 90852 - DNA, 691 bp, Homo sapiens
  misc_feature: GYAE6OF01B55F8.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (217)..(217): a, c, t, g, unknown or other
  misc_feature (217)..(217): n is a, c, g, or t
  modified_base (567)..(567): a, c, t, g, unknown or other
  misc_feature (567)..(567): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgcccaccctntccgtgcgaacgggccaaggtacaggaaacctagttgggtaacgactaaacgtttacgacccgttaacgggtaaacccaaaaacgaaaaaaacccgtcgggacccaacggtaccccttaccccaaggaccccttccctacttaacgttttaactccgtttaccactacccgaaccgacgggacctaacgtagacttaccggtaccccaaaccgagtaacttacgaggtcggacagggtacgggtcgtacggggaacacgtacttcgacgtcctacaacctagtaccagtccaaggtaccgttaacacggttactaggaaacgtacgttaggcttaaggtttaactacgtntaacaagtagtggtagtacgtagtccgtcctagggtaaccgttccgacgtacgggactacgaggtgacgtaacgtcgaaggtacgaacgtgtcggacgtcgacactaatcgttcgtcttacccg

SEQ ID NO: 90853 - DNA, 566 bp, Homo sapiens
  misc_feature: GYAE6OF01AJG4D.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggagcaacttagcctggtaccaaacaaaaacctggccagcctcccagacctcctacatttactcgttcactccaccaggccactgactcgtacccaaccagtacttcagtggcaggaggtcgtgggacagacttacagtctcaccatcagcagcgtacagtctagaacgtcttggactagtttactactagtacaatatgtgtcagtcggacctacggtaacgttccggcccgtaggacccaagtaggtaggtactacgtacgacgggacggttaacgtcgggtacggtctaccggaccgtaccctaagtttccgtcgttcctttccg

SEQ ID NO: 90854 - DNA, 651 bp, Homo sapiens
  misc_feature: GYAE6OF01B9638.5.57.F02.1.454.CMB.1.raw
  modified_base (202)..(202): a, c, t, g, unknown or other
  misc_feature (202)..(202): n is a, c, g, or t
  modified_base (250)..(250): a, c, t, g, unknown or other
  misc_feature (250)..(250): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccaccctctcctagcacgggccaggtcaagaacatttggganactaaacttagccttaggtaaccaacaaaaacctggaccacgcctacccagacctcctctatttactcgttcactccaccaggccactgactcgtacccaacagacttcaagtcggacagacgggtcgtagggacagtacttcgacgttctacgaacctatacaagcaacggtcgtaaccgagttaccgtaggaaacgtacgtttacggacttaacgttttaacgttacttacggtaacctaaagtaaacgttgggtacgttaccgtagggtacggtacccgtacggtaaaccggtttccgggaccgtaacggggaccaccgtaggtacgacgtacgtacgacggtaccgtaaacgtcggtacggtacttcgaccgtaccgtagttccgtgttccgttacc

SEQ ID NO: 90855 - DNA, 664 bp, Homo sapiens
  misc_feature: GYAE6OF01B7ZZF.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (246)..(246): a, c, t, g, unknown or other
  misc_feature (246)..(246): n is a, c, g, or t
  modified_base (369)..(369): a, c, t, g, unknown or other
  misc_feature (369)..(369): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgccaccctntcctgcagggccagtccagaacattgggtanctaacttagcctaggtaaccaaacaaaaacctggaccacgcctcccaagacctcctactatttactcgttcactccaccacggccacgtgactcgtcccaaccagtacttcaggtgacaaggnggtcgtagggacaggtactacgagtctacgaccatcacgcaggtactaccgagtacctaggaaacgtacgttagggacttaacggttttaacttaaccgtacggttaacctaaacctaaaggttcggttaacgtacgtaacggttaccggtacccggttaacccggtaaacggtttcccgggaacccgtaacgggtacccgtaacggaggtacggtaaatacgtaccggaacggtaccggaaacgttgggtacgccttaggaccctaccgaattcgttacgttccgtttaacccg

SEQ ID NO: 90856 - DNA, 553 bp, Homo sapiens
  misc_feature: GYAE6OF01DP4L4.5.57.F02.1.454.CMB.1.raw
  modified_base (453)..(453): a, c, t, g, unknown or other
  misc_feature (453)..(453): n is a, c, g, or t
  modified_base (536)..(536): a, c, t, g, unknown or other
  misc_feature (536)..(536): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagacgcccaccctctcctgcagggccagtcagaacagttggagcaacttagcctggtaaccaacaaaaacctggaccagcctacccagactcctctatttatccgttcactcccaccagggccactgactcgtacccaacagacttcagtcggacaggagggtctgggacagtacttgcgtctccacatacgagcgagtctacagtactagagtacgttggcttagtttatactagtacaatactggtcgtnagtcgccgtagtaccggttccggacccgtaggaccacgtacgtggatagtacgacggactaagtggtcggctcgacctaacgntttccgtgttccttccg

SEQ ID NO: 90857 - DNA, 590 bp, Homo sapiens
  misc_feature: GYAE6OF01CZU48.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctctcctgcagggccagtcagacattggagcaacttagcctaggtaaccaaacaaaacctggtacacgcctcccagacctcctctatttactcgttcactcccaaccagggccatgatccgtacccaaccagacttcgagtcggacaggagggtctgggacagtacttcagtctcacatcagcagcgtacagtctagaagtacgttggcttagtttactacgtgtactaactaagtggtaggtctaggtcggacccgttacggaaccggttccgggacccgtacgggaccctaacgaggtacggaattacgtaccggacgggtacgtaacgttgggcggtcctacggaccaacccgtagttccgttcgttctttaccg

SEQ ID NO: 90858 - DNA, 529 bp, Homo sapiens
  misc_feature: GYAE6OF01B1MNN.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctntcctgcagggccagtcagaacattggancaacttgcctggtaccaacaaaaacctggccagcctccagactcctcatttatcgttcatccaccaggccactgatcgtcccaacagattcagtgcagagggtctgggacagacttcagtctcaccatcagcagtcgtacagtctagaagcttggactagtttatactgtacaactaagtgtgtcagtcggcctacgtaacgttccggaccagggaccacgagtaggactagtcgaggtacgaaacgttgtacgggtctggaccctactagttcctagttcttaaccg

SEQ ID NO: 90859 - DNA, 466 bp, Homo sapiens
  misc_feature: GYAE6OF01B00UT.5.57.F02.1.454.CMB.1.raw
  modified_base (453)..(455): a, c, t, g, unknown or other
  misc_feature (453)..(455): n is a, c, g, or t
  modified_base (457)..(466): a, c, t, g, unknown or other
  misc_feature (457)..(466): n is a, c, g, or t
tcagatcagacacgcacgaccggtgctcgatttagctcgatatagttgggtttggggggaagaggaagactgacggtcccccaggagtccagagtgcgtcgcaagtattggcagtgtgaaatttgacaccttatatgcagactctgtgaggggccgcttcaccgtgtccagagacaactccaagaacgccgtctatttgcagatggacagcctgagagtcgacgacacgggcatctattattgtacggcggccgagcaatactctcttactttctggagtcagggagtcccggtcactgtctcctcagcctccaccaagggcccatcggtcttccccctggccaccctcctccaacgacgcaccctctgggggcacgacgcggcccgtggctcgcctggtcaagggactaccgttcccgtgtctgatctgagcgggctggcaggcgcatagcnnngnnnnnnnnnn

SEQ ID NO: 90860 - DNA, 621 bp, Homo sapiens
  misc_feature: GYAE6OF01E18AT.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (242)..(242): a, c, t, g, unknown or other
  misc_feature (242)..(242): n is a, c, g, or t
  modified_base (297)..(297): a, c, t, g, unknown or other
  misc_feature (297)..(297): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccagggggangagccaccctctcctgcagggccagtcagaacattggancaacttgcctggtaaccaaacaaaaacctggccagcctccagactcctcatttancgttcactccacgacgggcccactgactcgtacccaaacagattacagtcggcaggaggggtctaggggactaggtacttcacgtctacacctatcgagtcagccgtacagttctaggaaagtcgttggacttaagttttactacttcgtaacaactagttggtcggtactacggttacggcccttacgggtaaaccggtttccgggaccaaccgggacgggtaacccaacgtaggttacggaatttaacgtccggtaaagggaccgtaaacgttcgggtcgggaccttacgggacccaaccgttacttcgttaggtttacccc

SEQ ID NO: 90861 - DNA, 519 bp, Homo sapiens
  misc_feature: GYAE6OF01B8X9M.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttagcctggtaccaacaaaaacctggccagcctcccagacctcctcatttatcgttcatccaccgagggccactgatcgtcccaacagattcagtggcagagggtctgggacagacttcagtctcaccatcagcagccgtacagtctagaacgtacttggctagtttattacgtgtacaactatgtgtcagtcgacctacgaccgttcggacccgtagggaccacgagtggatagtcgaggcaaacgtgcggctgcactatccgttgtcttccg

SEQ ID NO: 90862 - DNA, 611 bp, Homo sapiens
  misc_feature: GYAE6OF01ERNP2.5.57.F02.1.454.CMB.1.raw
  modified_base (152)..(152): a, c, t, g, unknown or other
  misc_feature (152)..(152): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (240)..(240): a, c, t, g, unknown or other
  misc_feature (240)..(240): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagataccgttgggganatcgtgatgacgcagtctccagccatcctgtctgtgtctccgagggganagagccaccctntcctgcagggccagtcagacattgganctaacttgcctggtaccaacaaaaacctggccagcctcccagacctcctctatttactcgttccatcccacacgggccactgactcgtacccaacagattcagtgcaggagggtctgggacaggtacttacgagtcctacacctataccagcaggtccgtaacgtacgtcgtaggaacgtacgttcggactaggttttactacttaggttaccaaagtaattggtaggtactaggtcggacccgttacggtaaccggttccggtacccgacgggaccaacgtaacgggtacggtaacgtaacgtacggaacggtaccggtaacgtcgggtcggtaccgtacggccctacgtaacttctcggttccttaccg

SEQ ID NO: 90863 - DNA, 775 bp, Homo sapiens
  misc_feature: GYAE6OF01DRVMJ.5.57.F02.1.454.CMB.1.raw
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtcctccgagggganagacgcccacccctctccctgccgacgggcccaggttccagaaacctagtttggtagcctaaacgtttagcccttagggtaacccaaaaccgtaaaaaacccgttcggaccctaacggcccctaccccgaagtaacccttcccctactaattttaacttcgttaccacttcccaaccgacgggcccactgacttcgtaccccaaccagtacttcagtcggacaggtacgggtctaggggaactagtacttcgacgtcctacgaccatcgagcaacggccgtaacacggttcctaggtaaacgtcgtttacggaccttaaggttttaacttaccgtacgttaaccgtaaaccttaaggtttcggttagggttaccgttaagggttcccgggtaacccgtttaccgggtaaaccgggttttcccgggaaccccggtaaacggggtaccctaacggtacgggttacgggtaaacttaaccgtaccgggtaaaccggggtacgttaaccgttaggggtacccgtcgttaccggaccctaacccgttaattcccgtttaaggttccctttaaacccg

SEQ ID NO: 90864 - DNA, 559 bp, Homo sapiens
  misc_feature: GYAE6OF01C35AL.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagccaccctctcctgcagggccagtcagaacattggagcaacttagcctaggtaaccaacaaaaacctggaccagcctcccagacctctctatttatcgttcactccaccagggccactgatcgtacccaacagtacttcagtcgacagagggtctgggacagacttcagtctcaccatcagcagctacagtctagaacgtcgttaggactagtttatactgtacaactaatgtagtctaggtcgtccgtacgtaacgttcggaccctagggacccacgaggtagacttacgacgtaacgggtacgtaaacgtcggtaggtctacgtaccgaaccgtatccgttgtccgttaccg

SEQ ID NO: 90865 - DNA, 680 bp, Homo sapiens
  misc_feature: GYAE6OF01BD8D4.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
  modified_base (646)..(646): a, c, t, g, unknown or other
  misc_feature (646)..(646): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggganagagcccacccgtctcctgccaggggccaggtccaaggtaactagtttgggtaacgctaaaacgtttgcccgttaggtaaaccccaaaacgaaaaacccgttgggacccaacggcccttaccccgaagaacccttccctactaacttttaactccgttaccactacccgacccgacgggaccctaacttcgactaccgtaccccaaaccgtagtacttcaggttcggaccgaaggtacgggtcctaggggaacctacgtacttcaacgtctacaccatcagccagcgtacagtcagaagtacttggacttaagtttatacgtactacgtaaactagtggtcgtacgtaggtccggacccttacgggtaacccggttccggaccggtaacggacctaacgtacggtaggtactaacgtccggacggtacgtaacgtgttccggnttaccggacttacccaagttcgttcgtcgttacg

SEQ ID NO: 90866 - DNA, 511 bp, Homo sapiens
  misc_feature: GYAE6OF01AYU40.5.57.F02.1.454.CMB.1.raw
  modified_base (154)..(154): a, c, t, g, unknown or other
  misc_feature (154)..(154): n is a, c, g, or t
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (299)..(299): a, c, t, g, unknown or other
  misc_feature (299)..(299): n is a, c, g, or t
  modified_base (376)..(376): a, c, t, g, unknown or other
  misc_feature (376)..(376): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctctcctgcagggccagtcagaacnttggtagcaacttagcctggtaccaacaaaaacctggccagcctcccagacctcctcatttancgttcatccaccagggccactgactgtccccaaccagattcagtggcagagggtctgggacagcttcagtctcaccntcagcagcgtacagtctgaagcttggctagtttatactgtctaacagtgtgtcagtggcctcgaacggttcgccacgggaccacgtagtggatagtacgacggtcgaactggtcgctggcaccatctcgtcttac

SEQ ID NO: 90867 - DNA, 500 bp, Homo sapiens
  misc_feature: GYAE6OF01A0LJ5.5.57.F02.1.454.CMB.1.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacnttggagcaacttgcctggtaccaacaaaaacctggccagcctcccagacctcctcatttatcgttcatccaccagggccactgatcgtcccaaccagattcagtggcaggagggtctgggacagacttcagtctcaccatcagcagcgtacagtctagaagacttggctagtttattactgtacaactatgtgtcagtcgcctcgtaacgttccggccagggaccacgaggtgatatcgaggtcagtgtgctgcacatctgtctc

SEQ ID NO: 90868 - DNA, 652 bp, Homo sapiens
  misc_feature: GYAE6OF01EWN35.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgcccaccctctcctgccagggccagtcagaacattggancaacttgcctaggtaaccaacaaaaacctggaccagcctccacgactcctactatttactcgttcactccacgacggccactgactcgtaccaacacgacttcagtggcgagacgggtcgtacggggacaacgtacttcgacgtcctacaccataccagacgacgtaccgtacgtacgttcgtaggaaacgtacgttaggtacttaaggttttaacgttaacgttagttaaccgtaaactaagtttcggtagggtacgtaggtacggtacccgttaccgggtaaccggtttccgggaacccggtacggggtaaccacgtacggtacggtaactacgtacggtaacgggacgtaaacggttcggtcgggacctaggtacccaacgtacttcgtacgttccgttaccg

SEQ ID NO: 90869 - DNA, 605 bp, Homo sapiens
  misc_feature: GYAE6OF01AO6ND.5.57.F02.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgccaccctctcctgcagggccagtcagaacnttggagcaacttagcctggtaccaaacaaaaacctggaccagcctcccagactcctcatttatcgttcatccaccagggccactgatcgtcccaaccagatcagtggcagagggtctagggacagacttcagtctacaccatcagcagcgtacagtctagaagtacttggactagtttactacgtagtacaactaagtcgtagggtactaagggtcggtacccgttacggtaacccggttttccggaccccgtaaggggtaccctacggtaacggttcgggaaattaccgtaccggaacgggtaccgtaaacgttgggttaccggcgttacggaccctaaccgtagttccgttcggttcctttacccg

SEQ ID NO: 90870 - DNA, 607 bp, Homo sapiens
  misc_feature: GYAE6OF01EEAYD.5.57.F02.1.454.CMB.1.raw
  modified_base (314)..(314): a, c, t, g, unknown or other
  misc_feature (314)..(314): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggagatcgtgatgacgcagtctccacgccatcctgtctgtgtctccgaggggagagacgcccaccctctcctgcgagcccaggtccagaacattggtaagtcgaacttagaccctgggtaacccagaaaaaaccctggacccagcctcccagacctctcatttancgttcatccaccaggccactgactgtcccaaccacgaattcagtggcagagggctagggactaggacttcagtctacaccatcagcacgacgtacacgtctagaacgtacgttaggactaagtttacttaacttagtactaacgtaagttcggtaggtcgtaagtacggaccttaccggtaaccggttcggtacccgtacggggtaacccaacgtacggtaggacgtaacgtacgtacgacgaacgtcggtacggtacggtcggtacgacccgtataccgttcgtcgttaccg

SEQ ID NO: 90871 - DNA, 560 bp, Homo sapiens
  misc_feature: GYAE6OF01COD96.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagatcgtgatgacgcagtctccagccatcctgtctgtgtctccgagggganagagcccaccctctcctgcagggccagtcagaacattggancaacttagcctaggtaccaacaaaaacctggaccagcctccagacctcctacatttatcgttcactccaccagggccactgactcgtacccaacagacttcagtggacaggagggtctgggacagacttcagtctacaccatcgagcagcgtacagttcagtaagtacttggacttagtttacttactgtacaactagtagtgtcaggtcgcctacggaacgtttccggacccctaagggacccaagtcggtaggacttacgtacgacgggacgtaacgtggtacggcttacggaccacctatccgttgttccttccg

SEQ ID NO: 90872 - DNA, 556 bp, Homo sapiens
  misc_feature: GYAE6OF01DG82D.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcagggccagtcagaacagttggagctaacttagcctggtaaccaacaaaaacctggaccagcctcccagacctcctctatttactcgttcactccaccgacgggccactgactcgtacccaacagtacttcgagtggcaggacgggtctgggacagacttcagtctcaccatcagcagcgtacagtctagaagtacgttggactagtttatactgtacaactagtgtggtcagtcgacctacggtaacgttccggaccgagggtaccacgtagtaggatagtcgaggacgtaacggtggtcggacgttcgacctacctattcgtcgttcttaccg

SEQ ID NO: 90873 - DNA, 607 bp, Homo sapiens
  misc_feature: GYAE6OF01DWMSL.5.57.F02.1.454.CMB.1.raw
  modified_base (155)..(155): a, c, t, g, unknown or other
  misc_feature (155)..(155): n is a, c, g, or t
  modified_base (204)..(204): a, c, t, g, unknown or other
  misc_feature (204)..(204): n is a, c, g, or t
  modified_base (244)..(244): a, c, t, g, unknown or other
  misc_feature (244)..(244): n is a, c, g, or t
tcagatcagacacgcacgaccggtgctcgatttagctcgatataggttgggtttgggggaggaactgctcagttacggacccagacggaaccatggaagccccagcgcagcttctcttcctcctgctactctggctcccagataccgttgggganatcgtgatgacgcagtctccagccatcctgtctgtgtctccgagggganagagccaccctgtcctgcagggccagtcagacattggtancaacttagcctaggtaaccaaacaaaaaccgtggaccaagcctcccagactcctcatttatcgttcatccaccgaggccaactgatcgtacccaacagacttcagtcggacaggaggtctagggacagcttcagtctacacatacagacaagcgtaacagtctagaagtacttaggaccttagttttaacttacgtagtaccaacgtaagttggtaggttactaggttcggacccttacggtaaccggtttccgggaccctaaggggacccaacgacggttaggacttaagccgtaagggtacgtaacgttggtacgggtctacggtacccgtaacccgtagtttcgttcgttcgtttacccg

SEQ ID NO: 90874 - DNA, 609 bp, Homo sapiens
  misc_feature: GYAE6OF01BNKA4.5.57.F02.1.454.CMB.1.raw
  modified_base (203)..(203): a, c, t, g, unknown or other
  misc_feature (203)..(203): n is a, c, g, or t
  modified_base (420)..(420): a, c, t, g, unknown or other
  misc_feature (420)..(420): n is a, c, g, or t
  modified_base (457)..(457): a, c, t, g, unknown or other
  misc_feature (457)..(457): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgcccaccctctcctgcagggccagtcagacattggagcaacttgcctaggtaaccaaacaaaaacctggaccacgcctaccacgacctcctactatttactccgttacactcccaccgacgggccacgtcgactcgtacccaacagtacttcaggtggacaggtacgggtctagggacagtacttacacgtcctcacactcagcagtccgtanacgtctagaacgtacgttggtactagtttactacgtntaccaatacgtgtcgtacgacggtcggtaccgtacggtaccgttccggacccgtaacgggaccacggtacgtcgggactacggtacgaagggtaccgtaacggttcggacggtacgtacgtaccctacgtacgttcgtacgttcgttacccg

SEQ ID NO: 90875 - DNA, 746 bp, Homo sapiens
  misc_feature: GYAE6OF01CJ7XI.5.57.F02.1.454.CMB.1.raw
  modified_base (155)..(155): a, c, t, g, unknown or other
  misc_feature (155)..(155): n is a, c, g, or t
  modified_base (205)..(205): a, c, t, g, unknown or other
  misc_feature (205)..(205): n is a, c, g, or t
  modified_base (248)..(248): a, c, t, g, unknown or other
  misc_feature (248)..(248): n is a, c, g, or t
tcagatcagacacgcacgaccggtgctcgatttagctcgatataggtttgggtttgggggaggaactgctcagttaggacccagacggaaccatggaagccccagcgcagcttctcttcctcctgctactctggctcccagataccgttgggganatcgtgatgacgcagtctccagccatcctgtctgtcgtctccgagggganaggacgccacctctcctgcagggccagtcaagaacattcgganctaacttaggcctaggtaaccaaacaaaaacctggaccacgcctacccagacctcctctaattttactccgttacacttacccgaaccgacgggaccctaactaggaacttaccggtaccccctaaacgtaaggtactttacgaacggttcggaccgtaaagggtacggggttaccgttaagggggaacctaagggtaaccgtttaccgaacgtttaccaacgtaaccgaacgttaccgaagccaacgggtacgttaacgtagtttaccgttaggaaaacggttcgttacgggactttaacgttttaagttactcgtaactaaaccttaagttcgggtacgtacaagggttccggtaccgttaccgtaacgggttccggaccccgaagggtcccaaacgagggttaccgaattaacgtcgaacgggtacctaagttcgggttacggaccttacgggacccttaacccgttaagtcccgttaagttcccgtttaacccg

SEQ ID NO: 90876 - DNA, 652 bp, Homo sapiens
  misc_feature: GYAE6OF01CDMFS.5.57.F02.1.454.CMB.1.raw
  modified_base (151)..(151): a, c, t, g, unknown or other
  misc_feature (151)..(151): n is a, c, g, or t
  modified_base (200)..(200): a, c, t, g, unknown or other
  misc_feature (200)..(200): n is a, c, g, or t
tcagatcagacacgcacgaccggtgctcgatttagctcgatatagttgggtttgggggaggaactgctcagttaggacccagacggaacatggaagcccagcgcagcttctcttcctcctgctactctggctccagactaccgttgggganatcgtgatgacgcagtctccagccatcctgtctgtgtctccgagggganagacgcccacctctcctgcagggccagtcaagaactagtttggaagactaaacgttacgccgtacggtaaaccaaacaaaaaccgtggaccacgccctacccagtacctctctaactttactccgttacactccaccgacggccactgacttcgacccaacagtacttcgaagtcggacgaggtagggtctaggggacaggtaccttcgacgtcctaccaacctatacgacgcaaggtacgtaactacgttacgtaggaaacgttacgttacgggacttaaggttttactaacttgtaacctaacgttaagtggttacgtacgtaggtccggacgttaaccggtaacggttccgaccggtaagggaccaacgtaggtacgtaagtacgttcggaacgggtacgtaacggtggtacgggactaccggtaccaactcgttctcgttccttaccg

SEQ ID NO: 90877 - DNA, 545 bp, Homo sapiens
  misc_feature: GYAE6OF01CKCPF.5.57.F02.1.454.CMB.1.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacnttggtagcaacttgcctggtaccaacaaaaacctggccagcctcccagactcctcatttatcgttcatccaccagggccactgatgtaccccaacagacttcagtgcagagggtctgggacagcttcagtctcaccatacagcagcgtacagtctagaagacgttggactagtttattactagtacaacagttgtggtcacggtggtccctacggtaaccgttccggacccgaggggaccaacgacgtaggatacgtccgtaggtccgaacgtgtacgggcttcgacctaccattcgtcgttccttaccg

SEQ ID NO: 90878 - DNA, 547 bp, Homo sapiens
  misc_feature: GYAE6OF01C7BNU.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (389)..(389): a, c, t, g, unknown or other
  misc_feature (389)..(389): n is a, c, g, or t
  modified_base (522)..(522): a, c, t, g, unknown or other
  misc_feature (522)..(522): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcagggccagtcagaacnttggancaacttgcctggtaaccaaacaaaaacctggacccagccctcccagacctcctctatttactcgttcactcccaccgacgggccactgactcgtaccccaaccagtacttcagtggcaggagggtctgggacagacttcgagtcncacatcagcagcgtacagtcagaacgcttaggctagtttacttactgtacaactatgtggtcaggtcggccttacgtacgttccggacccgagggaccacgtagtagatagacgacggactaagtggtcgtcncggacaacctgttctggtcttaccg

SEQ ID NO: 90879 - DNA, 561 bp, Homo sapiens
  misc_feature: GYAE6OF01C6W99.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggaccgatcgtgatgacgcagtctccagccatcctgtctgtgtctccagggganagagcccaccctctcctgcagggccagtcagaacagttggtagcaacttgcctggtaaccaaacaaaaacctggccagcctcccagactcctctatttatccgttcactcccaccgaggcccactgatcgtaccccaacagattcagtggcgagagggtcgtgggacaggacttcgagtctacacatcgagcagcgtaacagtcgtagaacgtacgttggacttagtttatacgttgtacaatagtgttcgtacaggtcggtacctcggtaacgttccggacccgtagggaccagtacggtaggactatacggagggtaccgtacgtggtcgccgtgacctaccattcctgttcttacc

SEQ ID NO: 90880 - DNA, 822 bp, Homo sapiens
  misc_feature: GYAE6OF01DMBT7.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (246)..(246): a, c, t, g, unknown or other
  misc_feature (246)..(246): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctcgagggganagacgcccaccctctcctgcacgggccagtcagaactagttgganctaacgttgcctaggtaaccaaacaaaaacctcggaccagccctaccagacctcctactatttactcgttcactccacgacggccactgactcgtaccccaaacgagtactttaccgaggttcggacgtaagggtacggggttcgtacgggggaacctacgtaaccgtttcgacggttaccctaccgaaaccccgtagtaccgaacggtaccaacgggtaccgttaacgtacggttaccgttaaacgggaaacgttaccggtttacgggtaaccgtttaacgttttttaaccgtaaccgttttacggttaaccttaaaacgttaacggtttacgggtttaccggtacgttaacgggtttaccgggtacccccgtttaaccggggtaaacccgggttttccgggaaccccccgggtaaaggggtacccccctaaaggggtaaacggttacggggtaaacctttaaacgggtacccggtaaacggggtaccccggttaaaaggtttccggggtaacgggtacccgttacggtaacccctaacccgtagttttccccgttcggttacccgttttacccg

SEQ ID NO: 90881 - DNA, 646 bp, Homo sapiens
  misc_feature: GYAE6OF01ABSAJ.5.57.F02.1.454.CMB.1.raw
  modified_base (149)..(149): a, c, t, g, unknown or other
  misc_feature (149)..(149): n is a, c, g, or t
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggttggggagaactgctcagttaggacccagacggaaccatggaagccccagcgcagcttctcttcctcctgctactctggctcccagataccgttggganatcgtgatgacgcagtctccagcccatcctgtctgtgtctccagggganagagcccaccctntcctagcagggccagtcagaacattggtancaacttagcctggtaccaacaaaacctggccagcctcccagactcctacatttatcgtttcattcccacctagggcccactgaactcgtaccccaaccacgattccaagttcggccgagtacggggtcctaggggaccaaggactttcgacgtctcacccaattcaacggtcaggaccgttacacgttcttaggaaagtaccttgggacctaagtttacttaaccgtgtacctaactaacgttggttacggtactaaggttcggtacccgtacggtaaccgtttcggaccccgtaagggtacccaaccgtggtacggacttaacgttaccggacggtaccggtaaacgttcggaccgggtacgttacgaccgtaccctaacgttccgttacggtcctttacccgg

SEQ ID NO: 90882 - DNA, 579 bp, Homo sapiens
  misc_feature: GYAE6OF01BKCAS.5.57.F02.1.454.CMB.1.raw
  modified_base (201)..(201): a, c, t, g, unknown or other
  misc_feature (201)..(201): n is a, c, g, or t
  modified_base (393)..(393): a, c, t, g, unknown or other
  misc_feature (393)..(393): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagacattggtagcaacttagcctaggtaaccaaacaaaaacctggaccagcctcccagacctcctctatttactcgttcatccaccagggccactgactcgtaccccaaccagtataccaggtacggcaggagggtctagggacagacttcacgtctacaccntcagcagcgtacagtctagaacgtcttggactagtttatactgtacaagattgtagtacagttcggaccgttcgtaaccggttccggaccccgaagggaccacggtaggtaggtactacgtcggacggtacgtaacgttcgggtcgtacgtaccggacctaaccgtattccgttggttccttaccg

SEQ ID NO: 90883 - DNA, 534 bp, Homo sapiens
  misc_feature: GYAE6OF01B3XF3.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcagggccagtcagacnttggancaacttgcctggtaccaacaaaaacctggaccagcctcccagacctcctcatttactcgttcactcccaccacgggcccactgactcgtaccccaaccagacttcagtggcaggagggtctgggacagtacttcagtctcaccatcagcagcgtacagtctagaagtcttggactagtttactactgtacaatatgtgtcagtcgcctgaacgttcgacccgtaggaccacgtaggtgatacgtacgacggtacaacgtggacgtctacgccactagtctgttccttaccg

SEQ ID NO: 90884 - DNA, 532 bp, Homo sapiens
  misc_feature: GYAE6OF01CVX5R.5.57.F02.1.454.CMB.1.raw
  modified_base (201)..(201): a, c, t, g, unknown or other
  misc_feature (201)..(201): n is a, c, g, or t
  modified_base (468)..(468): a, c, t, g, unknown or other
  misc_feature (468)..(468): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctaggtaaccaaacaaaaacctggaccagcctcccagactcctcatttatcgttcatccaccagggcccactgatcgtcccaaccagattcagtgcagagggtctgggacagacttcagtctcaccatcagcagcgtacagtcagaagcttggctagtttattactgtacaacaatgtggtcagtcggcctacgaacgttccggccagggaccaagngtaggactagtcgacggacgaacgttggtcgggccttggaccacctattccgtgttccttaccg

SEQ ID NO: 90885 - DNA, 521 bp, Homo sapiens
  misc_feature: GYAE6OF01BAM85.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcagggccagtcagaacnttggancaattgcctggtaccaacaaaacctggccagcctcccagacctcctcatttatcgttcactccaccaggccactgatcgtaccccaacagtacttcgagtcggacaggagggtctgggacagacttcagtctacaccatcagcagcgtacagtctagaagtcgttgactagtttactatgtacaatatgtgtcagtcggcctacgtacgtccgacgacggaccacgtaggtgactagcgtaggacgtagtcgtcggctcgacactatctgtcctacg

SEQ ID NO: 90886 - DNA, 535 bp, Homo sapiens
  misc_feature: GYAE6OF01C072L.5.57.F02.1.454.CMB.1.raw
  modified_base (201)..(201): a, c, t, g, unknown or other
  misc_feature (201)..(201): n is a, c, g, or t
  modified_base (381)..(381): a, c, t, g, unknown or other
  misc_feature (381)..(381): n is a, c, g, or t
  modified_base (390)..(390): a, c, t, g, unknown or other
  misc_feature (390)..(390): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggagcaacttagcctggtaaccaacaaaaacctggccagcctcccagacctcctctatttatcgttcatccaccagggccactgatcgtacccaaccagacttcgagtggcagaggtctgggacagactcagtctcacatcancagcgtacngtctagaagcttggctagtttatactgtacaactagtgtgtacagtcgccctagaacgttcggccccgaagggacctacgaggttaggacttagtcgaagggaccaaacggttgcggctcgaccaaccattcctgttccttaccg

SEQ ID NO: 90887 - DNA, 614 bp, Homo sapiens
  misc_feature: GYAE6OF01CPGA2.5.57.F02.1.454.CMB.1.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctctcctgcagggccagtcagaacattggancaacttgcctaggtaccaacaaaaacctggaccagccctcccagacctcctacatttactcgttcactccaccgagggccactgactcgtaccccaaccagtacttcgagtggacaggacgggtcgtgggaacaggactttcgacgtcctacgacctatcagcagtccgtaacgagtctaggaacgtacgttaggtacttagttttacttactagtacaactaagttggtacggtactaggtcggtcccgttacggtaaccggttccggacccggtaagggaccaacgtacggtaggacttagccgagggaccgtaacgttggtacggtacctcggaacctacccgtagttccgttcgttccgtttacccg

SEQ ID NO: 90888 - DNA, 618 bp, Homo sapiens
  misc_feature: GYAE6OF01BY35D.5.57.F02.1.454.CMB.1.raw
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgtcagtctccagccatcctgtctgtgtctccaggggagagacgccacctctcctgcagggccaggtcagaacattggtancaacttgcctggtaaccaaacaaaacctggaccagcctccagacctcctcatttactcgttcactcccaccgagggccactgacgtcgtaccccaacgagtacttccaggtcggacgaggtacggggttcgtagggaaccaggtaccttcgacgtctaccaccactcgacgtcgacgtccgtaactacgtctaggaaacgtacgttacggacttaagttttacttacgtcgtacaactagttcgtggtacaggtacggacctacggtaaccgttccggacccgaacgggacccacgtacggtcggtactacgtcgacgggtacgtaacggtggtacgtccgttacgacctaacgtattccgttgttccttaccg

SEQ ID NO: 90889 - DNA, 616 bp, Homo sapiens
  misc_feature: GYAE6OF01EDPKU.5.57.F02.1.454.CMB.1.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (556)..(556): a, c, t, g, unknown or other
  misc_feature (556)..(556): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccaccctctcctgccagggccagtcagaacnttggancaacttgcctaggtaaccaaacaaaacctggaccagcctaccagacctcctctatttactcgttcactcccacgacgggccacgtgactcgtacccaacagtattaccgaggtcggcaaggtacgggtctagggacaggtacttcgacgtcctaccgaaccatccagcaggtaccgtactaggtctagaacgtacgttcgggtacttagttttactacgttagtacaaactagtgtagtacgacggttacggccgtacgggtaaccgttccggacccgtaacgggaccgtacgtacggtacggacgttacncggaacgggtactacggttcggacggtcgtacggacctaccgtatcgttcgtccttaccg

SEQ ID NO: 90890 - DNA, 649 bp, Homo sapiens
  misc_feature: GYAE6OF01ECQ9O.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgccacctctcctgcaggccagtcagaactagttggtagactaacgttacgaccgtacgtaaccaaaacgaaaaaccgtcggaccaacgccctaccgacgacctcctactatttactccgttacactcccacgacggccacgtgactaccgtacccaactagtacttacgaggtcgacgagggtacggtcgtaggactagtaccttacgacgtcctacgacctagtacgaacgtacacggtacgttaacgcgttacgtaagtaacgtacgttggtaccttaagtttactacgttagtaccaagtagttggtagcgtacgttcgaccgtacggtaccgttcccggaccgaagggtacccaagtacggtagaacctacgtaccggacggaccgtaaggtcggtcgtacgtaccgtacctaccgtagttcgtagttcccgttaccg

SEQ ID NO: 90891 - DNA, 560 bp, Homo sapiens
  misc_feature: GYAE6OF01CQNB9.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctggtaccaacaaaaacctggccagcctccagactcctcatttatcgttcatccaccaggccactgatcgtacccaaccagtattcagtgcagagggtctgggacagacttcagtctcacatcagcagcgtaacagtctagaagtacttggctagtttatactgtacaatatgtgtcaagtcggcctacggtaacgttccggacccaagggacccaacgacgggtagacttagtacgaacgggtaccgtaaacggttggtacgggccttacggaccctaaccctagtttccgttcgggttcctttacccg

SEQ ID NO: 90892 - DNA, 520 bp, Homo sapiens
  misc_feature: GYAE6OF01EHX1R.5.57.F02.1.454.CMB.1.raw
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagagcccacctctcctgcagggccagtcagacnttggagcaacttgcctggtaccaaacaaaaacctggccagcctccagacctcctcatttatcgttcatcccaccagggccactgatcgtaccccaaccagacttcagtcggcaggagggtctgggacagtacttcagtctcacctatcagcagccgtacagtctagaaagcttggactagttttactactgtacaatagtgtggtcaggttcgacctcggtaacgttcggcccgaggaccagagtgatatcgaggcgaactgtgctcgcacatcgtgtcttccg

SEQ ID NO: 90893 - DNA, 734 bp, Homo sapiens
  misc_feature: GYAE6OF01CYKYA.5.57.F02.1.454.CMB.1.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
  modified_base (706)..(706): a, c, t, g, unknown or other
  misc_feature (706)..(706): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggganagacgcccaccctctcctgcagggccagtcagaactattggancaacttgcctaggtaaccaaacaaaacctggaccacgcctacccagacctcctactatttactcgttcactcccaccgacgggcctatgactcgtacccaaactagacttcaggtggacagggtacggggtctaggggaacacggtacctttacgacggttcctaccaacccgtaatccgaaggcctaacgggtacccgttaaacgacggttaccgttaaggaaaacggttaccgttttaggggacctttaaggtttttaacgttaaccgttacgtaactaaaacttagtagggtttacgggtactaacgggttcgggtaaccccttacggggtaacccggtttaccgggaccccggaacggggtacccaaacggtacgggttaggaacgtttacgtaccggaacggggtaccgaaacggttcgggtcgggtacccttaccgggtacctaaccccggttntttacccggtacgttttcccttaaccgg

SEQ ID NO: 90894 - DNA, 622 bp, Homo sapiens
  misc_feature: GYAE6OF01BVC9S.5.57.F02.1.454.CMB.1.raw
  modified_base (203)..(203): a, c, t, g, unknown or other
  misc_feature (203)..(203): n is a, c, g, or t
  modified_base (248)..(248): a, c, t, g, unknown or other
  misc_feature (248)..(248): n is a, c, g, or t
  modified_base (576)..(576): a, c, t, g, unknown or other
  misc_feature (576)..(576): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctggctcccagataccggttggggagatcgtgatgacgcagtctccagccatcctgtctgtgtctcgagggganagacgcctacctctcctgcagggccagtacaagaactagttgganctaactacgcctacggtaaccaaaacaaaaacctggaccaacgaccctacccgaagtacctccctataacttttaactccgttactaactcccgaaccgacgggaccctacgtacgtaacgtccgtaaccccaaacgtacgtaattcgaacggtcggacgaggtacgggtactagggacacggtacttcagtctacacgatcaagcaggtactaactagtcgtagaacgtacgttaggtactagttttacagtgtaacaatagtggtacgacgtaagtcgtacctacggtaccgttaccgaccgaacggacaccgtaggtacgatacncggtaaggacaacggtgcgctacgaccactagtcttcggtctaccg

SEQ ID NO: 90895 - DNA, 706 bp, Homo sapiens
  misc_feature: GYAE6OF01BSZ5A.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
  modified_base (251)..(251): a, c, t, g, unknown or other
  misc_feature (251)..(251): n is a, c, g, or t
  modified_base (664)..(664): a, c, t, g, unknown or other
  misc_feature (664)..(664): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagcctatcctgtctgtgtctccgagggganagacgcccaccttctcctgacgagggccaggtcaagaacagttgganactaacttcgaccttaggtaaacccaaacaaaaaccgtggaccaacgccctaccgacgtacctcctactaactttatccgttacacttccccacgacggccctaacgtgaacgtccgtaacccaacgtacgtacttcagggtacgcgtaaggtacggggttacgtaggggaaacctacggttaccgttacgaagttccctaaccgaaccgtaactaccgaacgaccgtaacggtaccgtaacgacggttacttagggaaacgttccggttaaggtacctttaagttttactacgtacgttaacgaaacttggttacggtggttacgacggttacggtaccgttaccgggtaaccgttccggaacccgagggtaaccccagtagtacggtactacgtcggacggtacgttacgnggttaccgcgttaccgacctactaccgttgtcgtcgttaacc

SEQ ID NO: 90896 - DNA, 535 bp, Homo sapiens
  misc_feature: GYAE6OF01CGM0R.5.57.F02.1.454.CMB.1.raw
  modified_base (201)..(201): a, c, t, g, unknown or other
  misc_feature (201)..(201): n is a, c, g, or t
  modified_base (399)..(399): a, c, t, g, unknown or other
  misc_feature (399)..(399): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggngagagccaccctctcctgcagggccagtcagaacattggagcaacttagcctggtaaccaacaaaaacctggccagcctcccagacctcctcatttatcgttcactccaccacggccactgatcgtacccaaccagattcagtggcagagggtctaggcagacttcgagtctcacatcagcagcgtacagtctagaanacgttggactagtttattactgtacaactatgtgtcagtcgctcgtacgtttccggccgtacgggccacgagtaggacttagtcgacgggactaacgtcggaggccttgggacccacgattcgttgttccttaccg

SEQ ID NO: 90897 - DNA, 528 bp, Homo sapiens
  misc_feature: GYAE6OF01CA5AU.5.57.F02.1.454.CMB.1.raw
  modified_base (486)..(486): a, c, t, g, unknown or other
  misc_feature (486)..(486): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagccaccctctcctgcagggccagtcagaacattggagcaacttagcctggtaaccaaacaaaaaccctggacccagccctcccacgacctcctcatttactcgttcatccaccgagggcccactgatcgtaccccaacagacttcagtcggcaggagggtctggggacagacttcgagtctcaccatcagcagccgtacagtctagaacgacttggctagttttaatctgtacaatatgtagtcagtcggcctcggtacgttcggacccacgggaccacgngtggatagtcgaggtcgaacgtggtcgctgcacatctgtctc

SEQ ID NO: 90898 - DNA, 522 bp, Homo sapiens
  misc_feature: GYAE6OF01C9LFF.5.57.F02.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggnagacgccacctntcctgcagggccagtcagaacnttggancaactttagcctggtaccaacaaaaacctggccagcctcccagactcctcatttatcgttcactccacagggccactgatgtcccaacagattcagtgcagagggtctgggacagacttcgagtctcgaccatcacgctagcgtaacacgtctagaacgtacttgggctagttttactactgtacaactatgtgtcagtcgccgtacgaacgtttcgacccagggaccacgagtggactagcgtacggcaacgtgtcggctgccaccatctggttccttacg

SEQ ID NO: 90899 - DNA, 588 bp, Homo sapiens
  misc_feature: GYAE6OF01BU8K8.5.57.F02.1.454.CMB.1.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgcccaccctctcctgcagggccagtcagaacnttggancaacttgcctggtaaccaacaaaaacctggccagcctcccagactcctcatttatcgttcactcccaccagggccactgactcgtccccaaccagacttcagtggcagagggtctgggacagtacttcagtctcacatcagcagcgtacagtctagaagacttggactagttttattactgtacaaataacgttggtacgtcgacgttcgggacccttacggtaaaccggttccgggaccccgaaggggaccccacgaggtcggaacttacgttcgaacgggtacgtaaccgttgggtacggaccttcgacccgtactaactttccgttggttcctttacccg

SEQ ID NO: 90900 - DNA, 630 bp, Homo sapiens
  misc_feature: GYAE6OF01DWPMK.5.57.F02.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctntcctgcagggcagtcagaacattggtancaacttagcctaggtaaccaaaccaaaaaccctggacctaagccctcccagaacctcctctatttatccgttcactccaccagggccatgatcgtacccaacagattcagtgcaggaggtctgggacagacttgagtctcacatcagcagcgtacagtctagagtacttggacttagtttattactgtacgaactagttcggtagtcgtaacggtcggtaccgtacggtaaccggtttccgggacccgtaacggggacccttaacgtaagggttaccgggaaacgttacgtaccgggtaaacgggtcccgggtaaacgtcggggttccggtaccgttaccggtccccgaaaccccggtatttacccggttggttccccttttacccg

SEQ ID NO: 90901 - DNA, 620 bp, Homo sapiens
  misc_feature: GYAE6OF01C2DPS.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
  modified_base (608)..(608): a, c, t, g, unknown or other
  misc_feature (608)..(608): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgccacctctcctgcagggccagtcaagaactgttgganctaaacttagccgtacggtaaccaaacaaaaaccgtggaccagccctacccagtacctcctactatttactcgttacactacccaccgacggcctaacgtgactacgtaccccaacctagtactacaggtacgacgaggacgggtctacgggacagtaccttcgacgtctacaccatcgagacacggctaacagtactaggaacgtacgttaggtactagttttacgtacgttacgtactaaacgtagttcgtacgtacgtagtaccggtcccttaacgggaccgtttccggaccgaacggacctaacgtagtaggtactacggtacgtagggaccgtacgtggtcgctacgcgtacacttcncgttactacccg

SEQ ID NO: 90902 - DNA, 680 bp, Homo sapiens
  misc_feature: GYAE6OF01D0Z01.5.57.F02.1.454.CMB.1.raw
  modified_base (202)..(202): a, c, t, g, unknown or other
  misc_feature (202)..(202): n is a, c, g, or t
  modified_base (672)..(672): a, c, t, g, unknown or other
  misc_feature (672)..(672): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagccacctctcctgcgagggccagtcagaacagttggtagcaacttagcctaggtaacccaaacaaaaacctggaccacgcctaccagactcctactatttatcgttcactacccgaccgagggacctactcgtactaccggtaccccaaaccgtaaggtactttacgaacggttcggaccgtaaggtacggggtacgtagggggaacctaggtaaccttcgaacgttctacaaccgtatcgaagcaacggtctaactaggtacctacggtaagtaaccttgggtaccttagttttaacttactacggttacaaacgttattcgggtacggtactacggtacgtaccgtaccggtaaccggtttcgggaccccgaagggtacccgaagtacggttaggaacttaacgtcggaacgggtacgtaaacggtcggtacggtactacggtcaacccggttatccgttcgttnttaccccg

SEQ ID NO: 90903 - DNA, 580 bp, Homo sapiens
  misc_feature: GYAE6OF01EHCQA.5.57.F02.1.454.CMB.1.raw
  modified_base (203)..(203): a, c, t, g, unknown or other
  misc_feature (203)..(203): n is a, c, g, or t
  modified_base (408)..(408): a, c, t, g, unknown or other
  misc_feature (408)..(408): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagagcccaccctctcctgcgagggccagtccaagaacagttggtagctaaacgttagcctggtaacccaaacaaaaacctggaccacgcctcccagacctcctctatttatcgttcactccaccagggcccactgatcgtcccaacagattcagtggcaggacgggtctgggacagacttcagtctcaccatcagcagtctaacngtacgtagaagtcgttggacttaagtttattactgtacaactattggtagtcgagtcggaccctacgggtaacgttcccgggacccaggggacccacggtagtacggacttagtacgacgggacgaacgttggtcggacgtcgaccgaaccctagttccttgtcccttaccg

SEQ ID NO: 90904 - DNA, 533 bp, Homo sapiens
  misc_feature: GYAE6OF01EBA5Y.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (304)..(304): a, c, t, g, unknown or other
  misc_feature (304)..(304): n is a, c, g, or t
  modified_base (318)..(318): a, c, t, g, unknown or other
  misc_feature (318)..(318): n is a, c, g, or t
  modified_base (339)..(339): a, c, t, g, unknown or other
  misc_feature (339)..(339): n is a, c, g, or t
  modified_base (383)..(383): a, c, t, g, unknown or other
  misc_feature (383)..(383): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggganagagcccacccttctcctgcagggccagtcagaacnttggancaacttgcctggtaccaacaaaaacctggccagcctacccagacctcctctattttacncgttcactccaccngggccactgatgtccccaacngacttcaggtcgcagagggtctgggacagacttcagtctcaccntcagcagcgtacagtctgaacgacttgactagtttatactgtacaacaatgtggtcaggtcgcctacggtaacgttcggaccgagggaccactaggtcgtatagtcgaggcaacgtgtcgggcttcggctacccgtatcttcgtcttccc

SEQ ID NO: 90905 - DNA, 502 bp, Homo sapiens
  misc_feature: GYAE6OF01DHYK3.5.57.F02.1.454.CMB.1.raw
  modified_base (201)..(201): a, c, t, g, unknown or other
  misc_feature (201)..(201): n is a, c, g, or t
  modified_base (466)..(466): a, c, t, g, unknown or other
  misc_feature (466)..(466): n is a, c, g, or t
  modified_base (482)..(482): a, c, t, g, unknown or other
  misc_feature (482)..(482): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagacattggagcaacttagcctggtaaccaacaaaaactggaccagcctccagactcctcatttatcgttcactccaccagggccactgatcgtacccaacagattcagtggcaggaggtctgggacagacttcagtctcaccatcagcagcgtaacagtctagaagacttggctagttattactgtacaatagtgtgtcagtcgactcgtacgtcgaccgaggaccagagtgatancgaggacgtaatgcgncgacacctatctgtctaccg

SEQ ID NO: 90906 - DNA, 729 bp, Homo sapiens
  misc_feature: GYAE6OF01BZBIL.5.57.F02.1.454.CMB.1.raw
  modified_base (153)..(153): a, c, t, g, unknown or other
  misc_feature (153)..(153): n is a, c, g, or t
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctcagccatcctgtctgtgtctcgagggganagacgcccaccctntcctgcagggccagtcaagaactgttggancaacttgcctaggtaaccaaacaaaaccgtggaccacgcctaccagacctcctctaatttactcgttcactccaccgacggcctacgtcgtactcgtacccaaacagtaacttcgaggtcggacgtaaggtacggggtcgtacgggactaacggtacttacgacgttacctacgaacctagtacgaacgtacgacggtaccgttaactacggtacctaggaaacgttcgttacggtaactttaacggttttaacttaaccgttggtaaacttaaccgtaaagtttcggttacgggtactaacggttcgggtacccgttacggtaaacccgggttccggaccccgtaacggggtaaccctaaccgggtaggttacggtaacgttaaccggtcggtaacggggtaacccgttaacgggttgggtacccggggtacttaccgggtaccctaacccgttagtttaccttcccgggtttacctttacccg

SEQ ID NO: 90907 - DNA, 613 bp, Homo sapiens
  misc_feature: GYAE6OF01DNW9X.5.57.F02.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
  modified_base (355)..(355): a, c, t, g, unknown or other
  misc_feature (355)..(355): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctntcctgcagggccagtcagaacattggancaacttagcctggtaaccaaacaaaaacctggaccagcctacccagactcctcatttactcgttacactccaccgaggccactgactcgtacccaacagtattcagtcgcaggnggtatgggacagacttcagtctcacatcagcagcgtacagtctagaacgtacgttaggccttaagttttacttacgtcgtactaaactaagttgtaggtctaaggtcggtacccttacggtaaccggtttccggaccctacggggaccctacggaaggttcgggtaacttagtaccggaaagggtaccgaaaccggttggttacccgggtacttaggaccccgtaaacccgtattttacccgtgtttccccgttaacc

SEQ ID NO: 90908 - DNA, 588 bp, Homo sapiens
  misc_feature: GYAE6OF01DUB55.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (422)..(422): a, c, t, g, unknown or other
  misc_feature (422)..(422): n is a, c, g, or t
  modified_base (568)..(568): a, c, t, g, unknown or other
  misc_feature (568)..(568): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggancaacttagcctggtaaccaacaaaaacctggccagcctcccagactcctcatttatcgttcatccaccagggccactgatcgtacccaaccagattcagtggcagagggtctgggacagacttcagtctacaccatcagcagcgtacagtctagaagacgttggctagttttattacgtntactaactaagttggtaggtctaggtcggtacccgttacggtaacgtttacccgggacccgtaacgggacctaaccgaaggttcggaacgttagtaccggtaaggggtacccgaacgttggaccgggtctacgggcctaaaccgtnttccgttagttccgttaccc

SEQ ID NO: 90909 - DNA, 578 bp, Homo sapiens
  misc_feature: GYAE6OF01ELGP9.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (379)..(379): a, c, t, g, unknown or other
  misc_feature (379)..(379): n is a, c, g, or t
  modified_base (571)..(571): a, c, t, g, unknown or other
  misc_feature (571)..(571): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgccacctctcctgcagggccagtcagaacattggagcaacttgcctaggtaacccaaacaaaaaccgtggaccagccctacccagtacctcctactatttactcgttacactccaccgacggccactgactcgtaccccaaacagtacttcgagtcggcaggtacgggtcgngggacagtacttcgagtctacactatcacgcacgtcgtactagtctagaagtacgttcggacttaatttattactcgtacaactagtcgtagtcgtacgtcggccttaacgtaccggttccgacccgacgggtaccacgaggtacgatactcggacgtacgaacgtgacggctcgacctacgattcgtcgtnttacccg

SEQ ID NO: 90910 - DNA, 500 bp, Homo sapiens
  misc_feature: GYAE6OF01A6CBB.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (427)..(427): a, c, t, g, unknown or other
  misc_feature (427)..(427): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgcagggccagtcagaacattggtagcaacttagcctggtaaccaacaaaaacctggccagcctcccagactcctcatttatcgttcatccactagggccactgatgtacccaacagattcagtgcagaggtctggacagactcagtctcacatcagcagcgtacagtctgaagacttggctagtttattacctgtacaacatgtagtnagtgcctcgaacgttcggcacggacacgagtgtatagtacgacggtgaacgtgagctgcacatctgtcttacg

SEQ ID NO: 90911 - DNA, 752 bp, Homo sapiens
  misc_feature: GYAE6OF01C0Q16.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccaccctctcctgcgagggccagtcagaacattggagcaacttagcctggtaaccaaacaaaaccgtggccagaccctccagtactcctctatttctcgttcactccaccgacggcccactgactccgtacccaaccagtacttcgaaggtcggaccgagggtacggggtccgtaggggactaacggtaccttacgacgttcctaccgaccctaagtaccgacggaccgaacggtccgttaaccgtacggttaccgttaaggaaacgttaccgtttagggtaccgtttaacgtttttaacgtttaccgttacgtaccgtaaaacgttaagtttcgggttacggttacgtaggttaccgggtaccccgtttaaccgggtaacccggggttttcccgggaaccccgaacgggggtaacccctaaacggttacgggttacggaaaccgtttacggtaccggtaaacggggtaccgtaaccggttaggttaccggggacctttacggacccgtaacccgtatttacccgttggttcccgtttaacccg

SEQ ID NO: 90912 - DNA, 650 bp, Homo sapiens
  misc_feature: GYAE6OF01BPCXP.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtcctccaggggagagagcccaccctctcctgcaggccagtcagacattggagcaacttagcctagtaaccaactaaaaaccgtggaccagcctacccagacctcctcatttactcgttcactccaccgaggccactgactcgtacccaacagattcgagtcggcaggacgggtctagggacacgtacttacgacgtctacgaccatccagaccgagtccgtaacgtagtcgtagtaagtaccgttgacgttaagttttacttacgtacgtactaacctaagttggttagtacgagttccggtacccgtacggtaaccggtttcccggaccccggtaacgggtaccccgtacggtaacggttacggtaaacgttacgtaccggtaacgggtaccgtaaacggttcggacgggtccttacgggacccttaccgtaactttcggttacgtttcccgttaacccg

SEQ ID NO: 90913 - DNA, 731 bp, Homo sapiens
  misc_feature: GYAE6OF01DOEVS.5.57.F02.1.454.CMB.1.raw
  modified_base (154)..(154): a, c, t, g, unknown or other
  misc_feature (154)..(154): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtcgtccgaggggagagacgcccaccctctccgtgcgaacgggccaggtacaagaactagttagggtacgacctaaacttcggaccctaacgggtaaacccaaaacaaaaaccgtcggaccctaacgccctacccagtacctaccctacttaactttactccgttacctactaccccaaccggtaccgggaccctacgtacggtaacttccgtaaccccgaaaccgtaggttaccttacgaggttacgggacgtaggggtacgggtacgtacggggaactacggtaccttacgacgtacctaccgaccgtataccgacgacgtacggtacgtacgtagttcgaagtaacgtacgttcggacttagtttactaagttcgtactaagtagttggtcgtacgtaggtccggtaccgtaccgggttaccgttaccggacccggtaacggtacccgtaacgaggttacggtactacggtacggtaacggacggtacggtcggtaccgggtctaccgaccttactaaggtccgtttaggcctttaccg

SEQ ID NO: 90914 - DNA, 612 bp, Homo sapiens
  misc_feature: GYAE6OF01B7L72.5.57.F02.1.454.CMB.1.raw
  modified_base (245)..(245): a, c, t, g, unknown or other
  misc_feature (245)..(245): n is a, c, g, or t
  modified_base (396)..(396): a, c, t, g, unknown or other
  misc_feature (396)..(396): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgcccaccctctcctgcagggccagtcagaacatttggancaacttagcctaggtacccaaacaaaaacctggaccagccctcccagacctcctcatttatcgttcatccacaggccactgatgtcccaaccagattcagtggcaggacgggtctgggacagacttcagtctcaccatcagcagcgtaacngtctagaagtcgttggactagtttattactgtacaactaatgtaggtcaggttcggacccgttacggtaacccggttccggacccgtaacggggacccaacgtacggttgggaaacttacggtacccggtaagggtaaccccggaaacgtttcggggtaccgggtaccttacgggaccctaacccgtaacgtttcccgttacggttccctttaccc

SEQ ID NO: 90915 - DNA, 588 bp, Homo sapiens
  misc_feature: GYAE6OF01ELDEU.5.57.F02.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
  modified_base (398)..(398): a, c, t, g, unknown or other
  misc_feature (398)..(398): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctctcctgcagggccagtcagaacattggtancaacttgcctaggtaaccaaacaaaaacctggaccacgcctcccagacctcctctatttatcgttcactccaccgagggccactgactcgtacccaaccagattcaggtcggcgaggagggtcgtaggggacaggtacttcgacgtctacaccntccagcagccgtacagtctagaacgtacttggtctaggttttacttactgtacaactattggtaggtctaggtcggccgtacggtaaccgttccggacccgtacggacccgacgtaggtagtactacgtccgagggtaccgtaacggtggtaccggtcgtacgtccaacctagttccgtgttccgttacc

SEQ ID NO: 90916 - DNA, 518 bp, Homo sapiens
  misc_feature: GYAE6OF01EH2FZ.5.57.F02.1.454.CMB.1.raw
  modified_base (154)..(154): a, c, t, g, unknown or other
  misc_feature (154)..(154): n is a, c, g, or t
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (329)..(329): a, c, t, g, unknown or other
  misc_feature (329)..(329): n is a, c, g, or t
  modified_base (348)..(348): a, c, t, g, unknown or other
  misc_feature (348)..(348): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccagggganagagccacctctcctgcaggccagtcagacattggancaacttagcctaggtaccaacaaaaacctggccagcctccagacctcctctatttatcgttcatccacacggccactgatcgtcccaacngacttcagtgcagaggtcngggacagacttcagtctcacatcagcagcgtacagtctagaagtcgttgctagtttattactgtacaatatgtgtacaggtcgtcctacgtaacgttccggaccagggtaccagtaggtgtatagtcgacggacgaacgtgacggtctcgtaccactatctgtccttacg

SEQ ID NO: 90917 - DNA, 542 bp, Homo sapiens
  misc_feature: GYAE6OF01DZFVB.5.57.F02.1.454.CMB.1.raw
  modified_base (213)..(213): a, c, t, g, unknown or other
  misc_feature (213)..(213): n is a, c, g, or t
  modified_base (384)..(384): a, c, t, g, unknown or other
  misc_feature (384)..(384): n is a, c, g, or t
  modified_base (513)..(513): a, c, t, g, unknown or other
  misc_feature (513)..(513): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctntcctgcagggccagtcagaacattggagcaacttagcctggtaaccaaacaaaaacctggaccagcctccagactcctcatttatcgttcatccaccaggccactgatcgtaccaaccagattcagtggacagaggtctgggacagacttcagtctcacatcagcagctangtctgaagtactggactagtttatacgtgtactaacgaatggtagtcacgtggtaccttaccggtaaccgttccgggtaccccgacgggacccgagacggtaggactagtacgacggtacggactaggnggtcgtcgcaccattcgtcgttcgttacc

SEQ ID NO: 90918 - DNA, 765 bp, Homo sapiens
  misc_feature: GYAE6OF01C1LBE.5.57.F02.1.454.CMB.1.raw
  modified_base (151)..(151): a, c, t, g, unknown or other
  misc_feature (151)..(151): n is a, c, g, or t
  modified_base (201)..(201): a, c, t, g, unknown or other
  misc_feature (201)..(201): n is a, c, g, or t
  modified_base (250)..(250): a, c, t, g, unknown or other
  misc_feature (250)..(250): n is a, c, g, or t
tcagatcagacacgcacgaccggtgctcgatttagctcgatatagttgggtttgggggagaactgctcagttaggacccagacggaaccatggaagccccagcgcagcttctcttcctcctgctactctggctccagataccgttgggganatcgtgatgacgcagtctcagccatcctgtctgtgtcctcgaaggggganagacgtccaccctctcgtgccgagggccagtcaagaactgtttgggacnctaaacgtttcgcctacggtaaaccaaacaaaaaccgtcggaccaacgtccctacccgaagtacctcctattaactttaactccgtttaccaacttccccgaaccgacgggtccctaacgttcgaattcccggttaacccaaaccgtaggtaacttccgaaggttcggacgaacgggtacggggttacgtagggaaccgtagggtaccctttacgaacggttcctaccgaaacctacgtacgaacgtacgtacggtaccgtaaccgacgttacgtaacggtaaacgttacggtttacgaccgtttaagttttaacttacgttacgtaaaccaacgtaagtttggtacggttactacgggttaccggaccgttaaccgggtaacggtttcccggacccgtaacgggtaccctaaacggtcggtaacgtacgtacgtacggaacgggttacccgtaaaggttcgggtacggtaccttacggtaccaacccggtatttcccgtggttaccctttaccg

SEQ ID NO: 90919 - DNA, 688 bp, Homo sapiens
  misc_feature: GYAE6OF01C13J2.5.57.F02.1.454.CMB.1.raw
  modified_base (156)..(156): a, c, t, g, unknown or other
  misc_feature (156)..(156): n is a, c, g, or t
  modified_base (204)..(204): a, c, t, g, unknown or other
  misc_feature (204)..(204): n is a, c, g, or t
  modified_base (351)..(351): a, c, t, g, unknown or other
  misc_feature (351)..(351): n is a, c, g, or t
tcagatcagacacgcacgaccggtgctcgatttagctcgatataggttgggtttggggaggaactgctcagttaggacccagacggaaccatcggaagccccagcgcagcttctcttcctcctgctactctggctcccagtataccggttgggganatcgtgatgacgcagtctccagccatcctgtctgtgtctcgagggganagagcccacctctccgtgcgagggccagtcagaactagttggacgcaacttagccgtggtaaccaacaaaacctggaccaggcctccacgactccctactatttactcgttcactccaccgagggccatcgactcgtacccacgagnttcagtggacaggtaggtcgtagggactaggacgttacacggtcctaccgaaccgtacgtaccgaggtacctaacggtcccggtaactaggttaccgtaggtaaaacggtccgtttggggacctttaacgggttttaactttaaccggtacgtactaaaccgtagttggtacggttacgacggttacggtacccgttacggtaaccggttcccggacccgtaagggtacccaacggtccggttacgggaacgttacgacggacgggtaccgtaacgggtcgggtacggtaccgttcggtacccgtaaccgtacgtttccgtacgtttccgttaaccg

SEQ ID NO: 90920 - DNA, 616 bp, Homo sapiens
  misc_feature: GYAE6OF01CD5QG.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtcctccgagggganagacgccaccctntcctgcagggccagtcagaacattggagcaacttagcctaggtaaccaaacaaaaacctggccacgcctcccagacctcctactatttactcgttcactccaaccgacgggaccactgactcgtacccaacagtacttcagtgcaggagggtctagggacacggtacttcgacgttctaccgacctagtcagcgaagtccgtaacgagttccgtagaacgtacgttacggactaagttttaacttacgtgtacaacgtaatcggtagtcaggtcgaccgtacggtaacgttccggacccgtaagggacccaagtcgtacggtaactacgcgtaacgggtcgaaaccggttggtaaccgggtctaccggtacctaacccgattccgttcggtctttacccg

SEQ ID NO: 90921 - DNA, 690 bp, Homo sapiens
  misc_feature: GYAE6OF01DOXS4.5.57.F02.1.454.CMB.1.raw
  modified_base (152)..(152): a, c, t, g, unknown or other
  misc_feature (152)..(152): n is a, c, g, or t
  modified_base (188)..(188): a, c, t, g, unknown or other
  misc_feature (188)..(188): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagataccgttgggganatcgtgatgacgcagtctccagccatcctgtctgtntctaccgagggganagagccaccctctccgtgcgaacgggtccaggtccagaacattggacgcaacttagaccgtaggtaaccaaacaaaaaccgtggaccacgcctacccgagtacctcctactactttacgtcttacaacttaccaaccgacgggtaccacgtacgacttaccggtacccctaaacccgtaggtaactttccgaaggttaccggacaacgggtaacgggttacgttacggggaactaaggtaccgtttacgagtcccttacgacctactacgaggacacggtacgtacgagttcctaggaaacgtacgttacggtacttagtttaacttcgtagtaactaacgttaacgtggttacgggtactacggtacggaccctacgggtaaccggttccgaccgaacggtaccgaacgtacggtcggaaattacgtacgacggtacgtaacggtgtacggacgttcggaacctacgaacttcgtcgtatttacccg

SEQ ID NO: 90922 - DNA, 633 bp, Homo sapiens
  misc_feature: GYAE6OF01C2YXW.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagatcgtgatgacgcagtctccagccatcctgtctgtgtctccgagggganagagcccaccctctcctgcagggccagtccagaacattggagctaacttagcctggtaaccaaacaaaaacctggaccagcctacccagactcctctatttactcgttcactccaccgacgggccactgactcgaccccaacagtactcaggtgcagagggtctgggacagacttcagtctcacctatcacgcagccgtaactagtctaggaacgtcgttacggacttaagtttacttacgtagtacctaaactaattggttacggtacgacggttacgggtccccttaggtaaccggttccggaccccgtaaggggtacccaagtacggttaggaacttacgtaccggaacgggtaccggtaaacgttcgggtacgggtaccgtaccggtacccgtaacccttagttacccgttggtttacccttaacccg

SEQ ID NO: 90923 - DNA, 695 bp, Homo sapiens
  misc_feature: GYAE6OF01BQQ7N.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgcccaccctctcctgccagggccagtccaaggaactagttgggacgctaaacgttacgccttacgggtaaacccaaaaccgaaaaaacccgtcgggttacccaacggccctaccccaagtaccttccctacctaattttactccgttaccactcccaccgagggccctactgactcgtacccaaacagtacttcaggtggacgaggacgggtcgagggacagtacttcacgtctcacctatacagcagtctacagtctagaacgtacttggacttagttttacttacgtacgttacaaactagttggtaggtactaaggtcggtacccttacgggtaaccggtttccgggacccgtaacggggtacctaacgggtacggttacggtacttaacggtccggaacgggtaccggtaaacggttcgggtacgggtaccttacgggtaccctaacccgtacggtttccgttaccgggtttcctttaaccccg

SEQ ID NO: 90924 - DNA, 795 bp, Homo sapiens
  misc_feature: GYAE6OF01CW4V9.5.57.F02.1.454.CMB.1.raw
  modified_base (154)..(154): a, c, t, g, unknown or other
  misc_feature (154)..(154): n is a, c, g, or t
  modified_base (206)..(206): a, c, t, g, unknown or other
  misc_feature (206)..(206): n is a, c, g, or t
  modified_base (256)..(256): a, c, t, g, unknown or other
  misc_feature (256)..(256): n is a, c, g, or t
  modified_base (532)..(532): a, c, t, g, unknown or other
  misc_feature (532)..(532): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtcctccagccatcctgtctgtgtctccggaagggganagacgcccacccttctcctgccgagggccagtacaagaactgttaggacnctaaacgttacgaccgttacggtaaacccaaaacctaaaaaccgtcggacccaaccgtccctacccgaacgtacccttccgttactaactttttacgtccgtttaccactacccgaacccgacgggtaccctaacgttcgaaccttacccggtaacccaaccgtagtacttcgaacggtcggacgagggtacgggtacgtacggggaactacggtaccttacgtaccgtaccttacccgaactaacgtaccgacgaccgaacggccgtttaaacgngtaacgttacggaaacgttacggttacgggtacttttaaggtttacttaaccggttacgtaaacctaaacgttaagttcgggtaaccgtagttaccggtaccggtaccgttaaccggtaccgggtttacccgaaccgggtaacggaaccgtacgtaaggggtacgtacgttaacggccggaaaggggttacccgtaaggttccgggtaaggttcccgtaccgaacccttaacggttaactttcctcccggttttacctacccg

SEQ ID NO: 90925 - DNA, 539 bp, Homo sapiens
  misc_feature: GYAE6OF01BAIF4.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcaggccagtcagaacattggtancaacttgcctggtaaccaacaaaaacctggccagcctcccagactcctcatttatcgttcactccaccagggccactgatcgtcccaacagattcagtgcagagggtctggacagacttcagtctacaccatcacgcagtcgtacagtctagaagtcttaggcctagtttacttactgtacaactagttgtgtacgagtcggcctacggtaacgttccggacccaagggtacccacgtagtcggaatacgtacgacggacgaacgttggcgtactgaccacctatcttcgttcttacg

SEQ ID NO: 90926 - DNA, 823 bp, Homo sapiens
  misc_feature: GYAE6OF01DKQFM.5.57.F02.1.454.CMB.1.raw
  modified_base (153)..(153): a, c, t, g, unknown or other
  misc_feature (153)..(153): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtcgtccgaggggagagacgcccaccctctccgtggaccgacgggccaaggtaccaagtaacctaggtttcgggaacgctaaacgttacggcccgttaacggtaaacccaaaaaccgtaaaaaccgtcgggaacccaaccggccctacccgacgtaccctcccttacttaacgttttaccgtaccgttaccacttaccccgaaccggccgggtaaccctacgtacggtaccttacccggtaacccctaaacgtacgtaactttacggacggttacggacggtaagggtacgggtcgtacggggaactacgtacttacgacggttacctaaccacgtacgtaccgaacggtaccgtacggtaccgtaacgtacggttacgtaacggtaaattccgggtttaggtaacgtttaacgttttactaccgtacggtaaactaaaccgttagtttacgggtacgttacggtacgggttaacccggttccggttaacccggggttaaccggtttccccgggaacccggtaacggggtacccaaaggtcggttacgggaaccgttacgtaacgggacgggtacgtaaccggttggtaccgacgttaaccgaccgtaccttcgttcgttccgttcctttaaccg

SEQ ID NO: 90927 - DNA, 574 bp, Homo sapiens
  misc_feature: GYAE6OF01C0XIJ.5.57.F02.1.454.CMB.1.raw
  modified_base (213)..(213): a, c, t, g, unknown or other
  misc_feature (213)..(213): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggttgggggaggaactgctcagttaggacccagacggaaccatggaagccccagcgcagcttctcttcctcctgctactctggctcccgagataccgttggggagatcgtgatgacgcagtctccagccatcctgtctgtgtctcgaggggagagagccaccctntcctgcaggccagtcagaactagttgganctaacttagcctaggtaaccaaacaaaaacctggaccagcctccagactcctcatttactcgttacactccaccgagggccacgtgatcgtacccaacagacttcagtggacaggtggtcgtaggacagtctacgacgtctacactatcagacgacgtcgtaactagtctaagaacgtacgttcgtacttagtttactacgtcgtacaactagttggtagtctaggtcgtaccgtacggtaccgttccggaccgtacggacctagagtagactacgtacgacgggtactaacggttggcggtacgtacgtcctaactattcctgttctaccg

SEQ ID NO: 90928 - DNA, 602 bp, Homo sapiens
  misc_feature: GYAE6OF01CFUJQ.5.57.F02.1.454.CMB.1.raw
  modified_base (243)..(243): a, c, t, g, unknown or other
  misc_feature (243)..(243): n is a, c, g, or t
  modified_base (354)..(354): a, c, t, g, unknown or other
  misc_feature (354)..(354): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgccaccctctcctgcagggccagtcagaacattggancaacttagcctggtaccaacaaaaacctggccagcctccagactcctcatttactcgttcactccaccgagggccactgactcgtacccaaccagacttacagtggcaggngggtctgggacagactcagtctcaccatcagcagcgtacagtctagaagtacgttggactagtttatacttgtactaactatgtgtacaggtcggacctacgggtaacgttccggacccgtaacggggacctaacggaggtacggtaacttaacgaccggtaaacgggtacccgtaaacggttcgggttaccgggtaccgttacggtacctaacccgtaagtttcccgttcggtttccctttaacccg

SEQ ID NO: 90929 - DNA, 523 bp, Homo sapiens
  misc_feature: GYAE6OF01A6M7N.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (474)..(474): a, c, t, g, unknown or other
  misc_feature (474)..(474): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcagggccagtcagacattggancaattagcctgtaaccaacaaaaacctggaccagcctacccagacctcctactatttactcgtttacactccaccagggccactgatcgtacccaacagattcagtgcaggaggtctgggacagtactcagtctcacatcagacagcgtacagtctagaagtacgttagctaagtttatacgtgtacaactagtgtgtcagtcgcctgtaacgttccggccacggacacgngtagtatagtcgagtacgaagtgcggctcgcaactatcttcgtcttacg

SEQ ID NO: 90930 - DNA, 720 bp, Homo sapiens
  misc_feature: GYAE6OF01CKAOA.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagccaccctctctgcgagggccagtcaagaactattgggagctaacttagcctaggtaaccaaacgaaaaacctggaccacgccctcccagacctcctactatttactcgttacactccaacgacggaccactgactccgtacccaaccagtacttacgaggtcggacgaaggtacggggtcgtacggggaactacggtacctttacgacgttcctaccaacctataccgacggactaaggtaccgtactaggttaccgtaggaacgttaccgttaggtacttaacggttttaattaccgttagtaactaaaccgtaagttacggttacgggtacgtaacgggttaccggtacccgttaacgggtaacccgggtttacccgggaccccggtaacgggtaaccccgtaacggtaacgggttaggaaccgttaagtacccgggtaaggaccggtaaacgttgggtaccggttacgtacgtacccgtaaccgtactttccgttacgttccgtttacccg

SEQ ID NO: 90931 - DNA, 552 bp, Homo sapiens
  misc_feature: GYAE6OF01BJ5K3.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcccaccctctcctgcagggccagtcagaacnttggancaacttgcctggtaccaacaaaaacctggccagcctcccagactcctcatttatcgttcatcccaccagggcccatgatcgtcccaaccagtattcagtgcaggagggtctgggacagacttcagtctcaccatcagcagccgtacagtctagaaagcttggactagtttatactgtacaataatggtacggtcaggtcggacctacggtaaccgttccggacccgagggacccaacgaggtaggactagtccgacggtacgtaaacgtcggtaggtcctacgcaccctattccgttcgttccttacccg

SEQ ID NO: 90932 - DNA, 635 bp, Homo sapiens
  misc_feature: GYAE6OF01DU4S9.5.57.F02.1.454.CMB.1.raw
  modified_base (202)..(202): a, c, t, g, unknown or other
  misc_feature (202)..(202): n is a, c, g, or t
  modified_base (618)..(618): a, c, t, g, unknown or other
  misc_feature (618)..(618): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagatcgtgatgacgcagtctccagccatcctgtctgtgtcctccgagggganagacgccaccctctcctgcagggccagtcagaactagttggagctaacttagcctaggtaacccaaacaaaaccgtcggacccacgccctacccacgtacctcctctatttactccgttacactacccaccgacggacctacgtcgtactaccgtaccccaaacctagtacttcgaaggtcggacgagggacgggtcgtaggggaacaggtaccttcgacgttacctaccgaacctactcgacgacgaacgtccgtaacgtacgtacgtaagtaaacgtcgttagacgtttaagtttacttacctagtaacctaacgtagttggtacggtacaggttcggaccttacggtaccggttcgacccgaggaccagagtggactagcgacggtacgacgttggacgctacgaccaccgtnttacctgttccttaccg

SEQ ID NO: 90933 - DNA, 541 bp, Homo sapiens
  misc_feature: GYAE6OF01A4W13.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctntcctgcagggccagtcagaacnttggancaacttagcctggtaccaacaaaaacctggccagcctcccagactcctcatttatcgttcatccaccagggccactgactcgtcccaaccagattcagtggcagagggtctgggacagacttcagtctcaccatcagcagcgtacagtctagaagacttggactagtttatactgtacaactaatgtgtcagtgcctacgtaacgttcggacccagggaccacgaggtggatagtcgaagggtccgtaaacgtcggttacggcttacggccaaccgtagttccgttggttccttaccg

SEQ ID NO: 90934 - DNA, 524 bp, Homo sapiens
  misc_feature: GYAE6OF01CRDHH.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggagcaacttgcctggtaaccaacaaaaacctggccagcctcccagactcctcatttatcgttcatccaccagggccactgatgtcccaacagattcagtggcaggagggtctgggacagacttcagtctcacatcagcagctacacgtctagaagtacttggactacgtttattactcgtacaactaatgtggtcaggtcgccttacggacgtttcggcccaagggaccacgagtggactagtcgaggcgaacgtgtcggcttgcaaccgattcctgtccttacg

SEQ ID NO: 90935 - DNA, 553 bp, Homo sapiens
  misc_feature: GYAE6OF01CBBAE.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaaacttagccctaggtaacccaaacaaaaaaccctggaccaagccctcccagacctcctcatttatcgttcatccaccagggccatgatcgtcccaaccagattcaagtggcaggagggtctgggacagacttcagtcctcaccatcagcagcgtacagtctgaaagtacttggctagtttagtactgtacaactaagtgtggtcagtcgggacccttggtaacgttccggacccgagggacccagtagtggatacgtcgacggtacgaacgttggtacggctacggccaacagttccttgtccttaccg

SEQ ID NO: 90936 - DNA, 761 bp, Homo sapiens
  misc_feature: GYAE6OF01CX6VS.5.57.F02.1.454.CMB.1.raw
  modified_base (152)..(152): a, c, t, g, unknown or other
  misc_feature (152)..(152): n is a, c, g, or t
  modified_base (200)..(200): a, c, t, g, unknown or other
  misc_feature (200)..(200): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgtgggganatcgtgatgacgcagtctccagccatcctgtctgtgtctccagggganagacgcccacctctcctgcagggccagtcagacattgggancaacttagctacggtaaccaacaaaacctcggaccacgcctcccagacctcctactactttactcgttacactcccaccgacgggaccacgtcgactccgtaccccaaccagtacttcgaagttcggacagggtagggtcgtagggaacagtacgttcaagttccctacgaacctagtacgacgaccaacggtaccgtactacggttacgtaagaaacgtacggttaagggctttaaacggtttaactttaccgttacgtaacctaaaccgttaaggtttcggttacgggtttaccgtaagggttcccgggtacccgttttaaccgggtaaacccgggttttccccgggaaccccggtaaaccgggggtaccccgtaaaacggtaccgggttaacggggtaacttaacggttacccgggaacgggtaaaccccgggttaaaggttcccggggtacgggttacccttacgggtaacccggtaacccctaggtttccccttgggttttcccctttaacccgg

SEQ ID NO: 90937 - DNA, 757 bp, Homo sapiens
  misc_feature: GYAE6OF01D6CHA.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccgtctcctgcgagggccagtcaagaactagttggagcaacgttcgcctacggtaacccaaacaaaaaccgtcggaccacgccctacccagacctcctctatttactcgttccactcccgaccgacgggccacgtcgactccggtaccccaaaccgtagtacttacgaaggttcggacgtaagggtacggggtacgtacggggaacacggttaaccttaccgtaacgttcctaccaaccctagttacgaacggaccgtaacggtaccggttaacgacggttacgtaaggtaaacgttacggtttagggtaacctttaagggttttaactttaccgtacgttaaccgtaaactaacggtttcgggttacggtacgttaacgggtacggtaccccgttacgggtaaaccgggtttcccggaacccggtaacgggacccgtacggtagggtacggtaacttaggtaccggaacggggtaccgtaacggttgggtaccgggtacgtacggtacccgaaccgttaacgttccggttcgttcgtttaacccg

SEQ ID NO: 90938 - DNA, 865 bp, Homo sapiens
  misc_feature: GYAE6OF01D7TF8.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtcgtctccgagggganagacgcccaccctctccgtgccgagggccaggtcaagaactagttgggtaagcctaaacgtttacgcccgtacgggttaaacccaaaaaccgtaaaaaaacccgttcgggacccaacggtcccctaccccgaagtacccttccccttacttaactttttactccgtttaccaacttccccaaccggtacgggaccctaacgttcgtacttaccggtacccccaaaccgtagtactttaccgaacggtcggaaccgaagggtacggggttccgtaggggaacctaacggttacctttacgaacgttacctaccgaaccgtacttacgaacggacgtaacggtccgttaaacgtaggttaaccgttaaggaaaacggttaccgtttacgggtaacttaacgtttttttaaccgtaacgttacgttaaccgaaacgttaaggtttcggttacgggtacgttaacgggttcgggtaccccgttacggggtaaacccgggttttcccgggaaccccggttaacggggaaccccgttaacggtaacgggttaccgggtaaacgttaaccgttaccgggaacgggttacccggtaaacggttccgggtacgggtccgttaacgtacccgtacccgttaacgtttccgttacggttccctttaacccgg

SEQ ID NO: 90939 - DNA, 966 bp, Homo sapiens
  misc_feature: GYAE6OF01DHBDA.5.57.F02.1.454.CMB.1.raw
  modified_base (154)..(154): a, c, t, g, unknown or other
  misc_feature (154)..(154): n is a, c, g, or t
  modified_base (190)..(190): a, c, t, g, unknown or other
  misc_feature (190)..(190): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccgttgggganatcgtgatgacgcagtctccagccatcctgtctgtntcctcgagggganagacgcccaccctctccgtggcgacgggccaggtaccaaggaacctagtttgggaacgtacctaaaccgtttacggcccgttaacgggttaaaacccaaaaacccgtaaaaaaaccccgttcggggaacccctaacggtaccccctttacccccgaacggtaaacccctttcccccgttacctttaacttttttaacccgttccggttttaccctaaccgttacccccgaaacccggtaccggggtacccctaaccgttacggtacctttaacccgggtaccccctaaaacccgtaaggttaactttaccggtaagggttacgggaccgtaaggggtacggggttcggtacgggggaaacctacggtaaccttcgtaacggttcccttaaccgtaaccgtacttaaccggacgtacgaaccggtaccggttaaaccgtacggttaccgttaaacggtaaaccggttacgtttacggggtaaccttttaacgggttttttacttaacccggttaagttaacccgtaaaacgttaacgtttgggttaccgggttaacgtacgggttacccggtcccggtttaaccgggtacccgggtttaccccgggaacccgggtaaccgggtaacccgtaaagggtacgggttacggtaacttaacgggtacccggtaacggggtacccgttaaacggttcggggttacgggacccgttacgggtaaccccttacgggtacctttacccttacgggtttccctttaaccccgg

SEQ ID NO: 90940 - DNA, 776 bp, Homo sapiens
  misc_feature: GYAE6OF01ELSKX.5.57.F02.1.454.CMB.1.raw
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgcccacctctccgtgcgacgggccagtcaagaactagttggtaacgacctaaacgttacgcccgtacggtaaacccaaaacgtaaaaaccgtcggacccacgccctacccgagaccttcctactactttactccgttacactcccaaccgacgggccctacgtgtacttcccgtaaccccaaactacgtacttacgaagggttcggacgtaagggtacggggttacgtaggggaacctacggttacctttacgacggtttacccttaccgaaccgtaacttaccgaaggacccgtaacggtacccggttaaactacggttacgtaaacggtaaacggttaaccgtttgggtaacctttaacgtttttaacgttaccgttacgtaaccgtaaacgttaagtttcggtacggttaccgagggtttcccggaccgttacgggtaaccggttccggtacccgaacgggacctacggaaggtcggtaactacgtaacggtacgggacgtaaccggttgtaccggtaccgtacggtacccgtaaccttagtttccgttacgtttccgttaccccg

SEQ ID NO: 90941 - DNA, 545 bp, Homo sapiens
  misc_feature: GYAE6OF01BNBU5.5.57.F02.1.454.CMB.1.raw
  modified_base (153)..(153): a, c, t, g, unknown or other
  misc_feature (153)..(153): n is a, c, g, or t
  modified_base (356)..(356): a, c, t, g, unknown or other
  misc_feature (356)..(356): n is a, c, g, or t
  modified_base (440)..(440): a, c, t, g, unknown or other
  misc_feature (440)..(440): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctcaggggagagagccacctctcctgcagggccagtcagaacattggtagcaacttagcctaggtaaccaacaaaaacctggaccagcctcccagacctcctcatttactcgttcactccaccgagggccactgactcgtacccaacagtattcaggtcggcaggngggtcagggacagacttcagtctcacatcagcagcgtacagtactagaagtcttggactagtttattactgtacatatgtagtngtgactcggtacgttccgccgacggaccacgagtacggactacgtacgaacgggtgtaacgttgggacggtctaccggcgtacctactcgttcggttcttacccg

SEQ ID NO: 90942 - DNA, 565 bp, Homo sapiens
  misc_feature: GYAE6OF01BQ3O8.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagacgcccaccctctcctgcagggccagtcagaacattgganacaacttgcctaggtaaccaaacaaaaacccgtggaccacgccctcccagacctcctacatttactccgttcactccaccgagggccactgactcgtccccaacagattcgagtgcaggagggtcgtgggacaggtacttcgagtctacacatcagacacgacgtacagtctagaactcgttaggtactagtttatacgtagtacaactagtgtacgtctaggtcgtctacggtacgttccggacccgtacgggaccagtcggtaggtactagtcgacgggtacgtaacgtggtcggccgtgaccactatccttgtcttacc

SEQ ID NO: 90943 - DNA, 627 bp, Homo sapiens
  misc_feature: GYAE6OF01CE58F.5.57.F02.1.454.CMB.1.raw
  modified_base (201)..(201): a, c, t, g, unknown or other
  misc_feature (201)..(201): n is a, c, g, or t
  modified_base (218)..(218): a, c, t, g, unknown or other
  misc_feature (218)..(218): n is a, c, g, or t
  modified_base (398)..(398): a, c, t, g, unknown or other
  misc_feature (398)..(398): n is a, c, g, or t
  modified_base (572)..(572): a, c, t, g, unknown or other
  misc_feature (572)..(572): n is a, c, g, or t
  modified_base (616)..(616): a, c, t, g, unknown or other
  misc_feature (616)..(616): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggnagacgcccaccctctcngcgagggccagtcaagaactgttggagctaaacgttagccgtaggaaccaaaccaaaacctggacccagccctacccagacctcctctatttactcgttcactcccaccgacggcctactcgactcgacccaacagtacttcgagtcggacgaggtcgggtcgtaggggacagtacttanacgtctacaccgtataccaggccaagtccgtaacgtagtccgtagaaacgtcgttggacttagtttaactcgtagtaacaagtagtgttacggtactcgggtacggtcccgtaacggtaccggttaccggacccgacgggaccgtaacgtgtaggaactacggacgacgggtanaacggttggtaccggcgtacgtacccaaccttgttacccggttnttcccgttacc

SEQ ID NO: 90944 - DNA, 584 bp, Homo sapiens
  misc_feature: GYAE6OF01AJ83O.5.57.F02.1.454.CMB.1.raw
  modified_base (395)..(395): a, c, t, g, unknown or other
  misc_feature (395)..(395): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgccaccctctcctgcgagggccagtcagaacattggtagcaacttgcctaggtaaccaaacaaaaacctggaccacgcctcccagacctcctcatttatcgttcactccaccgagggccactgactcgtaccccaaccagattcagtcgacaggtagggtctgggacacgacttacgagtcctcgaccntacagcagtcgtacagtctagaacgtacttggacttagtttatacgtgtacaactagttgtgtactaggtcggtacctacggtaccgttcggacccgtaagggacccaggtacggtaggaacttacgtacgacggtaccggtaacgtggtaccggctacggtaccaccgttatccgttagttccttacg

SEQ ID NO: 90945 - DNA, 532 bp, Homo sapiens
  misc_feature: GYAE6OF01BUZGX.5.57.F02.1.454.CMB.1.raw
  modified_base (201)..(201): a, c, t, g, unknown or other
  misc_feature (201)..(201): n is a, c, g, or t
  modified_base (243)..(243): a, c, t, g, unknown or other
  misc_feature (243)..(243): n is a, c, g, or t
  modified_base (297)..(297): a, c, t, g, unknown or other
  misc_feature (297)..(297): n is a, c, g, or t
  modified_base (385)..(385): a, c, t, g, unknown or other
  misc_feature (385)..(385): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggtancaacttgcctggtaccaacaaaaacctggccagcctcccagactcctcatttancgttcatccacagggccatgatcgtacccaacagattcagtgcagagggtcagggacagacttcgagtctcaccatcagtcagcgtanagtctagaagtcttggactagtttatactgtacaacattgtgcagtcggacctcggtaacgttccggacccagggtaccacgtagtaggtataacgtcgaggtacgaacgttggcggtactggactaccgatccgttgtcccgttac

SEQ ID NO: 90946 - DNA, 630 bp, Homo sapiens
  misc_feature: GYAE6OF01DDXVE.5.57.F02.1.454.CMB.1.raw
  modified_base (238)..(238): a, c, t, g, unknown or other
  misc_feature (238)..(238): n is a, c, g, or t
  modified_base (602)..(602): a, c, t, g, unknown or other
  misc_feature (602)..(602): n is a, c, g, or t
  modified_base (613)..(613): a, c, t, g, unknown or other
  misc_feature (613)..(613): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgcccaccctctcctgcgaggccagtcagaacnttggagcaacttgcctgtaaccaacaaaaccgtcgaccacgcctaccgacactcctctatttactcgttcactccaccgacggcctacgtcgacgttccgaccccaacgaagtacttcgaacgtcggaccgtaagggacgggttacgtacgggaactacggtactttcccgaggttcctaccgacccgtatccgtaagcgtaacgccgttaacgagttcgtagaacgttacgttagtacctttatttactacgttgactaactagttcgtacggtcgagtccggtaccgtacgtaccggttccggaccgtaacgggacccaagtcggttagacgttcgacggtaggacctaacggttgcggtcngaccctacgtnttcctgttccttacccg

SEQ ID NO: 90947 - DNA, 731 bp, Homo sapiens
  misc_feature: GYAE6OF01BLDEM.5.57.F02.1.454.CMB.1.raw
  modified_base (155)..(155): a, c, t, g, unknown or other
  misc_feature (155)..(155): n is a, c, g, or t
  modified_base (191)..(191): a, c, t, g, unknown or other
  misc_feature (191)..(191): n is a, c, g, or t
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttgggganatcgtgatgacgcagtctccagccatcctgtctgtntctcgagggganagacgcccacctctcctgccagggccagtcaagacagttgganctaacttgccgtacggtaaccaaacgaaaaccgtggaccacgaccctaccacgacctcctactatttactccgttacactcccaccgacggccactcgactccgacccaacgtagtattcgaggtcggactagggtacgggtcgagggaactacggtaccttacgacgtccctaccaacctacgtccgaacggaccgtacggtacgtaaccggtacgttacgtaacggaacgttacgttacgggtaaccctttaaggttttaaccgttaccgtagttaacccgaaacgttaggttacggttagggttacctacgggtccgggttaacccgtaaccgggttaacccgggttacccggtaacccggaacgggtaccgaacggttacgggtaacggtacgtaccgtacgggaaccgggtaccgtaaacgggtcgggtacgtaccggtccgtaacctacccgtagttcccttaaggttcccttaaccgg

SEQ ID NO: 90948 - DNA, 823 bp, Homo sapiens
  misc_feature: GYAE6OF01DH4KR.5.57.F02.1.454.CMB.1.raw
  modified_base (205)..(205): a, c, t, g, unknown or other
  misc_feature (205)..(205): n is a, c, g, or t
tcagatcagacacgcacgaccggtgctcgatttagctcgatataggttggggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganacgacgcccaccctctcctgcgacgggccagtcaagaactagtttggaacgtcctaacgttacgccgttacggtaaacccaaaaccgaaaaaccgtcggaacccacgaccctacccaacgaccttcctactaacttttataccgttacaccgtaccgaccgacgggtaccctacgtcggaacttaccgtacccaaccgtaagtcttacaggtcggacgtaagggtacgggtccgtagggaaccgtacgtacctttacgacggttccctaccgtaaacctagtaccgacggtacctaacggttaccggtaaaccgtacggttaacgttaacgggaaacgttaaccgtttaggggtaacttttaacgggttttaacgttaaccggttacgttaaacctaaaccggtttaaagttcggggtttaacggttaccgtaacgggttcgggttaaccccgttaccgggttaaacccgggtttcccggaaaccccggttacggggacccttaaggggtaccggttaagtacggttaaccgtacggggaaacggttcccggtaaacgtttcgggaccggtccgttaaccggtccaaccgttacgtttcgtcccgttaccgttacccg

SEQ ID NO: 90949 - DNA, 551 bp, Homo sapiens
  misc_feature: GYAE6OF01EQJWQ.5.57.F02.1.454.CMB.1.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccaggggganagagcccaccctctcctgccagggccagtcagaacnttggancaacttgcctaggtaaccaacaaaaacctggccagcctcccagacctcctctatttatcgttcactccaccgagggccactgactcgtacccaacagattcagtgcaggnggtcngggacagactcagtctcacatcagcagcgtacagtctagaacgtacgttgactagtttactacgtgtacaatagtgtgtcgtaggtcggtaccctacggtaaccggttccggacccgtacgggaccacgtaggtcggatacgtcgaacggacgtaacgtcggtacggctcgacctacatcgttgtcttacg

SEQ ID NO: 90950 - DNA, 729 bp, Homo sapiens
  misc_feature: GYAE6OF01AWPO9.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccaccctctcctgcgacgggccagtcagaactagttggacgctaacttggcccttacggtaacccaaacgaaaaaccctcggacccaacgccctacccgaagtacccttcctctacgtttacgtccgtttaccaccttacccaccgtacgggacccctaacgtcgtaacgtccgtaaccccaaacccgtagtacttacgaagggttacggaccgagggtacgggttacgtacggggaactacggtacctttcgacggttacctcgaacctataccgaacggtcaacggtaccgtaacgtaggttacctaaggtaaacgtcggttacggtactttaagtttacttacgtacgtaactaacgtagttggtacgtgtacggtacggtcccgttacgggtaaccggttccgggaacccgtagggaccctaagtacgggtacgaacgtacgtacggaccgggtacgtaacggtggttaccgggcgttaccgaaccctaccgttagttccgttcgtccctttaaccg

SEQ ID NO: 90951 - DNA, 573 bp, Homo sapiens
  misc_feature: GYAE6OF01CGNO9.5.57.F02.1.454.CMB.1.raw
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggancaacttgcctggtaaccaacaaaaacctggaccagcctacccagacctcctcatttatcgttcactccaccacgggccactgatcgtacccaaccagacttcagtggcaggagggtctgggacagtacttcagtctcaccatcagcagcgtacagtctagaagtcttggcttagtttattactgtacaactagtcgtgtcaggtcgcctacggtaccgttcggacccgtagggacccagtacggtaggacttacgtacggacgggtacggaacttcgggtcggtccttacgggaccctaacccgtagtttcccgttggttccctttacccg

SEQ ID NO: 90952 - DNA, 882 bp, Homo sapiens
  misc_feature: GYAE6OF01CYJGW.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagactaccgttgggganatcgtgatgacgcagtctccagccatcctgtctgtgtctccgagggganagacgccaccctctcctagcagggccaggtcaagaactagttggagctaacgttagaccttaggtaaacccaaacgtaaaaaaccgtcgggaccctaacggacccttaccccgaacgtaacccttacccgttacttaactttttaacgttacccgttttaccaaccttaccccgaaacccgacggggtaccctaacgttcggtaacttaccggtaacccccaaaaccgtaggtaaccttttcgaaacgggttcggaccgaacgggtaacggggttaccgtaggggaacctaacgggtaacctttccgtaacggttacccttaccgaaaccgtaacttacccgacgtaccgaacggttcccggtaacgtacggttaaccgtaggtaaacggttaacgtttacgggtaactttaacggtttttaattacccgttagttaaccgtaaaccgttaaggtttacgggtacggtttacgtaaacgggttccggtaacccggtttaaccgtaacccgggtttacccgggaaccccgtaacgggggaacccccttaaggtaacgggttaacggaaacgtttaaccgtaccggtaacgggttaacccggtaaacggtttcgggtacggtacccgtttagggaccccttaaaccgttacgtttaaccgttccgttacccgtttaacccg

SEQ ID NO: 90953 - DNA, 595 bp, Homo sapiens
  misc_feature: GYAE6OF01EJFFZ.5.57.F02.1.454.CMB.1.raw
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (566)..(566): a, c, t, g, unknown or other
  misc_feature (566)..(566): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgcccaccctctcctgcagggccagtcaagacnttggtancaacgttgcctaggtaaccaaacaaaaaccgtcggaccacgcctacccagtacctcctactattttactcgttacactaccgaccgacgggccactgactcgtacccaacagatcagtcgcaggaggtcgaggacgagtacctcacgtcctacacctagtcagaccagccgttaacagtctagatacgtgaccgttatttactacttagactaacgtagttcgtacgtcgtaggtcgtaccgtacgggtaaccgttccgggtacccgaacgggtacccaagtcggtaggtactagtacgaacggcgtaacgttcggacgtntccgacctactaccttcgtcgttctaccg

SEQ ID NO: 90954 - DNA, 793 bp, Homo sapiens
  misc_feature: GYAE6OF01BQYZH.5.57.F02.1.454.CMB.1.raw
  modified_base (153)..(153): a, c, t, g, unknown or other
  misc_feature (153)..(153): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatccctgtctgtgtctccgaggggagagacgcccacccgtctcctgcgacgggccagtacagaactagttacggagacaacgttcgacctacggtaaccaaacaaaaaccgtcggaccacgccctacccagtacctcctctatttactccgttcactaccaccgacggccctacgtacgactaccgtaccccaaccgaagtacttcgaacgggttcgacggaagggtacggggttaccgtacggggaactaacggtacgttaccgaacggttccttacccgtaacccgtacttaccgaacggaccgtaacggtaccgtaaccgtaggttacccgtaaaggtaaaccggttacgtttacgggaacgttttaagggtttttaaccttaacgttaccgttaaacctaacgttaaggtttaggtaccggtttacgtaaccgggttaccggtacccgttaccggggttaacccgttacccgggacccggtaacggggtacccaacggttacgggttacggtaaacgttaacgtaccgggtaaccgggtaccggtaaacggttccgggtcgtaccggtaccggtacccgtacgttaagttcccttaggtttcccttaacccg

SEQ ID NO: 90955 - DNA, 688 bp, Homo sapiens
  misc_feature: GYAE6OF01BD5Y9.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggagcaacttgcctaggtaaccaaacaaaaacctggaccacgacctcccaagaacctcctacatttactcgttacactccaccgaggccactgactcgtacccaacagacttacacgtacgcgaggacgggttctacggggaacagtaccttacgacgtccctacgaacccaattcgaacggacaagaccggttaactacggttacctaaggtaaacggtaactttcgggaccgttaagtttttaactacgttaggtactaaacgtaatttacgggtcgtaactacggttccggtaaccgtccggtaaaccggttccgggtaccccgaacgggggtacccaagggtaacgtacgggtaacttaacgtaccgtaacggggtaacgtaacggttcggttaggaccgttacggtacccaaccctaggttaccctttggttaccgtttaacccg

SEQ ID NO: 90956 - DNA, 527 bp, Homo sapiens
  misc_feature: GYAE6OF01DY8RE.5.57.F02.1.454.CMB.1.raw
  modified_base (201)..(201): a, c, t, g, unknown or other
  misc_feature (201)..(201): n is a, c, g, or t
  modified_base (244)..(244): a, c, t, g, unknown or other
  misc_feature (244)..(244): n is a, c, g, or t
  modified_base (498)..(498): a, c, t, g, unknown or other
  misc_feature (498)..(498): n is a, c, g, or t
  modified_base (506)..(506): a, c, t, g, unknown or other
  misc_feature (506)..(506): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgccagggccagtcaagaacattggancaacttgcctggtaccaaacaaaaacctggccagcctccagactcctcatttatcgttcatccaccagggccactgatcgtacccaaccagattcagtggcaggagggtctgggacagtacttcgagtctcaccatcagcagcgtacagtcagaagacttggactagtttattactgtacaacgtaattggtgtcaggttcggccgttacgtaacgttcggcccgaagggtaccaacaggtgactagtcgaggngaacgtgngtctgcaccatctgtcgttac

SEQ ID NO: 90957 - DNA, 606 bp, Homo sapiens
  misc_feature: GYAE6OF01AWA2E.5.57.F02.1.454.CMB.1.raw
  modified_base (237)..(237): a, c, t, g, unknown or other
  misc_feature (237)..(237): n is a, c, g, or t
  modified_base (589)..(589): a, c, t, g, unknown or other
  misc_feature (589)..(589): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagcccaccctctcctgcagggccagtcagaacnttggagcaacttagcctaggtaaccaaacgaaaaaccctggacccacgccctcccaagcctcctctatttactccgttcactccaccgagggcccactgactcgtaccccaacagtacttcaggtcgacgaggtacggggtccgtagggaacctaggtacgttcagtcctacaccatcagccgagcgtacagtcgtagaaacgtcgttggtactagtttactactagtacaatagtgtacgtcaggtcggtaccgttacggtaaccggtttccggacccgtaacgggtacccacgtaggtcggaatacgtaccgacgggtacaacggtggtcgaccgtacgccgaacccgtntccgttgttcccgttac

SEQ ID NO: 90958 - DNA, 574 bp, Homo sapiens
  misc_feature: GYAE6OF01BDUB7.5.57.F02.1.454.CMB.1.raw
  modified_base (244)..(244): a, c, t, g, unknown or other
  misc_feature (244)..(244): n is a, c, g, or t
  modified_base (373)..(373): a, c, t, g, unknown or other
  misc_feature (373)..(373): n is a, c, g, or t
  modified_base (385)..(385): a, c, t, g, unknown or other
  misc_feature (385)..(385): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagcccaccctctcctgcagggccagtcagaacattggtancaattagcctggtaacccaaacaaaaaccctggccaacgcctcccaagacctcctactatttactcgttcatcccaaccgacgggcccactgactcgtacccaaccagtattcgagtggcaggaggtcngggacagtactnacgtctcacatcagcagcgtacagtctagaagtcttaggctaagttttatactgtacaagtatcggtgtacaggtcgtacctacggtaacgtttccggacccgaacgggaccacgtaggtacggtataacgttcgaaggaccgtaacgtcggtaccggcttacggactaccagttctacgttcttaccg

SEQ ID NO: 90959 - DNA, 690 bp, Homo sapiens
  misc_feature: GYAE6OF01D4NBP.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgcccacctctcctgcgagggccagtcaagaactagttggagctaacttacgcctacggtaaccaaacgaaaaaccgtggaccacgaccctcccgaagtaccttccctacttaacttttactccgttacaacctcccgaacccgtacgggacccactagtaactccgtaccccaacagtacttacgacggtacggacagggtacgggtcgtacggggacacgtacttacacgtctacgacctactacgacgtccgaacgtccgtaagtacgttactaaggaacgttacgttacgggactttaacgtttacttacgttacgtaactaacgtaagttcgggttacgtacgtagggtaccggtacccgttaccggtaaccgggttccgacccggtaaggaacccgagtaggacggtataaccgtcggacgggtaccaaggttcggtacggactacgcctacgagtttccctaggtttcccttaaccg

SEQ ID NO: 90960 - DNA, 513 bp, Homo sapiens
  misc_feature: GYAE6OF01CZWJ5.5.57.F02.1.454.CMB.1.raw
  modified_base (496)..(497): a, c, t, g, unknown or other
  misc_feature (496)..(497): n is a, c, g, or t
  modified_base (499)..(513): a, c, t, g, unknown or other
  misc_feature (499)..(513): n is a, c, g, or t
tcagatcagacacgcacgaccggtgctcgatttagctcgatatagttgggtttggggggaagaggaagactgacggtccccccaggagtccagagtgcgtcgcaagtattggcagtgtgaaattttgacaccttatatgcagactctgtgaggggccgcttcaccgtgtccagagacaactccaagaacgccgtctatttgcagatggacagcctgagagtcgacgacacgggcatctattattgtacggcggccgagcaatactctctttactttctggagtcagggagtccccggtcactgtctcctcagccctccaccgaagggcccagtccggtccttccccctggccaccctcctccaagagccaccgtcgtggggccacgacggccgggccctggggcctcggcccgtgggtccgaaacggtccttaccgtttccccgtcgttcttgacttcgtggaggccgggtcgtggccgaagggccgactagtagnngnnnnnnnnnnnnnnn

SEQ ID NO: 90961 - DNA, 687 bp, Homo sapiens
  misc_feature: GYAE6OF01B7JDN.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtcctccgagggganagacgcccaccctctcctgcagggccagtcagaactgttggagctaacttgccgtaggtaacccaaacaaaaaccctggacccacgccctacccagacctcctactatttactccgttacactccccaaccgacgggaccctaacgtcgtactaccggtaaccccaaaccgagtacgtttacgagggtcggacgtaacgggtaggggttcgtaggggaactacgtacctttacgacgttcctacgacctactacaacggtcaacggtaccgttaaccaggttaccgtaaggtaaacgttacggttggtacttaaggttttacttacgttataccaagtaagttcggtagtcgacggttcggtaccgtacggtaccggttccggacccgtacgggacccgatagggtacgtaactacggtacgaaccgggtgtaaaccgtgggttacgccgttcgaccctaccgtacttcggtctttccgttacg

SEQ ID NO: 90962 - DNA, 509 bp, Homo sapiens
  misc_feature: GYAE6OF01EFBWZ.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (432)..(432): a, c, t, g, unknown or other
  misc_feature (432)..(432): n is a, c, g, or t
  modified_base (500)..(500): a, c, t, g, unknown or other
  misc_feature (500)..(500): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagagcccaccctctcctgcagggccagtccaagaacngttggtancaacttgcctggtaccaacaaaaacctggccagcctcccagactcctcatttatcgttcatccaccagggccactgactcgtacccaaccagattcagtggcagagggtctgggacagacttcagtctcacatcagcagcgtacngtcngaatcttgctagtttatctgtacaactatgtgtcngtaggctacggtaacgttccggacccgaggaccacaggtgatagtcgaggtcaagtcgtggctgcacntctgtctcg

SEQ ID NO: 90963 - DNA, 759 bp, Homo sapiens
  misc_feature: GYAE6OF01BKM89.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgccaccctctcctgcgagggccagtcaagaactagttggtacactaacgttagccgtacggtaacccaaacaaaaaccgtggaccacgccctacccagtacctcctactaactttactcgttccactcccaaccgtacggcctactacgactccgtaccccaaacctagtaacttcgacggttcggacgtaacgggtacgggtaccgtacggggaacgtaacggtaccgtttaccgacgttacccttaccaacccgtacgttccaaacggcccgtaacggtacccgttaaccgtagttacccggttaaggaaaacgttaccgtttcgggaccgtttaaggttttactttaaaccgtacggttaaacccaaacgttaaacgtttcgggtaacgggttacctaggggttaccggtaccccggttaaccgggtaaccggtttcccgggaacccgtaacggggtaaccctacggacggttacggaaccttacgtaccggaacggtaccgacgttcgggacggcgttacgtccgtacctatccgttcggtcttacccg

SEQ ID NO: 90964 - DNA, 564 bp, Homo sapiens
  misc_feature: GYAE6OF01ACF4C.5.57.F02.1.454.CMB.1.raw
  modified_base (245)..(245): a, c, t, g, unknown or other
  misc_feature (245)..(245): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggggagatcgtgatgacgcagtctccagccatcctgtctgtgtctccgaggggagagagcccaccctctcctgcagggccagtcagaacattggtancaacttagcctggtaccaacaaaaacctggccagcctcccagactcctcatttatcgttcatccaccagggccactgactgtaccccaaccagattcagtcggcaggagggtctgggacagacttcagtctacacatcagcagctacagtctagaacgtcttggctagttttatactgtacaactaatgtggtacagtcgcgtacgaacgttccggaccctagggacccagtaggtggaatacgttacgaagggtaccgtaaacgttcgggtacgggtacgtacggacccaccgtaacttccgttggttccctttaccg

SEQ ID NO: 90965 - DNA, 742 bp, Homo sapiens
  misc_feature: GYAE6OF01CVQ7G.5.57.F02.1.454.CMB.1.raw
  modified_base (204)..(204): a, c, t, g, unknown or other
  misc_feature (204)..(204): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgcccaccctctcctgcgaggccagtcaagaactagttggtagactaacgttacgcctacggtaaaccaaaacaaaaaccgtcggaccaacgccctacccacgacctcctactatttactcgttacactccaccgacggccctatgtactcgtaacccaactagtacttcgacgtggacgaggtagggtccgtagggactaacgtacttaccgagttcctaccaaccgtactacgacgaccgtaacggtaccgtaacgtacggttacgtaaggtaacgtacgtttacgggtacttaagttttaacttacggttacgtaactaaacgttagttcggttaggtacgttaacggttccgggtacccgttaacggggtaacccggtttacccgggaacccgtaaccggggtaacccaacgggtaacggttaggtaaaccttaacggtaccggtaacgggacccggttaaacgttcggggttaccgtaccgtacgtaacccgttaacccgtagtttcccggtcgttacccgtttaacccg

SEQ ID NO: 90966 - DNA, 609 bp, Homo sapiens
  misc_feature: GYAE6OF01D3KI2.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
  modified_base (248)..(248): a, c, t, g, unknown or other
  misc_feature (248)..(248): n is a, c, g, or t
  modified_base (301)..(301): a, c, t, g, unknown or other
  misc_feature (301)..(301): n is a, c, g, or t
  modified_base (595)..(595): a, c, t, g, unknown or other
  misc_feature (595)..(595): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtcgtctccgagggganagacgccctaccctctcctgcacgggccagtccagaacattggancaacgttagcctaggtaaccaaacaaaacctggaccagcctaccagactcctntacttactcgtcactccacgacggccactgactcgtaccaacagtacttcgagtcggactaggacgggtcgtagggactaacgtacttcgacgtcctcgaaccgtatacgacgtacaacgtccgtaacgtcgttacgtagaaagtacgttagggacttaagttttacttacgttggtaacaaacgtagtcggtaggtactaacggtcggtaccgtacgtacggttccggacccgagggaccacgagtaggactacgtcgacggacgtaacggtgacggtctacggtcaaccctnttcctgttcctacg

SEQ ID NO: 90967 - DNA, 704 bp, Homo sapiens
  misc_feature: GYAE6OF01C37ZP.5.57.F02.1.454.CMB.1.raw
  modified_base (155)..(155): a, c, t, g, unknown or other
  misc_feature (155)..(155): n is a, c, g, or t
  modified_base (210)..(210): a, c, t, g, unknown or other
  misc_feature (210)..(210): n is a, c, g, or t
  modified_base (549)..(549): a, c, t, g, unknown or other
  misc_feature (549)..(549): n is a, c, g, or t
  modified_base (561)..(561): a, c, t, g, unknown or other
  misc_feature (561)..(561): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagattaccggttgggganatcgtgatgacgctagtcctccagccatcctgtctgtcgtccgtccggagggganagaccgtcccaccctctccgtgcgacgggccaggtacagaactagttggacgactaacgttacggaccttaacggtaaacccaaaaccgtaaaaaccgtcgggaacccaacggtcccctacccgaacgtacccttacccttacttaaactttttaacgtcccgttaccaaccgttacccgacccgtaacgggtaccctacgttacggtacttacccggtaacccccaaacggtacttaacgttacgaggtacgggaccgaagggggttacggttcggagggaactaacgttaccgtacgtacgttcctaccaacctagtaccagcctaacggccgttanacgtgaacgtanacgttagacttaggttactacgtgtaaccagtagttcgtacgagtacgtcggtcctaaggtcccgtacggacgtacgactacgaggtcacgtacgacgacggtagtacgtcggtacggctccgacactagttctgttcctacg

SEQ ID NO: 90968 - DNA, 677 bp, Homo sapiens
  misc_feature: GYAE6OF01CFMLH.5.57.F02.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (429)..(429): a, c, t, g, unknown or other
  misc_feature (429)..(429): n is a, c, g, or t
tcagatcagacacgcacgaccggtgctcgatttagctcgatataggttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagacgccaccctctcctgcagggccagtcagaacnttgganctaacttagcctggtaccaacaaaacctggaccagcctacccagacctcctacatttactccgttactactccaccgagggcccacgtgactccgtaccccaacctagacttcgaggttcggctaggacggttcgtagggactacgtacttcgacgtcctaccgacctatacagcacgtcgtaacngtctaggaacgtacgttggacttagtttaacttacgtacgtactaacgtattggtacgtacgtacggttacggtcccttacgggtaaccggtttcccgggacccgtaaggggtaccccaacggtacgggttacgggtaacgttaaccggtaccggtaacggggtacccggttaaacggttcgggtaccgggtaccgttaccggaccctacccggttaactttcccgttaccggtttcccgtttacccg

SEQ ID NO: 90969 - DNA, 526 bp, Homo sapiens
  misc_feature: GYAE6OF01B07P9.5.57.F02.1.454.CMB.1.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagacnttggancaacttgcctggtaccaacaaaacctggccagcctcccagactcctcatttatcgttcatccaccagggccactgactcgtcccaacagattcagtggcagagggtctagggacagtacttcagtctcaccatcagcagcgtacagtctagaagtcttgactagtttatactgtacaactatgtggtcagtcggtcctacggtaaccgttccggacccgagggaccacgaggtaggatatacggacggacgtaacgtggtaggctcgaccaccatctcgtcttcg

SEQ ID NO: 90970 - DNA, 875 bp, Homo sapiens
  misc_feature: GYAE6OF01DDG46.5.57.F02.1.454.CMB.1.raw
  modified_base (154)..(154): a, c, t, g, unknown or other
  misc_feature (154)..(154): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccgttgggganatcgtgatgacgcagtctccagccatcctgtctgtgtctcgaggggagagacgcccacctctcctgcacgggccagtacaagaactagttggtaacgctaacgttagccgtacggtaaaccaaaccaaaaaccgtcggaccacgtccctacccacgacctcctctaattttactccgttacactcccaaccgacgggccctacgtgactccgacccaacagtacttcgaggtcggacgtaggacgggtcgtagggaactacgtacttcgacgtcctaacgacctaactcgaacggctaacggtccgttaaaccgtacgttacgtaaggtaaacgttacggtttacgggtaacccgttttaagtttttaaccgttaaccgtttaacggtaacccttaaaacggtttaaacggtttacgggtttacggggttaaccgtaacggggtttaccggggtaacccccgttttaaaccgggggttaaccccggtttaccccgggggaacccccgggttaaacggggggtaaccccctaaaacggggttaacgggtttaacggggtaaccgttaaaccgttaacccggggaaaacggggggttaacccccggtttaaacggtttcggggggttacccgggtaaccccgggtttaccgggtaaaccccgttaaaccccggtttaggttttttaacccccggtcgggtttttaaccccctttaaaccccgg

SEQ ID NO: 90971 - DNA, 568 bp, Homo sapiens
  misc_feature: GYAE6OF01B7JPQ.5.57.F02.1.454.CMB.1.raw
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctctcctgcagggccagtcagacnttggancaacttgcctggaccaacaaaacctgccagcctccagacctcctcatttactcgttcactccaccgagggccactgactcgtacccaaccagtacttcaggtcggacagggtagggtcgtgggaactagtacttcgacgtcctcaccatcagcagtcgtactagtctagaacgtcgttggacttagtttacttacgtgtacaacgtaagttggtagtcgtaggtcggtaccgtacggtaaccggttccggacccgtagggacccaacgtggtacgatacgtcgacggtacgaacgtggcgtcgtacgccgtacattctgtctaccg

SEQ ID NO: 90972 - DNA, 766 bp, Homo sapiens
  misc_feature: GYAE6OF01CUATP.5.57.F02.1.454.CMB.1.raw
  modified_base (158)..(158): a, c, t, g, unknown or other
  misc_feature (158)..(158): n is a, c, g, or t
  modified_base (208)..(208): a, c, t, g, unknown or other
  misc_feature (208)..(208): n is a, c, g, or t
  modified_base (753)..(753): a, c, t, g, unknown or other
  misc_feature (753)..(753): n is a, c, g, or t
tcagatcagacacgcacgaccggtgctcgatttagctcgatataggttgggtttgggggaggaactgctcagttaggacccagacggaaccatggaagccccagcgcagccttctcttcctcctgcctactctggctcccagactaccggttgggganatcgtgatgacgcagtctccagccatcctgtctgtcgtctccgagggganagacgtccctaccctctccgtggacgacgggccctagtaccaaggtaactagttgggaacaccttaaacgttacggcccgttaacggtaaacccaaaacgtaaaacccgtgggacccaaccggcccttacccgaagtacccttacctaccgttaattttaccgtaccgttacctaaccttacccgaaccggtaccgggtaccctaacgttacgaaccgttacccggaacccctaaaccgtaggtaccttacgcggttacggacgaacgggtacgggtccgtagggaacctagtaccgttacgtaacgtccctaacgacctacgtacgaacgcgtaacgtacgtacaggttacgagtaaccggtacgttggtaacttacgtttaagttactacgtaactaaaccggtgttacggtacgtacgttacggaccggtcccgtaacgggttaccgtccggaaccgtacggaccgtagtacgtagaccttacggacgtaacgggacgttactgggttccggcttacggaacccctcgtaatttcccggttnttcccgttacccg

SEQ ID NO: 90973 - DNA, 560 bp, Homo sapiens
  misc_feature: GYAE6OF01BE20P.5.57.F02.1.454.CMB.1.raw
  modified_base (202)..(202): a, c, t, g, unknown or other
  misc_feature (202)..(202): n is a, c, g, or t
  modified_base (250)..(250): a, c, t, g, unknown or other
  misc_feature (250)..(250): n is a, c, g, or t
  modified_base (323)..(323): a, c, t, g, unknown or other
  misc_feature (323)..(323): n is a, c, g, or t
  modified_base (396)..(396): a, c, t, g, unknown or other
  misc_feature (396)..(396): n is a, c, g, or t
  modified_base (409)..(409): a, c, t, g, unknown or other
  misc_feature (409)..(409): n is a, c, g, or t
  modified_base (458)..(458): a, c, t, g, unknown or other
  misc_feature (458)..(458): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
tcagatcagacacgcacgaccggtgctcgatttagctcgatataggttgggtttgggggaggaactgctcagttaggacccagacggaaccatggaagccccagcgcagcttcccttctcctgctactctggctcccagataccgttggggagatcgtgatgacgcagtctcagccatcctgtctgtgtactccgagggganagacgcccacccgttctccgtgacagggccaagtcagaacattgggancaacttagcctggtaaccaaacgaaaacctggccagccctaccagacctcctcatttatcgttcatccaccgnggcctactgactcgtacccaacagacttcagtggcaggtacggctcgggacacggtcttcgagtcgacactanctagcagcgtacngtactagaatcgttggactagtttatacgtgtaccaatacgtgtgtacngtcgctacgacgttccggccaaggtccanaggtnatacgcgtaggaccgttagtcggtggaccttcggacctaaccgtattccgtcgttccttccgtaaccg

SEQ ID NO: 90974 - DNA, 681 bp, Homo sapiens
  misc_feature: GYAE6OF01BCJD5.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctcctctgcgacggccagtcaagaactagttaggtacgactaaacgttacgccgtacggtaaacccaaaacctaaaaacccgtcggacccacggtcccctacccgaacgtacccttcctacttaattttacgtccgttacacctaccccaaccggacgggaccctacgtgtacttccgtaaccccaaaccagttacttacgaggtcggacgagggtacgggttcgtacgggacgaacgtaccttacgacgttctaccacctatacgacgcgacggtacctaacgacgttcgtaaggaacgttacgttggactttaagttttacttactacgtaaccaagttagttggtacgtacgtaggtccggtaccgtacggtaaccggttccgacccggtacggaccacgtaggtacggtatacgtacgacggtacgtacgtggtcggtctcgacctacgtattccgtgttcttaccg

SEQ ID NO: 90975 - DNA, 582 bp, Homo sapiens
  misc_feature: GYAE6OF01A4P7D.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttgcctggtaccaacaaaaacctggccagcctcccagactcctcatttatcgttcatccaccagggccactgatgtccccaaccagattcagtgcagagggtctgggacagactcagtctcaccatcagcagcgtacagtctagaagtacttggctagtttacttactcgtacaactaattgtggtcaggttcggcccgttacgtaaccggtttccggaccccgtacggggacccaaccgtaggtacggattacgtaccgaacgggtacgtaaaccgttgggttcgggaccttacggacccgtaacccgatttcccgtggtttcccgtttaacccg

SEQ ID NO: 90976 - DNA, 654 bp, Homo sapiens
  misc_feature: GYAE6OF01DXW9T.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagacgccaccctctccngcagggccagtcagaacattggancaacttgcctaggtaccaaacaaaaacctggaccagcctcccagacctcctctatttatcgttcactccaccgacgggccactgatcgtaccccaaaccagacttcagtggccaggagggtcgtgggacagacttcagtctacaccatcagcagaccgtacagtctagaagtacgttggaccttaagttttactttacgtgttacaaactaagttcggttagggtactagggttcggaccccgttacgggtaaacccggtttccgggaccccgtaacggggaaccctaaccggtaacggttagggtaaacgttaacgttaccggaaacggggtacccggttaaacggttgggttaccgggtcccgttacggtacctaaccccgttagttcccttaggttcccttttaacccg

SEQ ID NO: 90977 - DNA, 713 bp, Homo sapiens
  misc_feature: GYAE6OF01C0IXW.5.57.F02.1.454.CMB.1.raw
  modified_base (154)..(154): a, c, t, g, unknown or other
  misc_feature (154)..(154): n is a, c, g, or t
  modified_base (205)..(205): a, c, t, g, unknown or other
  misc_feature (205)..(205): n is a, c, g, or t
  modified_base (220)..(220): a, c, t, g, unknown or other
  misc_feature (220)..(220): n is a, c, g, or t
  modified_base (258)..(258): a, c, t, g, unknown or other
  misc_feature (258)..(258): n is a, c, g, or t
tcagatcagacacgcacgaccggtgctcgatttagctcgatataggttgggtttgggggaggaactgctcagttaggacccagacggaaccatggaagccccagcgcagcttctcttcctcctgctactctggctccagataccggttgggganatcgtgatgacgcagtctccagccatccgtgtctgtcgtctccgaggggancgacgccctacctcnccgtgacgagggcctaggccaagaactagtttggaacnctaaactttaggcccttaggtaaacccaaaccaaaaaaccgtcggaccacgcctacccaagacctcctctaatttacgtcgttccactccaaccgacgggaccacttacgacttaccgaccccaaaccgtatattacgaggttacggcaagggtacgggttacgacggggaacacgtacttcgtacggtcctacaaccactacgacgcaacgtcgttaaccgaggtacctaaggaaagtaccgtttagggtaacctttaagttttaacgtttacgactaaccgaaacgtaacgtttgtacgggtaccctaagggttccgtcccgtaaaccgggttaaccggttcccggacccggaaccgggaacccgtataacggtggtaaacgtacgttccgaaacgggtacgaaccgttggtcggtacgtacgaccgtacctaaggtccttcgttcttacccg

SEQ ID NO: 90978 - DNA, 818 bp, Homo sapiens
  misc_feature: GYAE6OF01DK1ZY.5.57.F02.1.454.CMB.1.raw
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgcccaccctctcctgcgacgggcagtcaagactagttggagactaacgttacgaccgtacggtaaccaaaccaaaaaccgtcggaccacgccctacccaagaccttcctactatttaactccgttacactcccaccgacggccagtgactccgtacccaaccagacttcgaagtggacgtaggtagggtcgaggggtacaacggtaccttacgacgttacctaccctaaaccattaccgaacgggacctaaggtacccggttaaaccgtacggtaccgttaagggtaaacggttaaccgttttacggggacctttttaaaggtttttaacgtttaacccgttaggaaacccttaaacgtaaggttttacgggtacgggttactaacgggggtacggttacccccggttaaagggttaaccccgggtttaccgggaaccccccggttaagggggtaaacccccgtaaacggtaacgggtttacgggtaaaccgtttaaacgttaaccgggaacccggggttaaggtaacccggttgggggttacccggacccgtttacgggaacccttaacccggtaaccttttccggtcgttttaccccgtttaaacccgg

SEQ ID NO: 90979 - DNA, 751 bp, Homo sapiens
  misc_feature: GYAE6OF01BDNVD.5.57.F02.1.454.CMB.1.raw
  modified_base (153)..(153): a, c, t, g, unknown or other
  misc_feature (153)..(153): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagacgcccacctctcctgccgagggccagtcaagaactgttggagaccaacttacgtcctacggtaaccaaacaaaaacccgtggacctacgccctacccgacgtacctcctactaacttttactaccgtttaccacgtccccaaccgtacgggccctacgtacgtactccggtaccccaaactagtacttcgaacggttcggacgtaagggtacgggtcgtagggaaccagttaccgtacgtacgtacctaccgtaacctacgtaccgacggtacacgtaccgttaacgtacggttacgtaagtaaacggttaccgttcggtaacgtttaacgttttaactttaaccgttacgtaactaaacgttagttcgggtacgggttaccgtaaggtacccggtacccggttacgggttaaacccgggttccggaaccccggaacgggtacccgaacggtaggtacggtaacttaacggaccgtacgggaccgttaaccgtgggtaccggtacgttacgacctaaccgttagtccgtttcgttccggttaaccc

SEQ ID NO: 90980 - DNA, 808 bp, Homo sapiens
  misc_feature: GYAE6OF01B0G5D.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (254)..(254): a, c, t, g, unknown or other
  misc_feature (254)..(254): n is a, c, g, or t
tcagatcagacacgcacgaccggtgctcgatttagctcgatatagttgggtttgggggagaactgctcagttaggacccagacggaaccatggaagccccagcgcagcttctcttcctcctgctactctggctcccagactaccggttgggganatcgtgatgacgcagtctccagccatcctgtctgtcgtctcgagggganagacgcccaccctctcctgccgacgggccagtcaagaactagttgggtacnctaaacgttcgcccgttacggtaaacccaaaaccaaaaaaccgttcggaacccaccgtaccctaccccgaacgtacccttacccttacttaacttttaacttccggtttaccaacttccccgaacccggtacggggacccctaacgttcggtaaccttaccgggtaacccccaaaccgtaacgggtaccttttacgaacgggttcggaaccgtagggtaacggggtccggtagggtaaccaaggtaccttcgtacgttcctaccgtaacctaccgtacgacgtacgtacgtacccggtactacggttactacggaaacggttacgtttgggacttaacgttttacttaaccgtagtaaccgtaaactaaggtttcggtagttaccggtaaggtttaccgggtacccctttaaccgggtaacgggttaccccggaaccggtaaccgggtaaccgaacggttacggtacgggtaccttaacggtccgaaacgggttacccgtaaggttcggtacggacgttacggaccttaccgtacgttccttcttcgttacccg

SEQ ID NO: 90981 - DNA, 973 bp, Homo sapiens
  misc_feature: GYAE6OF01BS2HG.5.57.F02.1.454.CMB.1.raw
  modified_base (152)..(152): a, c, t, g, unknown or other
  misc_feature (152)..(152): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagcccagcgcagcttctcttcctcctgctactctggctccagactaccggtgggganatcgtgatgacgcagtctccagccatcctgtctgtcgtctccgagggganacgacgccctacctctcctgcgacgggccaggtccaagaactagttgggtaacacctaaagttcgaccgtacggtaacccaaaaaccgtaaaaacctgggaccctaacggcccctacccgacgtacccttccctacttaacgttttactccgtttaccaccttaccccgaaccggtacgggaccctaacgtcgtaacgtccgtaccccaaaccgtaaggtcttacggagttacgggactaacggggtacggggttcgtacgggggtaacctaacggttaccgtttaccggtaaacgggtttccccttaaaccggaacccgtaacgtttaccgggaaaccggttaccgaacgggggtaacccgttaaaccgtacgggtttaacgtaaacgggggttaaaaccgtttaaccgggtttacggggttaaaccccgttttaaaggtttttttaaaccgtttaaacccggttacgggtttaaaaccctaaaaccgggttaagttttccggggttaaccggggttaccgttaaacgggggttcccgggtttaacccgttaaaccccgggggtaaacggggttttcccccgggaaaccccggggtaacgggtaaccccggtaacggttaaaccgggttaggtaaacccgtttaaggttaacccggggaccggtaaacccgggttaacgggttcgggggtaaacgtccccggtttaaaccgggacccgttaaacccgttgttttaaccccggtttacgggtttcccccttttaaacccgg

SEQ ID NO: 90982 - DNA, 465 bp, Homo sapiens
  misc_feature: GYAE6OF01E207T.5.57.F02.1.454.CMB.1.raw
  modified_base (451)..(465): a, c, t, g, unknown or other
  misc_feature (451)..(465): n is a, c, g, or t
tcagatcagacacgcacgaccggtgctcgatttagctcgatatagttgggtttggggggaagaggaagactgacggtccccccaggagtccagagtgcgtcgcaagtattggcagtgtgaaatttgacaccttatatgcagactctgtgaggggccgcttcaccgtgtccagagacaactccaagaacgccgtctatttgcagatggacagcctgagagtcgacgacacgggcatctattatgtacggcggccgagcaatactctcttactttctggagtcagggagtcccggtcactgtctcctcagcctccaccaagggcccatcggtcttccccctggccacccctcctccaacgacgcacctcctcgggggcacgacgcggccctgggctcgcctggtcaaggactactccgtgtctgatctgacgcgggcgtggcaggcgcatagnnnnnnnnnnnnnnn

SEQ ID NO: 90983 - DNA, 954 bp, Homo sapiens
  misc_feature: GYAE6OF01DDCLN.5.57.F02.1.454.CMB.1.raw
  modified_base (157)..(157): a, c, t, g, unknown or other
  misc_feature (157)..(157): n is a, c, g, or t
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
tcagatcagacacgcacgaccggtgctcgatttagctcgatatagttggggtttgggggaggaactgctcagttaggacccagacggaaccatggaacgccccagcgcagcttctcttcctcctgctactctggctcccagactaccggttgggganatcggtgatgacgcagtctaccagccattcctgtctgtgtcncgaagggganacgactccacctctccgngcagggccagtacaagaactagttgggaacacctaaacgtttacgacccgttaacggtaaacccaaaaaccgaaaaaaccggtcggaccgaaccgtacccttaccccgaacggtaccctttacctacttaactttttaacgtaccggtttaccaacgttacccgaaccgaccgggtaccaaccgttaggtaccttaccggtaacccccaaaacgtaaggttacttacgaagggttccggaaggtaaacggggtacggggtccgttaacggggaaccgtaacgtaaccgttttaccgaaacggtttacccccgtaacaaacccgttaaacgtacccgtaacgggtaaccgaaacggggtttaaccctaaaccggtttaacgggttaccgtaaaggggttaaaaaccgtttaaccggggtttaacgggttaaccgttttaaaccggttttttaaaattttaacccggtaacggtttaaaccctaaaaagggttaaacggtttttcgggggtaacgggtttaaacccgtaaacgggggttttcccggaaccccggttttaaaacccggggtacccgggttttaccgggggaaacccccgggaacgggtaaacccccgtagggtaaacggttacgtaaaccggtaaagttaccggaacgggtacccggtaaattccgggtacggtaccgtcgacccgttaaacgtaccttacgtttacgtcccttttaacg

SEQ ID NO: 90984 - DNA, 575 bp, Homo sapiens
  misc_feature: GYAE6OF01EH7JX.5.57.F02.1.454.CMB.1.raw
  modified_base (408)..(408): a, c, t, g, unknown or other
  misc_feature (408)..(408): n is a, c, g, or t
  modified_base (453)..(453): a, c, t, g, unknown or other
  misc_feature (453)..(453): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgaggggagagacgccaccctctcctgcagggccagtcaagaacagttggtagcaacttagcctaggaaccaaacaaaaacctggccagccctccagacctcctctatttactcgttcactccaccgacgggccactgactcgtacccaacagattcaggtgcaggtagggtctgggacagtactcacgtctcacctatcgagcagtccgtaanagtctagaaacgtacgttggacttagtttattactaggtacaaanagttcggtagtcgtagtcggcctacgggtaacgttccggacccgtagggaccacgtagtggtaactagtacgtacggtacgtaactgggtcggactcgaccacctattcttcggtcttaccg

SEQ ID NO: 90985 - DNA, 834 bp, Homo sapiens
  misc_feature: GYAE6OF01BVS81.5.57.F02.1.454.CMB.1.raw
  modified_base (153)..(153): a, c, t, g, unknown or other
  misc_feature (153)..(153): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtcgtctccgaggggagacgacgcccacccgtctccgtggccgagggcccaaggtaccaagaactagtttcgggagtacctaaacgtttacgaccttaggtaaaccccaaaacgaaaaaaacccgtcggaccacgtaccctacccgaacgtaccttaccctacgttaactttttaacgtccgtttacctaaccgttaccccaaccgtaacggggcccttaacgttaggtaccttaccggtaacccctaaaaccgacgttaactttccgtaacggttcggaaccgtaggggtaacggggttccgttacggggaaccctaacggtaaccgtttcgtaacgtttcccgtacaacccgtaattaccgtacgacgtacggtccgtaacgtacgtacgttaggaaacggttcgttaagggttacctttaacgtttttaacgttaccgttaacggttaacctaaaaccgttaagttcgggttcggttaaacggtggttaccggttaacccggttaccggttaaacccggttcccgggacccgaaccgggtaacccaacgggtaacggtacgggttactaagttaccggaagggtacccggttaagtcgggtaccggtacgtacgacgtaaccagtttccgtgttcctttaacccg

SEQ ID NO: 90986 - DNA, 749 bp, Homo sapiens
  misc_feature: GYAE6OF01B4YM1.5.57.F02.1.454.CMB.1.raw
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggganagacgcccaccctctcctgccgagggccaggtccaagaactagttgggtacgctaaactttagccctacggtaacccaaaaccgaaaaaaaccctcgggacccaacggcccttaccccaagacctcctactatttaactcgttcactccaccgacgggccactgactcgtaccccaaccagtacttcaaggtcggacgtaggacggggttcgtacggggacacggtaaccttctacggttcctactaacccaactaccgaacgtaccgacggtacccggttaaccgaaggttccgttaaagggaaaaccggttaccgtttacgggacttaacgggtttttaaactttaccgttacgttactaaaacgtaagtttcgggttacggttacgtaacggttccggtacccgtagggttaacccggttacccgggacccgtaaccgggtacctaacggtaagttacgggtaattacggtaccgacgggtaccgtaacggtcggtacgggccttacggactaccccgtagttaccgttcgttccgttacccg

SEQ ID NO: 90987 - DNA, 588 bp, Homo sapiens
  misc_feature: GYAE6OF01BI5DU.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (409)..(409): a, c, t, g, unknown or other
  misc_feature (409)..(409): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtcctccgagggganagacgcccaccctctcctgcagggtccagtcagaacnttggagcaacttgcctaggtaaccaaacaaaaacctggaccagcctccagactcctctatttactcgttacactccaccgagggtccactgactcgtacccaaccagacttcaaggttcgacaagagggtctgggacagtacttcaagtctcacgatcagcagcgtaangtctagaagtcgttggacttagtttaactactagtcaaactaattggtaggtacagtcggccctacggtaaccgttccggaccgacgggtaaccacgtagttacgggactagtaccgacgggtacgaaccttggtcggtactacgaccacccctaagttccgttcgttccgtttacccg

SEQ ID NO: 90988 - DNA, 573 bp, Homo sapiens
  misc_feature: GYAE6OF01BCC94.5.57.F02.1.454.CMB.1.raw
  modified_base (152)..(152): a, c, t, g, unknown or other
  misc_feature (152)..(152): n is a, c, g, or t
  modified_base (170)..(170): a, c, t, g, unknown or other
  misc_feature (170)..(170): n is a, c, g, or t
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (238)..(238): a, c, t, g, unknown or other
  misc_feature (238)..(238): n is a, c, g, or t
  modified_base (355)..(355): a, c, t, g, unknown or other
  misc_feature (355)..(355): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttgggganatcgtgatgacgcagtcnccagccatcctgtctgtgtctccagggganagagccaccctntcctgcaggccagtcagacattggancaacttgcctggtaccaacaaaaacctggaccagcctcccacgacctcctcatttatcgttcatccaccacggcctactgtaatcgtacccaacagtacttcagtgcctagaggtcnggacagactcagtctacaccatcagcagacgtacagtctagaacgtcgttggactaggtttactacgtacgtacaacgtaactggtcgtctaaggtcggtaccctacgtaaccgttccgacccgacgggtacccagaccgtaggactagtaccgtagtacgaacccgttgggtacggcttacgaaccgaaccttagtcccgtcgtttccttaacccgg

SEQ ID NO: 90989 - DNA, 622 bp, Homo sapiens
  misc_feature: GYAE6OF01B2COG.5.57.F02.1.454.CMB.1.raw
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (541)..(541): a, c, t, g, unknown or other
  misc_feature (541)..(541): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgaggggagagagcccaccctctcctgcagggccagtcagaacnttggtancaacttagcctaggtaacccaaacaaaaacctggacccagccctccagacctcctctatttatccgttcactcccaccgacgggcctactgactcgtaccccaacagtattcgaggtcggcaggagggtcgtgggacaagcttacgcgttcacaccatcacgcaggtaccgtacacgtctacggtaaacgtacgttggaaccttagttttaacttaccgtgttaccgaacttaagtcggttaggtacgtaggtacgccgttacgtacgggtttccggacccgaagggacccaacgngggtacgacttacggtagacgggtagaacggttgggccggtctacggaccctacccgtaattccggttgtcccgtttaccg

SEQ ID NO: 90990 - DNA, 628 bp, Homo sapiens
  misc_feature: GYAE6OF01EGDP8.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctgctcccagataccggttggggagatcgtgatgacgcagtctccagccatcctgtctgtgtctccgaggggagagacgcccaccctctcctgcagggccagtcagaacattggtagctaacttacgcctaggtaaccaaacaaaaacctggaccacgcctacccagacctcctctatttactcgttcactccacgacggccactgatcgtacccaacagtacttcgagtcggcaggacgggtcgagggactagtacttcgacgtcctacaacctataccagccaagtccgtaacgagttacgtagaacgtacgttggacttaagttttacttacgtacgtaccaaacgtattcggttcgtacgaacggttccggtccgtacgggtaaccggtttccggacccgaacgggtacccgaacgaggtacggtataacgtacggaaggtaccgtaaggtcggtacggccgtacggtacacccttatcccgttgttccgttaccg

SEQ ID NO: 90991 - DNA, 762 bp, Homo sapiens
  misc_feature: GYAE6OF01DB7VE.5.57.F02.1.454.CMB.1.raw
  modified_base (152)..(152): a, c, t, g, unknown or other
  misc_feature (152)..(152): n is a, c, g, or t
  modified_base (201)..(201): a, c, t, g, unknown or other
  misc_feature (201)..(201): n is a, c, g, or t
  modified_base (755)..(755): a, c, t, g, unknown or other
  misc_feature (755)..(755): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagataccgttgggganatcgtgatgacgcagtctccagccatcctgtctgtgtctccgagggganagacgcccacccgtctcctgcgacgggccagtacagaactagttggaacacgtaacttcggaccgttaacggtaaacccaaaaccgaaaaaccgttcggacccacggtaccctacccgaacgtacccttccttacttaattttaaccgttccgttactaacctacccgaaccgtagggcccctaacgttcgaaacgttcccgtaacccctaaacgacggttaccttacggacggttacggacgtaaacgggttacggggttaccggttaaggggaaacccgtagggttaacctttacggtaaccgttcccgtaaccgtaaccctattacccggaagaccgtaacggtaccgtaccgtaacgttaccgtaggaaacggttaccgttagggtaacctttaaggtttcttaacgtagttaactaacgtaagtttcggtcggttacgtacggtaccggttaccgtacgggttaacctcccgggaaccgaaccggtacaaccggtaggtagaccttaagccggaaggtacaggtcgtcgcgtacaccgtacattcggtntcgttcc

SEQ ID NO: 90992 - DNA, 670 bp, Homo sapiens
  misc_feature: GYAE6OF01DXERD.5.57.F02.1.454.CMB.1.raw
  modified_base (203)..(203): a, c, t, g, unknown or other
  misc_feature (203)..(203): n is a, c, g, or t
  modified_base (434)..(434): a, c, t, g, unknown or other
  misc_feature (434)..(434): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagagcccaccctctcctgcagggccagtcagaacattggagctaacttagcctaggtaaccaaaccaaaaaaccgtcggacccacgcctcccgaacgtacctcctactatttactcgtttaccactcccaccgacgggccactgactcgtacccaaccagtacttcgagtcggcgaggtacgggtcgtgggacagtacttcgacgttcctacacatacgagcacgccgtanacgtcgtagaacgtacgttggacttagtttaattaccttgtaactaaccgtaagtcgggtacgtacgtacggttcggtacccgttacggtaacccggttttccgggaaccccggtaacggggtacccgtaacggtaggttaacggtaagttaacccgtacggtaaaccgggtaccgtaacggttggtacgggccttacgggtaccaaccggtactttccgttcgttccgtttaccg

SEQ ID NO: 90993 - DNA, 578 bp, Homo sapiens
  misc_feature: GYAE6OF01EY2ZV.5.57.F02.1.454.CMB.1.raw
  modified_base (155)..(155): a, c, t, g, unknown or other
  misc_feature (155)..(155): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (384)..(384): a, c, t, g, unknown or other
  misc_feature (384)..(384): n is a, c, g, or t
  modified_base (467)..(467): a, c, t, g, unknown or other
  misc_feature (467)..(467): n is a, c, g, or t
  modified_base (516)..(516): a, c, t, g, unknown or other
  misc_feature (516)..(516): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggganatcgtgatgacgcagtctccagccatcctgtctgtgtctccgaggggagagacgcccaccctctcctgcagggccagtcagaacnttggtancaacgttagcctaggtaaccaaacaaaaaccgtggaccagccctacccaagacctcctactatttactcgttcactcccaccgacgggcccactgactcgtaccccaaacagtacttcagtggacaggacgggtcgngggacagtactcacgtctcacatcagcagcgtacagtcagtaacgtcgtagactagtttatcgtatacaatagtgtaggtacnggtcgccgtacgtaaccgtcggacccgagggtaccacgtaggtacgtanagtaccgaggtaccgtaacggtcggtaggcctcggacctaacctattccgtgttccttaccg

SEQ ID NO: 90994 - DNA, 722 bp, Homo sapiens
  misc_feature: GYAE6OF01EOZHL.5.57.F02.1.454.CMB.1.raw
  modified_base (246)..(246): a, c, t, g, unknown or other
  misc_feature (246)..(246): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccaggggagagacgcccaccctctcctgcagggccagtcaagaacattggtancaacttagcctggtaaccaaacaaaaacctggacccagcctacccagacctcctctatttatcgttcactcccaccgacgggccactgtactcgtaccccaaccagtacttcgagtcggacagggtagggtcgtacggggaactacgtaccttacacgttcctaccaacccactacgaacgccaacggtccgtaacagttaccgtaggaaacgttacgttgggtaccttaacgttttaatttaaccgtagttaacctaaaccgtagttaggttacggtacgtacgggttaccggtaccccgttaacgggtaacccgggtttacccggtaccccggaacggggtacccctaaacgtacgggttacgggtaaacgttaacgttacggaaaccggggtaccgtaaaccggttcgggttacggggtacctaccggtaccctaaacccgtagtttacccgtttccggttaccctttacccg

SEQ ID NO: 90995 - DNA, 670 bp, Homo sapiens
  misc_feature: GYAE6OF01BCDPK.5.57.F02.1.454.CMB.1.raw
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (333)..(333): a, c, t, g, unknown or other
  misc_feature (333)..(333): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagacgcccaccctntcctgcagggccagtcagaacnttggancaattgcctgtaaccaacaaaacctggccagcctcccagacctcctcatttactcgtcactccaccgaggccactgactcgtacccaacngtacttacgagtcggacaggtacggggtctaggggaacacggtactttacgaacggtccctaccgaacctattaccgaacgaccgtacgtaccggtaactaggtttcctaagggtaaacgtacgtttacgggaacctttaaggttttaactttaaccgttggtaacctaaacgttagtttggtaccggttcaacgggttcggtacccgtacgtaaccgggtttcccggacccgaaggggtacccaacggtaggtacgggtactaacgttcggaaccgtacggtaacttcgggtacgggccttacggacctacccgtattcgttccgtcctttacccg

SEQ ID NO: 90996 - DNA, 755 bp, Homo sapiens
  misc_feature: GYAE6OF01D91J0.5.57.F02.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctcgagggganagagcccaccctctcctgcagggccagtcagacagttggtancaacttgcctaggtaaccaaacaaaaaccgtggaccacgccctaccacgtacctcctactatttactcgttcactccaccgacgggccaactgactcgtaacccaaccgtagtacttacgaggtcgacgtagggacggggtctaggggactaacggtaccttacacgtccctaccaacccttagtccgaacggcctaacggtacccgttaaacacggtttaccgtaaggaaacgttacgtttacgggaactttaacgggttttttaactttaaccgttagttaacctaaaacgttaaggtttcggttacgggttacgtaacgggttccgggtaccccgtttaccgggttaaaccgggtttcccgggaccccgtaaacgggggaccctaaccggtaagggttacgggtacttaaacgttccgggaacgggtaaccggtaaacggttcgggtacgggtacccgtacggtacccgaacccgttaagttccctttcgggttacccgttttacccg

SEQ ID NO: 90997 - DNA, 600 bp, Homo sapiens
  misc_feature: GYAE6OF01CKA87.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcagggccagtcagaacngttggancaacttagcctaggtaaccaaacaaaaacctggaccaagccctaccagacctcctctatttactcgtacactccaccagggccactgatcgtacccaacagattcgagtcgacaggacgggtctggggactaagaccttacgagtctacactactcagcaacgcgtaacagtactagaacgacgttggacttagtttattacgtagtactaacagttagtggtacaggttacggaccgtacggtaccggttccggaccctaaggggtacccacgacggtaggacttaagtccgaacggtgaaacgttggtacgggccttacggacctacccgtattccgttcggttacttacccg

SEQ ID NO: 90998 - DNA, 672 bp, Homo sapiens
  misc_feature: GYAE6OF01DN7CW.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
  modified_base (247)..(247): a, c, t, g, unknown or other
  misc_feature (247)..(247): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtcctccgagggganagacgcccaccctctcctgccgagggccagtcagaacattggancaacttagcctggtaaccaaacaaaaacctggacccagcctacccagacctcctctatttactcgttcactccaccgacgggccctactgatcgtaccccaaccagtattcagtcggacaggtagggtctagggacaggtacttcgagttcctcaccattacgagcgaacgtccgttaacgagttacgtaggaacgtacgtttagggcttaaggttttaattacgtacgttaccaaacgtattggttaggtctaaggttcggacccgttaccgggtaaccgggtttcccgggaccccgtaacgggggtaccctaacggtacggtacgggtaacttaccgaccgggtaagggtacccggtaacggtttcgggtacgggtccgttacggtacctaacccgtagtttacgtcggtttcccttaacccg

SEQ ID NO: 90999 - DNA, 667 bp, Homo sapiens
  misc_feature: GYAE6OF01CVIZT.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (217)..(217): a, c, t, g, unknown or other
  misc_feature (217)..(217): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgccacccgtntcctgcgacgggccaggtcaagaacngttggagcaacttagcctaggtaaccaaacgaaaaacctggaccaacgccctacccaagtacctacctctaactttactccgttacactaccgaccacgggcctacgtgactcgtaccccaacagtacttcgaggtcgacgaaggtacgggtctaggggaacaggtactttacgacgttcctactaaccgactacgaacgacctaagtacgtaacctaggttaccaggtaaacgtactttagggactttaagtttaacttacgtagtaacctaaagaagtttggtacggtactaggtacggtcccgttacggtaaccggtttccgggaccccgtaagggaccctaacgaaggtacgggtataacgtacggaacggtacgaacgtgggtacggtactcgtaccgactagttccgtcgtcttaccg

SEQ ID NO: 91000 - DNA, 802 bp, Homo sapiens
  misc_feature: GYAE6OF01BR28S.5.57.F02.1.454.CMB.1.raw
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgccctaccctctcctgcagggccagtcaagactattggancaacttgcctggtaaccaaacaaaacctggaccacgccctacccagaccttcctactaacttttatccgttacactaccaccgacgggcccacgttggatccgtacccaaccaagtacttcgaaggtcggacgaggacggggtcgtagggaactaggtaccttcgacgtcctactaaccctataccgacgactacggtcgttaacgacgttacgtaaggtaaacgtccgtttagggtaccttaagggtttttaacttacccggtagttaacccgtaaacgttaaacggtttcgggttaacggttacgtaacgggttacccgggttacccgttaacccggggttaacccgggtttacccgggaacccccggttaaggggtaacccccgtaacggttacgggttaaacgggttaaccggttaaaacggttcccggggaaacggggtaccccggttaaaacgggttcggggtttacccgggtaaccgtttacccggacccgtttaaaacccggttacccggtttcccggttttcccgggttttaccccgtttaacccgg

SEQ ID NO: 91001 - DNA, 552 bp, Homo sapiens
  misc_feature: GYAE6OF01B0BRM.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (343)..(343): a, c, t, g, unknown or other
  misc_feature (343)..(343): n is a, c, g, or t
  modified_base (495)..(495): a, c, t, g, unknown or other
  misc_feature (495)..(495): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggnagacgcccaccctctcctgcagggccagtcagaacnttggancaacttgcctggtaccaacaaaaacctggaccagccctcccacgactcctacactttatcgttccactcccaccacgggcccactcgatcgtcccaaccngtattcagtggcaggagggtctgggacagacttcagtctcaccatcagcacggtctacagtctagaacgtcgttggacttaggtttattacgtgtaccaactagtgtaggtcagtacggtcctacggtacgttccgacccgtaggaccacgngtacggatacgtagacgggacaacgtggcgacgtcgcaccgattcctgtcgttaccg

SEQ ID NO: 91002 - DNA, 582 bp, Homo sapiens
  misc_feature: GYAE6OF01BGQE5.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcagggccagtcagacattggtanctaacttgcctaggtaacccaaacaaaaaccctggacccacgccctacccagacctcctactactttactccgttcactcccaccgacgggaccacgtgactcgtaccccaacagtacttcaggtcggacaggtaggggtcgtagggacacgtacttcacgtctacaccatcagcagacgtacagtctagaacgtcttaggacttagtttacttactacgtacaatagtggtagtacgaggtcgtaccgtacgtaaccggttccggaccgacgggaccacgagtagatacgtcgacggtcgaacgtggtacggctacgaccactagtctgttcttccg

SEQ ID NO: 91003 - DNA, 591 bp, Homo sapiens
  misc_feature: GYAE6OF01CYNNG.5.57.F02.1.454.CMB.1.raw
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
  modified_base (245)..(245): a, c, t, g, unknown or other
  misc_feature (245)..(245): n is a, c, g, or t
  modified_base (412)..(412): a, c, t, g, unknown or other
  misc_feature (412)..(412): n is a, c, g, or t
  modified_base (467)..(467): a, c, t, g, unknown or other
  misc_feature (467)..(467): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccaccctntcctgcagggccagtcagaactattgganctaacttgcctaggtaaccaaacaaaacctggaccaagccctccaagacctcctctatttactccgttcactccaccacgggccaacgtgactcgaccccaacagtacttcagtgcaggaggtctagggactaggacttcagtctacacatacgagacagtccgtanaggtctaggaacgtacttggactagttttactacttgtacaactatggtacggtnaagggtgacccgttaggtaacggttccggacccgtaagggacccaagtacggtggaacttagtaccgaagggcccgtaaatgggtaacggcgtagcccgtaactagttccgtggttccttaccg

SEQ ID NO: 91004 - DNA, 631 bp, Homo sapiens
  misc_feature: GYAE6OF01EYI6K.5.57.F02.1.454.CMB.1.raw
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (603)..(603): a, c, t, g, unknown or other
  misc_feature (603)..(603): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttgggggagatcgtgatgacgcagtctccagccatcctgtctgtgtctccgaggggagagagcccaccctctcctgcagggccagtcagacnttggancacttagcctggtaaccaaacaaaacctcggaccagccctacccgagtacctcctactactttactcgttacactcccaccgagggcccacgtgaactccgtaccccaaccagtacttacgaggttcggacagggtacgggttcgtacggggactaggtaccttactacggtccttaccaacctattaccgagccgtaacggtaccgtaacgtacgtactaggaaacgtacgttggaccttagttttactacgttactactaatagttggtagtcgtaaggcggtacctaccgggtaccgttaccggccgtaacgggcctaaggtcgagtacacgtacgtaggacgtagtcgaggtcncggtacctacgtatcttggtccttaccg

SEQ ID NO: 91005 - DNA, 649 bp, Homo sapiens
  misc_feature: GYAE6OF01ERPX5.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagccaccctctcctgcagggccagtcagaacagttggtagactaacttacgcctacggtaacccaaaacaaaaaacccgtggacccacgaccctacccaagacctcctactatttatccgttcactccaccacgggccacgtgactcgtaccccaacagacttcgagtcggacaggacggtcgtagggacaggtacttcgacgtctcaccatcagcaggtccgtacagttactagaaacgtacgttggaccttaagttttaacttactacgtacaaactaagttggtacggtacaggttcggacccgtacggtaaacggttccggaccccgaagggtacccaacgtaaggtcggtaaacttaacgtacggaaaccgggtacgtaaacgttcgggtacgggtactaccgggtctaaacccgtaattcccgttagtccgtttaaccc

SEQ ID NO: 91006 - DNA, 626 bp, Homo sapiens
  misc_feature: GYAE6OF01C69NU.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggagcaactgcctgaaccaacgaaaactggccagcctccagactctcatttatcgttcatccaccagggccatgaatcgtaccccaaccaagtactcagtggacaggacgggtctgggacaggaccttcgagtctacacctatcgagctagcctaacgagtcctaggaaacgtactttgggaccttaggttttaattaccgttaggaacctaacgtaacgtgttacgggtctaaggttcggacccttacggtaaccggtttccggacccgtaacggggacctaaccgtaaggttacggaactacgttaccggaagggtaccggtaaacgttcgggtacgggacccttacggaccctaacccgtagtcccttcggttcctttaaccccg

SEQ ID NO: 91007 - DNA, 840 bp, Homo sapiens
  misc_feature: GYAE6OF01C94FP.5.57.F02.1.454.CMB.1.raw
  modified_base (151)..(151): a, c, t, g, unknown or other
  misc_feature (151)..(151): n is a, c, g, or t
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
  modified_base (247)..(247): a, c, t, g, unknown or other
  misc_feature (247)..(247): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgtggganatcgtgatgacgcagtctccagccatcctgtctgtgtcctccgagggganagacgcccaccctntcctgcaagggccagtacagaactgttggacnctaacttagcctacggtaaccaaactaaaaaccgtcggaccagccctacccagtacctctacgtattttacgtcgtttaccacttccccaaccgacggggtaccctaccgtcgtaacttccggtaaccccaaccgtacggtaacttacgaggttacggtacgaggggtaacgggtcgttacgggaactacgtaccgtttctaacggttccctaaccggacctaacgttaccgacgtaccgaacggtacccgttaacgacgttacgtaagggtaacgttaacccggttggggtaacccttttaacgggttttaaacgttaccggtttaaccgttaaccgtaaaaccgtttaacggttacgggttaccgggtttaaccgtaaacggggtttcccgggaacccgttttaaccggggttaacccgggtttacccggacccccgggtaaaggggttacccccgtaacggtacgggttacgggtaaaccgttacgtaaccgggttaaaccgggtacgtaaaacccggttggggttaccgggtacgttaccggacccgtaaaccttccgtttaccgttcggtttaacccttaaccccggg

SEQ ID NO: 91008 - DNA, 562 bp, Homo sapiens
  misc_feature: GYAE6OF01CIXO1.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctctcctgcagggccagtcagaacattggagcaaacttagcctaggtaaccaaacaaaaaacctggaccaacgcctccagactcctcatttactcgttcactccaccacgggccactgatcgtacccaacagacttcagtggcaggtacgggtctagggactacggacttcagtcctacaccatcagcacgtcgtacagtctagaagacttggacttagtttacttactgtacaacgtaatggttaggtacagggttacggaccgttacgtaacggtttccggacccgaaggggacccacgtaggtggatagtcgacgacgaacgttgcggctgccactatctgtcttac

SEQ ID NO: 91009 - DNA, 744 bp, Homo sapiens
  misc_feature: GYAE6OF01CUH8L.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgccaccctctcctgcagggccagtacagaactagttgganctaactagcctacggtaaccaaaccaaaacctcggccagccctcccagacctcctcatttctccgttacactacccaccgagggcctatcgactcgtaccccaaaccgagtacttcgaagttcggacgaacgggtaacggggttccgtaggggaaacctaggtaccgtttacgacgttaccctaccgaacccgtactcgaacggaccgtaacgggtacccgttaactacggttactaacgggtaaacgttaacgttacgggtactttaacggtttaactttaccgttacggtaacctaaacgtttaagttcggttacgggttacgtaacggttccgggtaacccgttaacccgggtaaccgtttacccgggacccgttaacggggaccctacggtaaacggttcgggaaacttacgtacggtaacgggaccgttaacggtcggtcgggtacgtcccgaaccttaaacccgtgtttacccgttggttccctttacccgg

SEQ ID NO: 91010 - DNA, 693 bp, Homo sapiens
  misc_feature: GYAE6OF01DGNQ0.5.57.F02.1.454.CMB.1.raw
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagatcgtgatgacgcagtctccagccatcctgtctgtgtctccgaggggagagacgcccaccctctcctgcagggccagtcagaacagttggancaacttagcctggtaaccaacaaaaacctggaccagcctccagactcctctatttatcgttacactccaccgaggccaactgactcgtacccaaccagacttcgaagtcggctaaggacgggtcgtaggggaacacggtacttacgaggttacctaccaacctataccgaacgcgtaacggtcgttaacgtacggttaccgtagtaaacgtacgtttacgggacctttaacggttttactttaaccgttacgtaactaaaccgttaagttacgggttacggttacgtaacggtttcggtacccgttaaccggtaaccgggtttcccggaaccccggtaacggggtacccaacgtacgggtacgggtaacttacggtaccgaacgggtaaccgtaacgttcgggtacggcgttacggacctaaccgtactttccgtgtttaccgttaccc

SEQ ID NO: 91011 - DNA, 466 bp, Homo sapiens
  misc_feature: GYAE6OF01CQMRR.5.57.F02.1.454.CMB.1.raw
  modified_base (274)..(274): a, c, t, g, unknown or other
  misc_feature (274)..(274): n is a, c, g, or t
  modified_base (425)..(425): a, c, t, g, unknown or other
  misc_feature (425)..(425): n is a, c, g, or t
  modified_base (451)..(451): a, c, t, g, unknown or other
  misc_feature (451)..(451): n is a, c, g, or t
  modified_base (454)..(454): a, c, t, g, unknown or other
  misc_feature (454)..(454): n is a, c, g, or t
  modified_base (457)..(466): a, c, t, g, unknown or other
  misc_feature (457)..(466): n is a, c, g, or t
tcagatcagacacgcacgaccggtgctcgatttagctcgatatagttgggtttggggggaagaggaagactgacggtccccccaggagtccagagtgcgtcgcaagtattggcagtgtgaaatttgacaccttatatgcagactctgtgaggggccgcttcaccgtgtccagagacaactccaagaacgccgtctatttgcagatggacagcctgagagtcgacgacacgggcatctattattgtacggcgccgagcaatactctcttactttntggagtcgagggacgtcccggtcacttgtctcctcacgcctcccaccaagggcccatccggtccttcccccgtggccaccctcctccaacgacgccaccctcgtggggcacgagccggcctgggctcgccgtggtcaaggctaccttccgngtctgactctgagcggctggcaggcncancgnnnnnnnnnn

SEQ ID NO: 91012 - DNA, 723 bp, Homo sapiens
  misc_feature: GYAE6OF01AZCQ8.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgccgagggcccagtcaagaactattggtacactaacttacgcctacggtaaccaaacaaaaccgtcggaccacgccctacccagacctcctactatttactcgttacactcccaccgacgggccacgtagactccgtaccccaacagtacttacgaggtacggcgagggtacgggtcgtagggaccaggtaccttacgacgtctaccacctatcgaacgcgaacggtaccgtaactaggttacgtaacggtaaacgttaccgtttacggtaacgttttaacgttttaactttaaccgttagttaactaaaccgttaaggttcgggttacgggttacggtagggttcccggtacccggttaccgggttaacccggttcccgggacccggaaccgggacctaacggtaacgggtacggtaagttaccggtaccggtaacgggacggttaacggttcgggcggtaccgtacggtacctacccgtattccgttcgttccgttacccg

SEQ ID NO: 91013 - DNA, 615 bp, Homo sapiens
  misc_feature: GYAE6OF01EL2V2.5.57.F02.1.454.CMB.1.raw
  modified_base (154)..(154): a, c, t, g, unknown or other
  misc_feature (154)..(154): n is a, c, g, or t
  modified_base (202)..(202): a, c, t, g, unknown or other
  misc_feature (202)..(202): n is a, c, g, or t
  modified_base (247)..(247): a, c, t, g, unknown or other
  misc_feature (247)..(247): n is a, c, g, or t
  modified_base (417)..(417): a, c, t, g, unknown or other
  misc_feature (417)..(417): n is a, c, g, or t
  modified_base (471)..(471): a, c, t, g, unknown or other
  misc_feature (471)..(471): n is a, c, g, or t
  modified_base (586)..(586): a, c, t, g, unknown or other
  misc_feature (586)..(586): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgaggggngagagcccaccctctcctgcgagggccagtcaagaactattgganctaacttagcctaggtaaccaaacaaaaacctggaccacgcctcccagacctcctctatttactcgttcactcccaccgacgggccacgtgactcgtacccaaccagtacttccaggtcggaccagggtacgggttcgtggggaacaggtaccttacacgtcctcacccntccagaccagcgtactagtctagaacgtacgtggtactagttttaactacgttntactaagtagttggtcggtactagggttacggtaccgttccgggtaacggtttcccggaccgtaccggggaaccacggacggtagtactacgtcggacggtaggtactggcggtntcggacctaactacgtcgtcttcgttacc

SEQ ID NO: 91014 - DNA, 719 bp, Homo sapiens
  misc_feature: GYAE6OF01B8MMM.5.57.F02.1.454.CMB.1.raw
  modified_base (191)..(191): a, c, t, g, unknown or other
  misc_feature (191)..(191): n is a, c, g, or t
  modified_base (204)..(204): a, c, t, g, unknown or other
  misc_feature (204)..(204): n is a, c, g, or t
  modified_base (253)..(253): a, c, t, g, unknown or other
  misc_feature (253)..(253): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatccctgtctgtntctccgagggganagacgcccaccctctcctgcgagggccagtccaagaacagtttgggaanctaacgttagcctaggtaaccaaacaaaaaccgtggaccacgccctaccagacctcctactactttacgtccgttacactcctaaccgaggccctacgtgtactaccgtacccctaaacaggtacttacgaggtcggacgaacggtagggtccgtaggggacctaacgtaccttcgaacgttccctacaacccgagttaccgaacgtaccgacggtaccggttaactacggttcctaaggtaaacggtacgtttacgggtacttaacgttttaataccgttacgtaacctaacttaaggtggtttcggtaacgtggttaccggacccgttacggtaaccgggtttcccggacccgtaacggggtacccaacgggtacgtacgggtatacggtaccggtaaggtaccgtaaacgtcgggttacggcctacggtacccgtaccagtttaccttggtacccctttacgg

SEQ ID NO: 91015 - DNA, 780 bp, Homo sapiens
  misc_feature: GYAE6OF01CCA1R.5.57.F02.1.454.CMB.1.raw
  modified_base (152)..(152): a, c, t, g, unknown or other
  misc_feature (152)..(152): n is a, c, g, or t
  modified_base (201)..(201): a, c, t, g, unknown or other
  misc_feature (201)..(201): n is a, c, g, or t
  modified_base (750)..(750): a, c, t, g, unknown or other
  misc_feature (750)..(750): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctccgtgccgacgggccagtccaagaactagttaggtagactaaacgttacgcccgttacgggtaacccaaaacaaaaaaccgtcggacccgaacggacccttaccccgaacgtaccccttaccctactaactttttaactccggtttaccaacgttaccccgtaacccgtaacggggcccctaaaccgttcggtaaccgttccggttaacccccaaacccgtaagttaaccgttacccgtaaaggttcgggacgtaaacggggtacggggttacgtacggggtaaccctaacggtaacctttacgaacggttccctactaacccgtactaccgaacgtaccgaacggtccgtaaaccgagttaccgtaaggtaaccggttacgttacggtacctttaaacggtttttacttaaacggtccgttaacctaaagttacgtgggttaacgtcggtaacggtccggttacccgtacggtaaccggttccgggacccgttaacgggaccagtaggcgacgtatcgaaggtcaacggttgnggtactcgacacgtactctcgttcttaccg

SEQ ID NO: 91016 - DNA, 553 bp, Homo sapiens
  misc_feature: GYAE6OF01ARJ9H.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (400)..(400): a, c, t, g, unknown or other
  misc_feature (400)..(400): n is a, c, g, or t
  modified_base (444)..(444): a, c, t, g, unknown or other
  misc_feature (444)..(444): n is a, c, g, or t
  modified_base (487)..(487): a, c, t, g, unknown or other
  misc_feature (487)..(487): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagccaccctctcctgcagggccagtcagaacattggagctaaacttgcctaggtaccaaacaaaaacctggaccacgcctcccagacctcctcatttatcgttcactccaccgagggccactgatcgtacccaaccagtacttcagtggcaggagggtctgggacagacttcagtctcaccatcagcacgcgtacngtctagaagtcgtgctagttttactactgtacaacatgtagtcnggtcgcctacggtaccgttcggccgtaacgggaccacgtacgnggtactagtacgacggtgtaacgtcggtacggcgtacgtacccaacgtagtcttcgttccttaccg

SEQ ID NO: 91017 - DNA, 627 bp, Homo sapiens
  misc_feature: GYAE6OF01DP1D2.5.57.F02.1.454.CMB.1.raw
  modified_base (151)..(151): a, c, t, g, unknown or other
  misc_feature (151)..(151): n is a, c, g, or t
  modified_base (187)..(187): a, c, t, g, unknown or other
  misc_feature (187)..(187): n is a, c, g, or t
  modified_base (214)..(214): a, c, t, g, unknown or other
  misc_feature (214)..(214): n is a, c, g, or t
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
tcagatcagacacgcacgaccggtgctcgatttagctcgatatagttgggtttggggagaactgctcagttaggacccagacggaaccatggaagccccagcgcagcttctcttcctcctgctactctggctcccagataccgttgggganatcgtgatgacgcagtctccagccatcctgtctgtntctcaggggaagacgcccacctctccngcagggccagtcagacngttggancactagcctaggaaccaacaaaacctgccagcctccacgtactcctctatttacgtccgttacacctccaccgtacggcctagtcgactcgtacccaaccgagtacgttcgacgttggacgtaggtacgggtcgtacgggaacgtaacgtacttacgacgttcctaccacctacgtacgacgacgtaacgtccgtaacgtacgttacgaagtaacgtacgttgggacctttaggtttaactcgttactacgaaacttaggtcgtagtacgagtccggaccgttacggtaccggttcccggtacgacgaccgagtacggtatagtatacggaggtaccacggttcggtacgtccgacggtaccaacgttacgtaccttgtccgttacccg

SEQ ID NO: 91018 - DNA, 603 bp, Homo sapiens
  misc_feature: GYAE6OF01B5YQ6.5.57.F02.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
  modified_base (368)..(368): a, c, t, g, unknown or other
  misc_feature (368)..(368): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccaccctctcctgcagggccagtcagaacattggancaacttgcctaggtaaccaaacaaaaacctggaccagccctcccacgacctcctctattttactcgttcactccaccgagggccactgactcgtacccaacagtattcaggtgcaggagggtcnggacagtactcgagtcacgaccatcagcagcgtacagtctagaacgtacttggacttagtttacttacgtgtacaactagtgtagtcgtaagtcggacctaccggtaacggttccggacccgtagggacccaacgtacggtaggtaacttaggtaacgtacgggtaaccggtaacgtgggttaccggtaccgtacggaccctaccgttaacgttccgttcgttcccgtttacccg

SEQ ID NO: 91019 - DNA, 649 bp, Homo sapiens
  misc_feature: GYAE6OF01EFD8T.5.57.F02.1.454.CMB.1.raw
  modified_base (154)..(154): a, c, t, g, unknown or other
  misc_feature (154)..(154): n is a, c, g, or t
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (287)..(287): a, c, t, g, unknown or other
  misc_feature (287)..(287): n is a, c, g, or t
  modified_base (410)..(410): a, c, t, g, unknown or other
  misc_feature (410)..(410): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccagggganagacgccacctctcctgcaggccaagtcagaacngttggagctaacttgcctggtaaccaaacaaaacctggccaagcctaccanactcctctatttatcgttcatcccacgtggccactcgactcgacccaaccagacttcaggtcgcgaggtaggtctagggacaagtacttcgagtcctcaacctatacgagcagtaccgttaanacggttactaggaaacgtacctttgggacctttagtttaacttagttactactaaacaagttggttagtacgacggtttacgggacccctttacggggaacgtttcccggggtaccccgaaacgggggtaacccaacggttaacggtacggtacgttaaattccggaaacggggtaacgtaaaccggttggtaacggtccgtacgtacccgaccgtaacgtttctaggttccttaaccg

SEQ ID NO: 91020 - DNA, 763 bp, Homo sapiens
  misc_feature: GYAE6OF01CZWVB.5.57.F02.1.454.CMB.1.raw
  modified_base (154)..(154): a, c, t, g, unknown or other
  misc_feature (154)..(154): n is a, c, g, or t
  modified_base (223)..(223): a, c, t, g, unknown or other
  misc_feature (223)..(223): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctcagccatcctgtctgtgtcctccgaggggagagacgccctaccctctccgnggcgaacgggcctagtaccaaggaaactgttggacgactaaacgttgcctacggtaaaccaaaaccaaaaaccgtcggaccacgccctcccaagcctcctacttaacgtttactccgttacactacccaacgaccggaccacgtagacttccgaacccctaacagtacttccgaggtcggaccgtaagggtcgggtacgtacggggaacacgttaaccgtcgtaacgtcctacaaccgtatacgaacggctaacggtcgttaaccaggttacctaaggtaaacgtcgttacgggtaactttaagttttaacgttactaacggtaacaaaaccgttagttcggttacgggtacgttacgggtccgtacccgttaaccgggttaacgggttaccccggacccggtaaaccgggtaccctaacggttacggtaacggtaacgttaaccggtaccgtaacgggggtaccgtaaacggttcgggtacggtaccgtacgtaccccgtaacgttacgtttcccgttaccggtttccgtttaaccccg

SEQ ID NO: 91021 - DNA, 765 bp, Homo sapiens
  misc_feature: GYAE6OF01CHD9L.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagactaccggttgggganatcgtgatgacgcagtctccagccatcctgtctgtcgtctccgagggganagacgccctaccctctccgtgcgacgggccaggtcaagaactagttggacgactaaacgttacgacccgttaggtaaacccaaaaccgtaaaaaacccgtgggaccctaacggacccctacccgaacggtaccctccccttacttaaactttttacgtccgtttaccaacttccccgaaccgacgggtaccctaacgtacggtaacttaccgtaccccaaacgtagtaactttcgaacggttacggaccgaagggtacggggttcggtacgggaacgtaacggtaccttacgaacgttccctaaccgaacgtactacgacgacgtaacggtaccggtaacacgttaacgttagaaacggttacgttaggtacttaacgtttaacttacgtacgttaacaaacgtagttcggtacggtcgtaaggtcgtacccgtaacgggtaacccggttccggaacccgtaacgggacctaacgtaggtaggacttacgacggtacggtacggtaacggttcggacggtcttaccggtactaacccgtacgttctcggttcccgttaccg

SEQ ID NO: 91022 - DNA, 707 bp, Homo sapiens
  misc_feature: GYAE6OF01A3K00.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgaggggagagacgcccaccctctcctgccgagggccagtcaagaacagttggtagcaacttagcctaggtaaccaaacaaaaaccgtggaccacgcctcccagacctcctcatttactcgttacactcccaccgacgggcccactgactacgtaccccaaaccagtacttaccgaggtcggacgaaggtacggggttacgtaggggaactaagtaccgttacgacgttcctaccgaaccctagtaccgaagaccacggtaccgttaacaacggttccttaaggaacgttacgttacggtaccttaagtttttaacgttaccgttagtaccctaaacgtaagtttggttaccgggtacgtaggtaccggtacccgttaacgggtaacccggtttaccgggacccgtaaccgggaacccgtacgtaacggttaggtactaacgtccggtaacgggtaccgtaacggttggtacgggacttcgaccgtacctagttcgttacggttccttaaccg

SEQ ID NO: 91023 - DNA, 854 bp, Homo sapiens
  misc_feature: GYAE6OF01DDB8F.5.57.F02.1.454.CMB.1.raw
tcagatcagacacgcacgaccggtgctcgatttagctcgatatagttgggttgggggaggaactgctcagttaggaccagacggaaccagtggaacgccccagcgcagcttctcttcctcctgctactcgtggctcccagactaccggttgggagattcggtgatcgacgctacgttcctaccgagccctacttccgttgtcgttggttcgtccgtaccggaagggggacgacgaccgtcccctacccttccgtccgtcggaccgaacggggtcccctaaggtacccgaaggtaaccgttaggttacgggtaaacgtacccttaaaccgttaccggtcccgttaaacggtaaaaccccgtaaaacccgtaaaaacccggtcggaccccaaccggtacccctacccgaacgtaccccttaccttactttaaacttttcgtaccgttaccaaccgttaccccaccggtacgggtaccctaacggttactaccgttacccgtaacccctaactaacgttacgttaccggaggttcggaaccggtagggtacggtaccggacggtaaccgtacgttaccgtacggtacttacctaccgaaccgtactaccggaacgaccgtacggtaaccttacgtacggttaaccgtaggtaaaccgttcggttacgttaaccgtttagttttaactaccggttacgtaactaaacgttggtttacggtacggtacgccgggtccggttaccgttaccgggttacccggaccggacgggtaccgacgtagtacggtactagtacggtaccggaggtaacgtcgtacgggcctcgactaccgacttacgttctaccgttccgtacccg

SEQ ID NO: 91024 - DNA, 606 bp, Homo sapiens
  misc_feature: GYAE6OF01AZYW6.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (410)..(410): a, c, t, g, unknown or other
  misc_feature (410)..(410): n is a, c, g, or t
  modified_base (507)..(507): a, c, t, g, unknown or other
  misc_feature (507)..(507): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgcccacctctcctgcgagggccagtcagaactagtttggagctaacttacgccgtaggtaaccaaactaaaaaccgtcggaccacgccctaccacgtaccttcctactaactttactccgttacactacccaaccgtacgggacctacgtgactccgtacccaacagtattcgagtcggcaggaggtcgagggacacgtcttnacgtctacactatcgacgcacgcgtacacgtctagtaacgtcgttcgtacttaagtttaacttacgtcggtaactaacgtagttcggtacgttacgnggtcgtaccgttacggtaccggtccggaccgtacggacacggagtagactagcgacggtacgacgtggtcgactcgacctactagtccttgtccttacg

SEQ ID NO: 91025 - DNA, 723 bp, Homo sapiens
  misc_feature: GYAE6OF01ATEYT.5.57.F02.1.454.CMB.1.raw
  modified_base (153)..(153): a, c, t, g, unknown or other
  misc_feature (153)..(153): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagacgcccaccctctcctgcagggccagtcagaactagttggtacgctaacttcgccgttacggtaacccaaaaccaaaaacccgtggacccaacgtccctacccaagaccttccctctaactttactcgtttacactcccaccgacgggtccactgactcgtaccccaaaccagtacttcaggtcggacgagggtacggggttcgtacggggaactacggtacctttaccgacgttcctaccgaacccattaccgaacgacgtaacggtaccgttaacaggttacctaggaaacggtacgttggtacttaagttttacttacgtagtaaccaacgttaagttggtaggtacgtaggttaccggtcccgttaacggtaacccggttccgggaccccgtaacggggtacccacggtacggttaggaaacgttaacgtaccggtacgggtacggtaaccgtcggggtaccggtacgttaccggacccttaaccgtaacgtttccttacggtttccttaacccg

SEQ ID NO: 91026 - DNA, 527 bp, Homo sapiens
  misc_feature: GYAE6OF01EVNR7.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (296)..(296): a, c, t, g, unknown or other
  misc_feature (296)..(296): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcccaccctctcctgcagggccagtcagacnttggancaacttgcctggtaccaacaaaaacctggccagcctcccacgactcctcatttancgttcatccaccagggccactgatcgtacccaacagattcagtggcagagggtctgggacagacttcagtctcacatcagcagtcgtacagtctagaagacttggactagtttattactgtacaactaatggtagtcaggtggcctcgtaacgttccggacccgagggaccacgagtggatactcgaggacgtaacgtggtacggctcgaccacctattcctgtcttaccg

SEQ ID NO: 91027 - DNA, 652 bp, Homo sapiens
  misc_feature: GYAE6OF01DP9OH.5.57.F02.1.454.CMB.1.raw
  modified_base (320)..(320): a, c, t, g, unknown or other
  misc_feature (320)..(320): n is a, c, g, or t
tcagatcagacacgcacgaccggtgctcgatttagctcgatatagttgggtttgggggaggaactgctcagttaggaaccagacggaaccatggaagccccagcgcagcttctcttcctcctgctactctggctcccagataccggttggggagatcgtgatgacgcagtctccagccatcctgtctgtgtctccgaggggagagacgcccacccgtctccgtgccgacgggaccagtacagaactagttaggtagactaacttagaccttaggtaaccaaactaaaaccgtggaccacgccctaccgacgtacctcctntaactttactccgtcactcccgacgacgggcctatggactacgtacccaacgagtacttcgacggtacggacagggtacgggtcgtaggggacaaggtacttacgacgttacacctacccgtaatacgacgaccgtacgacgtaccgtaggtacgtagtaacggtacgttaggtacgttaagtttacttacgtagtaacctaattagtgtacgtgtaacggtcgtaccgtacggtaacgtttcccggaccgtaacgggtccaacgtagttacggatacgttacgacggtacgtacgtcgtcgggacttcgactacgtatcgttgtccgtacg

SEQ ID NO: 91028 - DNA, 655 bp, Homo sapiens
  misc_feature: GYAE6OF01CDA0G.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcagggccagtcaagaacnttggacnctaacttgcctaggtaaccaaacaaaaacctggaccagccctcccagacctcctctatttactccgttacactcccaccgacggccactgactcgacccaaaccagtactcgagtggacaggagggtctagggacagtacttcgagtctaccacatacgagcaggtccgtactagtcgtagaaacgtcttaggacttaagttttaacttacgtacgtaactaaaccgtaagttgggtacggtacgtaacggttccggtacccgttaccggtaacgggtttcccggaccccggtaacgggaccctaacggtaggtacggtaacttaacggtccggaaacgggtaccgtaaacggttggtacccgggtacttacgggaccctaccgtaactttcccgtgttcccttacccg

SEQ ID NO: 91029 - DNA, 618 bp, Homo sapiens
  misc_feature: GYAE6OF01EX05S.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcagggccagtcagaactattggancaacttgcctggtaaccaacaaaaaccgtggccagcctcccagacctcctcatttactcgttcactccgacagggccactgactcgtacccaaccagtattcgagtggcagggtagggtcgtagggacagtacttcgagtcctacacctatcagcaggtccgtaactacgtctagaaagtcttggactaagtttattactgtaacaactaattggtgtactacggtcggtacccgttaccggtaaccggtttccggacccgtaacgggtacccaacgtacgggttaacggaacgttacgtaccgtacgggacggtaacgttgggttacggtccgtacggtaccctaaccgtagtttcctcggttccttaaccg

SEQ ID NO: 91030 - DNA, 592 bp, Homo sapiens
  misc_feature: GYAE6OF01ASLOR.5.57.F02.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (319)..(319): a, c, t, g, unknown or other
  misc_feature (319)..(319): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccaccctctcctgcagggccagtcagaacnttggancaacttagcctggtaccaacaaaaacctggaccagcctcccagacctcctctatttatcgttcactcccaaccgnggccactgactcgtaccccaaaccgtagtacttcgagtcggacagggagggtcgtgggacacggtacttcgagtctacaccatcagcagccgtacagtactgaagtcgttggactagtttatacgtgtacaatagtgtacggtctaggtcggtcctacggtaacggttccggacccgaagggacccaggtaggtcgtaactacgtacgacgggtaccgtaagttcggtacggtcgtccggtacctaaccgtacttccgttcggttcttacccg

SEQ ID NO: 91031 - DNA, 856 bp, Homo sapiens
  misc_feature: GYAE6OF01CFAZ6.5.57.F02.1.454.CMB.1.raw
  modified_base (247)..(247): a, c, t, g, unknown or other
  misc_feature (247)..(247): n is a, c, g, or t
tcagatcagacacgcacgaccggtgctcgatttagctcgatatagttgggtttgggggaggaactgctcagttaggacccagacggaaccatggaagccccagcgcagcttctctcctcctgctactctggctcccagataccgttggggagatcgtgatgacgcagtctccagccatcctgtctgtgtctccgaggggagagcgcccaccctcctcctgcgacgggccagtcagaactagttgganctaacttagcccgtacggtaaacctaaaccaaaaaaccgtcggacccacgaccctaccccgagacccttcccctaccgtaattttaacttccgtttaccacctaccctaaccccgaacggggcccaccttacggaagttcccgtaaccccctaaacccgaagttacgttaccgaacgttcggaacccgtaagggtacgggggttaccgtacggggtaaccaaacgggttaccttaccgtaccgggttacctaccctaaccctagtaccgaaccggacgtaacgtaccggtaacccgtaagtcccgttaaaggaacgttaaccggttacggttacttaaccgtttttaacgttaaccgttacggttaaccctaaaccgttaaagtttcgggttaacgggttacgtaaaccggttcgggttaaccccggttaccccgggttaaacggtttacccccggggaaccccggtaacccgggggaaccgtaaaccgtacgggttacgggaaacgttaaggttaccccggaagggttaaccccggtaaacgttcgggtacgggtacccgttacggtaccccgtaaaccctgtttaccccgttgttacccgtttaccc

SEQ ID NO: 91032 - DNA, 753 bp, Homo sapiens
  misc_feature: GYAE6OF01DUTQN.5.57.F02.1.454.CMB.1.raw
  modified_base (155)..(155): a, c, t, g, unknown or other
  misc_feature (155)..(155): n is a, c, g, or t
  modified_base (168)..(168): a, c, t, g, unknown or other
  misc_feature (168)..(168): n is a, c, g, or t
  modified_base (204)..(204): a, c, t, g, unknown or other
  misc_feature (204)..(204): n is a, c, g, or t
  modified_base (221)..(221): a, c, t, g, unknown or other
  misc_feature (221)..(221): n is a, c, g, or t
  modified_base (250)..(250): a, c, t, g, unknown or other
  misc_feature (250)..(250): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttgggganatcgtgatgacgnagtctccagccatcctgtctgtgtctccgagggganagacgcccacctctccngacgacgggcagtcaagaactagttgganactaacgttcgaccgtacggtaaaccaaaacgaaaaccgtcggacccacgtccctaccacgtacctcctacttactttacgtccgttacacctacccaaccggtaccgggtaccctacgtacggtacctaccgtaaccccaacgtacgtaacttacgacggtggacgtaacgggtacgggttcgtagggtacgaacgtaccgttacgaacgtcctaccaacctagtaccgacgtacacggaccttaacgagttacgtaaggtaacgtaccgttggtaactttaacgttttattaccgtagtaaccgtaaacgtaggtacggttcggtaacgtacgggttcggttaacccgtaccggggttaacgttacccgggaccgtaaccggggtaccctaaggaaccgggtagtaaaccgttacgtaacggtaacggggtaccctaacgggttcgggtaccggtaccgtaccgacccgttaactacttccgttcgtttaaccctacccgg

SEQ ID NO: 91033 - DNA, 577 bp, Homo sapiens
  misc_feature: GYAE6OF01A7YZ6.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (362)..(362): a, c, t, g, unknown or other
  misc_feature (362)..(362): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgaggggganagagcccaccctctcctgcagggccagtcagaacnttggancaattgcctggtaccaacaaaacctggccacgcctcccagacctcctctatttactcgttcactccaccacgggccactgactcgtacccaacagacttcagtcgcaggacgggtcngggacagacttcagtctcaccatcagcagcgtacagtctagaacgtacttggactagtttactactgtacaatagttgtgtcaggtcgcccgtacggtaaccggttccggacccgagggtacccacgtaggtacggaactacgtcggacgggtacgtaaacggttcggtacgggtcctacggaccctaccgtaagttccgttcggtcctttaccg

SEQ ID NO: 91034 - DNA, 609 bp, Homo sapiens
  misc_feature: GYAE6OF01EEJTC.5.57.F02.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (446)..(446): a, c, t, g, unknown or other
  misc_feature (446)..(446): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganacgacgcccacctctcctgcgaggccagtcagaactnttggancaacttgcctaggtaaccaaactaaaaacctcggaccacgcctacccacgtacctcctactatttactccgttacactccaccgacgggaccacgttgactacgtacccaacctagtacttcgaggtcggacgaggtacgggtcgtgggaacacgtacttcgaacgtctaccaaccagtacacgacacgtaccgtaacgngtactagaacgtacgttggtactagtttacttacgtgtacaacgtaattggtacggtctaaggtcggtaccttacggtaccgttcggacccgacggaccgacgtaggtagtacgtatacgaagggtactaggtgtcggcgtacgcctacgattctcgtctacg

SEQ ID NO: 91035 - DNA, 663 bp, Homo sapiens
  misc_feature: GYAE6OF01CBO9V.5.57.F02.1.454.CMB.1.raw
  modified_base (153)..(153): a, c, t, g, unknown or other
  misc_feature (153)..(153): n is a, c, g, or t
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (327)..(327): a, c, t, g, unknown or other
  misc_feature (327)..(327): n is a, c, g, or t
  modified_base (577)..(577): a, c, t, g, unknown or other
  misc_feature (577)..(577): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagtacgccaccctctcctgcagggccagtccagaacngttgganctaacttgcctaggtaaccaaacaaaaacctggaccaagccctcccagacctcctacatttactcgttcaactccaaccgngggacccatcgatccgtacccaacgagacttcagtcgcaggacgggtctaggggacagtaccttacgacgtctcgtaccagtccagcacgtaccggtactacgtctaggaaacggtaccttagggcctttaaagttttacttaaccgtgttaaccctaaagtaacgttggttcgtacgtagggtccgtacccgttaccgggtaacgtttccccgggacccgtaggggaccctaacgtcgggttaaacgtntaacggttaccgaagggtacccgttaaacggttgggtaacgggccgttacggaccaacccgttattacggtggtttccccttaccg

SEQ ID NO: 91036 - DNA, 577 bp, Homo sapiens
  misc_feature: GYAE6OF01CGX4A.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
  modified_base (421)..(421): a, c, t, g, unknown or other
  misc_feature (421)..(421): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctntcctgcagggccagtcagaacattgganctaacttgcctaggtaaccaaacaaaaacctggccacgccctcccagacctcctctatttactcgttcactccaccgacggccactgactcgtaccccaacagtacttccgaggtcggacgaaggacggggttcgtagggaacacgtacttcgagtcctacaccgatcagcagcgtangtctagaacgtcttggcttagtttactactcgtacaacgtagttgtaggtcagtcggccttacggtaaccgttccggcccgaacgggaccacggagtcgtatacgcgacggacgaacgttggacggctacggacctactattcgttgttcttaccg

SEQ ID NO: 91037 - DNA, 709 bp, Homo sapiens
  misc_feature: GYAE6OF01ALAFD.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgcccaccctctcctgccgacgggccagtcaagaactgttggtagctaacttgcctaggtaaccaaacaaaacctggaccacgcctcccgagacctcctactatttacgtcgttacactacccaccgagggtccctactcgacttccgacccaaaccgtagtacttcgaggtcggacgaagggtacgggtctacggggaactacggtacttaccgtacggtccttaccgaacctacgtcgaacgtccgtaacggtcccgtaatacgttcgtaacggaacgtacgttacggtaccttaagttttaacgttacgtaacggtacctaaacgtagtttcggtacggttactaaggtccgtacccgtacggtaacccgggttccggacccgtacgggaacctacggtaggtacggtacgttacgtacggtaacggaccggttaacgtcgggttacggaccgttacgtacccgacccttaaggttccgtttcggtaacccgtttacccg

SEQ ID NO: 91038 - DNA, 815 bp, Homo sapiens
  misc_feature: GYAE6OF01CR8JV.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctcgagggganagacgccacctctcctgcagggccagtcaagaacagttggtagcaacttagcctaggtaaccaaacaaaaacctcggaccacgcctaccaagacctcctctattttactccgttacactcccgaaccacgggacctaacgttcgaacttccgtaaccccaaccgtagtacttacaggtcggaccgaagggtaggggtccgtaggggaactacggtaaccgtttcgacggttccttaccgaacccgtaagttccgaacgaccgtaacggtacccggttaaacctacggtttaccgtaacggtaaacggttaccgtttaacgggaccgtttaacgtttttaacgtttaaccgtttacggtaaacccttaaacgtaacggtttcgggtttacggttacgtaacggtttacgggtaccccgtttaaaccgggtaacccggttttacccggggaacccctaacgggggttaaccccaacggttacgggtacgggttaaccgttaacgttaccgggtaaacgggtacccggttaaaccggtttggtaccggggttacccttaaccgggtacccgtaaacccgttacgtttacccgtttcgggtttaacccctttacccgg

SEQ ID NO: 91039 - DNA, 684 bp, Homo sapiens
  misc_feature: GYAE6OF01AT8LH.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (248)..(248): a, c, t, g, unknown or other
  misc_feature (248)..(248): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgcccacccgtctcctgcgagggccagtcagaacagttgganactaacttacgcctacggtaaccaaacaaaaacctggaccacgcctacccagcctacctactactttactccgttacctacctaccgaccgagggcccactacgtaccttacgtaccccaacgtacgttactccgaggtcggaccgaagggtacgggtacgtagggaaccgtaacggtacttacgaacgttactaccgacctagtacgacgacgtacgtaccgttacacggttacgtagaacgtacgttacggtagttaacgtttattaccgtaggttaacctaacgtagttacggtacgtacgtaggttcggtacccgttacggtaccggttaccggtacccgaacgggtacctacggtaggtacggtagtacgtaccggacggtacgacggttcgggtacgcgtacgccgtactacgttcgtacgttcgtaccg

SEQ ID NO: 91040 - DNA, 678 bp, Homo sapiens
  misc_feature: GYAE6OF01BX3C1.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctcgagggganagacgccaccctctcctggccagggccagtcaagaactagttgggaacgacctaaacgttacgacccgtacgggtaaaccctaaaaaccgaaaaaacccgtcgggacccaacgacccttacccgaacgtaccttccctactaacttttacgtccgttaccaactaccccaaccgtacgggcccaacgtcgactccgtaaccccaaacctagtacttcgaaggtcggacgacgggagggttcgtagggaaccaacggtacttacgtagtcctacaacccatcacgacgtacgacgtaacagtacgtagaacgtacgttagactttagtttacttacgtcgtaacaacgtattggtagtacgtaggtccgtaccgtacggtaacgttccggaccgacggaccaggtagtagtactacgtcgaaggtacaacgttggacggtacctacgtaccacctacgttcttacgttccgttaccg

SEQ ID NO: 91041 - DNA, 679 bp, Homo sapiens
  misc_feature: GYAE6OF01AORAA.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagccaccctctcctgcagggccagtcagaacnttggagcaacttagcctaggtaccaacaaaacctggaccagcctacccagacctcctctatttactcgttcactccaccgacggccactgactcgtaccccaacagtacttacaggtcggacgaggtacgggtcgtagggaactaaggtacctttacgacgttcctacgtaccgtactacgacgaccgtacggtaccgtaacgacgttacctaggtaaacgtacgtttcgggtaaccttaaggttttacttaacgttacgtaacctaaacgtaaacgttcggtacgggttacgtacggttaccgggtacccttaccgggtaaccggtttcccggacccgtacggggaacctaacggtaggtacggtaactacgtacgacgggtaccggtaagtcggttacggaccgttacgacctaccgtaattcgttcgtttcgttaacccg

SEQ ID NO: 91042 - DNA, 695 bp, Homo sapiens
  misc_feature: GYAE6OF01AMVS3.5.57.F02.1.454.CMB.1.raw
  modified_base (154)..(154): a, c, t, g, unknown or other
  misc_feature (154)..(154): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctcgagggganagacgccaccctctcctgcgagggccagtcaagaactagttggacactaacttacgccgtacggtaaccaaaacaaaaaccgtcggaccacgccctacccagaccttcctactactttactcgttcactaccgtaccgacggccactggtactccgtacccaaactagtacttacgaggtcggactagggacggtcggtacgggactacggtacctttacgacgtacctcctaacctgtaccgacggtacctaacggtaccgttaaccgaggttaccgtaaggtaaacggtccgtttaacggggtaactttaagttttaacgttaccgtacggttaacaaacgttaggttcggttacggttacgtaacggtccggtaccgtaccgggtaaaccggttcccgaaccggtacggaacctacggtaggtcgtaaagtaccgagtacgggacgtaacggtggtacggtagtacgactacctatcgttacgtcttacg

SEQ ID NO: 91043 - DNA, 811 bp, Homo sapiens
  misc_feature: GYAE6OF01BLFIA.5.57.F02.1.454.CMB.1.raw
  modified_base (153)..(153): a, c, t, g, unknown or other
  misc_feature (153)..(153): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagacgcccaccctctccgtgccgacgggccagtccaaggaaactagtttgggtaacgactaaacgtttacggccttaacgggttaaaccccaaaacaaaaaacccgtgggacccaacggtacccttaccccgaaggtaacctccccttactaactttttactccgtttaccaacttccccgaaccgacggggtacccaaccttggaacttccgtaccccaaacccgtagtaactttaccgaggttacggacgaaggtacggggttacgtagggggaaccagggtaacctttccgaaggttccctaccgaaccctagtacgaacgcgtaacgtaccgttacgaggttacctaaggaaaaccgttaccgtttacggtactttaacggttttaaactttaccggttactaaaccgtaaacctaaggtttcgttacgggttaccgtagggtaccggtacccgttaaccgggttaaaccggtttcccgggaacccggtaaccgggtaacctaaccggttagtacgggtaactaacggttacgacgggtaccgttaacgggttcgtacgggtacctaggtaccctaccgtaacgtttctaggttccctttaaccg

SEQ ID NO: 91044 - DNA, 767 bp, Homo sapiens
  misc_feature: GYAE6OF01CEMRP.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccaccctctcctgcgagggccagtcagaactagttggtagctaaacttacgaccgtacggtaaacccaaaaccgaaaaaccgtcggacccacggccctacccgaagtaccctcctactatttactccgttacactacccacgacgggccctacgtcgactccgtacccaacgagtacttcgaaggtcggacgagggtacggggtcgtacgggaactacggtacctttacgacgttccctaccgaaccctactacgacggtccgaacggtaccgtaacgaacggttccgtaaaggtaacgttacggttacggtacgtttagttttaacgttaccgttacgtaacctaaacgtacggtttaggttcgggttaacgacgggttaccggacccgttaccgggttaaccgggttccccgggacccggtaaacggggacccttaacgggtaacggtacgggtacttaacgggtccggtaaacgggggtaccgttaaaccggtggggtaccggtaccgttacccggaccgtaacctacggtttccgttcccgttactttaaccccg

SEQ ID NO: 91045 - DNA, 731 bp, Homo sapiens
  misc_feature: GYAE6OF01C0M4K.5.57.F02.1.454.CMB.1.raw
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
tcagatcagacacgcacgaccggtgctcgatttagctcgatatagttggggtttgggggaggaactgctcagttaggacccagtttttacggaaccatggaacgccccagcgcagcttctcttcctcctgctactctggctcccagactaccggttgggatatcgtgatggacgcagtctccagccatccgtgtctgtntcncgagggganagacgccacctcnccgtgcgacggccagtcagacngttganctaagtgccgtagaaccaaacgaaacctgaccacgacctaccagacctctacgttattactcgttacacctccgaaccgcggcctaacgtcgactaccgtaccaaccgtatactcgaggtgacgtacgggtaggtcgtaggaactacggtacctacgtacgttacaaccgactacgtaccgacgtacgtacgtaccgtactaacggttaacctaaggtaaacgttaccgttaggttaacctttaaggttttaaccttacgtaacgtacctaaagttacgttcgggtagttaacggaacggttccggtaacccggttaaccgtaaccgggttcccggaacggttaaccgggcgtaaacgggtaaggtaccggtaaaccgtaacgtaccgggtaaacgggtaccgtacgggttaacggggtccgttaccgaacgttaacccgtaaaccttcggttaacggttcctttacccgttaaccccg

SEQ ID NO: 91046 - DNA, 866 bp, Homo sapiens
  misc_feature: GYAE6OF01CNZVI.5.57.F02.1.454.CMB.1.raw
  modified_base (154)..(154): a, c, t, g, unknown or other
  misc_feature (154)..(154): n is a, c, g, or t
  modified_base (172)..(172): a, c, t, g, unknown or other
  misc_feature (172)..(172): n is a, c, g, or t
  modified_base (226)..(226): a, c, t, g, unknown or other
  misc_feature (226)..(226): n is a, c, g, or t
  modified_base (838)..(838): a, c, t, g, unknown or other
  misc_feature (838)..(838): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctggctccagataccggttgggganatcgtgatgacgcagtcnccagccatcctgtctgtcgtctccgaggggagagtacgccctaccctcgtccgngcgacggggccaggtacaaggtaactagtttacgggaacacctaaacgttcgaccgtacggtaaaccaaaacgaaaaaccgtcggacctacggaccctacccgtaaggtaccctaccttacttaacgttttactaccgttaccaccttacccgaacccgaacgggtccctaacgtacgttaactccggtaaccccaaacgtacggttaacttaccggaggttcggaccgtaaggggtacgggttaccgtacggggaaactaacgggtcctttaccggacgtttactaccgaaccttacgaaccgtagaccgtaacggtaccggttaaccgtaggtttacccggtaagttaacgggttaaccttacgggtacgttttaacggttttaactttaaccggtaacgtaaccctaaaacggttaaaggtttcggttaccggtttaacggtacgggtttaaccccgggttcgtaaaccccgggttaagggtttaccccgggaacccgtaaccggggtaacccgaaggttaaccgggttcgggtaaaccttcggttaacggaaccggggaccgtttaaacgggttggtaacccgggttgaaacccgtaccgtaaaccgnttttaaccgttcggttaacctttaccgg

SEQ ID NO: 91047 - DNA, 566 bp, Homo sapiens
  misc_feature: GYAE6OF01AU53C.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggganagagccaccctctcctgcagggccagtcagaacattggtagcaacttagcctggtaacccaaacaaaaacctggaccagcctcccagacctcctcatttactcgttcatccaccgagggccactgactcgtccccaaccagacttcagtggcaggagggtctgggacagacttcagtctcaccatcagcagcgtacagtctagaacgtcgttggactagttttaattacctgtaccaacgtaatgtaggtctaaggtcggcctacggtaacggttccggcccgtacgggacccagtacggtggtaactagacgtagggacgaacgtggtcggctcgacctaaccattccgttgttccgttaccg

SEQ ID NO: 91048 - DNA, 788 bp, Homo sapiens
  misc_feature: GYAE6OF01C8FHX.5.57.F02.1.454.CMB.1.raw
  modified_base (154)..(154): a, c, t, g, unknown or other
  misc_feature (154)..(154): n is a, c, g, or t
  modified_base (220)..(220): a, c, t, g, unknown or other
  misc_feature (220)..(220): n is a, c, g, or t
tcagatcagacacgcacgaccggtgctcgatttagctcgatataggttgggtttgggggaggaactgctcagttaggacccagacggaaccatggaagccccagcgcagcttctcttcctcctgctactctgctcccagataccggttgggganatcgtgatgacgcagtctccagccatcctgtctgtgtctccgaggggagagacgccaccctctcgngacgacgggccagtcaagaaactagttaggaacacctaaaacgtttacgaccgttacggtaaaacccaaaaaccgtaaaaaacccgtcgggacccaacggtcccctacccaaggtacccttcccttacttaacttttactaccgtttactaccttacccgaaccgacgggtacctaacggtactacgttacccgtaacccccaaaacgtacggtaacttaccggacggttacgggaccgtaagggtacggggtacgtacggggaacgtacgtaacgtttacgtacgttaccctaccgaacccataccgaacgaccgaaggtccgtaacgtaacggttacgttaaccggaaagttaacgtttcgggtaactttaaggttttacttactaggttaaccaaacgttagtcggtaggtacgaggtaccggtccgtaaccggtacggttacccgggacccgtaacgggaccgtaacgaacgggttcgaaaggttaaccgtacggaacgggttaccggtaaacgttggtacgggaccttacgggaccctacgtaactcgttcttacgttacccg

SEQ ID NO: 91049 - DNA, 630 bp, Homo sapiens
  misc_feature: GYAE6OF01AS1FV.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgcagggccagtcagaacngttggagcaattagcctaggtaaccaaacaaaacctggaccagccctaccagacctcctctatttactcgttacactccaccgacgggccactgtactccgtaccccaaacagtacttcgaaggtcggacgaaggtacgggtacgtagggaactacgtacttcgacgtcctaccgacctagtcgaagcgaacgccgtaacacgtacgtagaacgtacgttcggacttaaggtttactacgtgtaaccaatagttggtacggtacaggttcggacccttacggtaaccggttccggaacccgacgggtaccaagtcgggtaacgtactagtccggaaggtaccgaacggttggacggtacgtacgaccgtaacctagttctcgttccgttaccg

SEQ ID NO: 91050 - DNA, 693 bp, Homo sapiens
  misc_feature: GYAE6OF01B5GPK.5.57.F02.1.454.CMB.1.raw
  modified_base (171)..(171): a, c, t, g, unknown or other
  misc_feature (171)..(171): n is a, c, g, or t
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtcncagccatcctgtctgtcgtctcgagggganagacgcccacctctcctgcgagggccaggtcaagaactagttgggtacactaaacgttgccttacggtaaaccaaaaccgaaaaaaccgtcggaccacgccctacccgaagtacctacctacgtaactttaactccgttacactaccaaccgacggaccactcgtactaccgtacccaaccgagtacttacgaaggtcggcaagggtacggtcgtaggacacgtactacgacgtcacaacgactacgacgcacggtaccgtaccgtagtaccgtaaggaaacgttacgttggtaccttagttttaactacgtggtaacctaagtaagttcggtaacgtcgtaagggtcgtacccgtacgggtacccggttaccggaccgaacgggacccaagtacggtacggtacgtaacgtacggaacgggtaccgtaacggttcggtaccggtaccgttacgaacccgtacgtaacgttccgttggttaacccttacccg

SEQ ID NO: 91051 - DNA, 630 bp, Homo sapiens
  misc_feature: GYAE6OF01BNE3I.5.57.F02.1.454.CMB.1.raw
  modified_base (240)..(240): a, c, t, g, unknown or other
  misc_feature (240)..(240): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtcctccgaggggagagacgcccaccctctcctgcagggccagtcagaacnttggagcaacttagcctggtaaccaacaaaaacctggccagccctcccagacctcctcatttatccgttacactcccaccgagggcccactgactcgtaccccaacagtacttcaggtcggacgaggcgggtcgtgggacaggtacttcgacgtctccaccataccaggtccaaggtaccgtaactacggttctagaaacggtacgtttgggaccttaagttttactaacgttgtacaaactagtgttaggtacagtacgggtaccctacgggtaaccggttccggacccgtacgggaacccacgtacggtaggattacgtaccgagggtacccggtaagtcgggtacggtcgttacggacctacccgttatcgttcggttccttacccg

SEQ ID NO: 91052 - DNA, 829 bp, Homo sapiens
  misc_feature: GYAE6OF01CQVH2.5.57.F02.1.454.CMB.1.raw
  modified_base (206)..(206): a, c, t, g, unknown or other
  misc_feature (206)..(206): n is a, c, g, or t
  modified_base (786)..(786): a, c, t, g, unknown or other
  misc_feature (786)..(786): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagactaccggttggggacatcgtgatggacgcagtctccagccatcctgtctgtcgtcgtcgagggganacgacgccctacctctctggacgagggccagtacaacggtaaactgttacgggaacacctaacgttacggtacccgttaacggtaaaacccaaaaaccgtaaaaacccgtcgggaacctaaccgtacccttaaccccgaacggtaccctttaccccgttacgttaactttttaaccgtccgtttaacctaaccgtaccccgtaaacccggtacgggaccctaacggttagtaacccgtttaccgtaaccccaaacgtaacgttacgtttaccgaaacgggttcggaaccgtaaggggtacgggttaccggtaacggggaaacctaacgggtaacctttaccgtacgttacccgttaaccgaacccttacgtacgaaccgtacgtaacggtaccgtaaccgtacggttacgtaaacggtaaacggttccgttacggtaactttaacgttttaacgtacgtaacgtaacaagttaacgttggtaccgtacggttagccggttaccgtaacggttacccggttccggaccggtaacggtaacgacgtaggtacgaaacttcgaacggaacgggtctaaacggnggtacgtaccggtactacccgacttagtccttcgttccgttac

SEQ ID NO: 91053 - DNA, 619 bp, Homo sapiens
  misc_feature: GYAE6OF01A9PLS.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctcagccatcctgtctgtcgtctccgagggganagacgccaccctctcctgcagggccagtcagaactattggaagcaaacttgcctaggtaaccaaacaaaaaccgtggaccacgcctacccgagacctcctactatttactccgttactacgtcccaaccgaggccctacgtgactcgtacccaaccgtagacttcaggtcgacgaggaggtcgaggacgagtactcgacgtctacgaccatcagcgtagccgtactgtctaggaaacgttcgttacggacttaagtttactttacgtacgttaccaaacgtagttcggtacggtacgtaggtaccggtaccgttaccgggtaccggttccgacccgtaggaccctaggtacgtaggacgtaacgtcgaacggtgtaaacgtggtcggacctcgtccgaccttatctgtccgttaccg

SEQ ID NO: 91054 - DNA, 646 bp, Homo sapiens
  misc_feature: GYAE6OF01EXJNY.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (249)..(249): a, c, t, g, unknown or other
  misc_feature (249)..(249): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtcgtctcgagggganagacgcccaccctctccgtgcgacggccagtcaagaactgttgganactaacttcgcctaggtaaccaaactaaaaaccgtcggaccacgccctacccaagtacctcctactatttactccgttcactcccacgacggccagtcgactccgacccaactagtacttcgagtcgacgtaagggtacgggtcgtagggacacgtaccttcgtacgtcctacacctactacgacgacacggtacctaacgtagtacgtagaacgtacgttcgtacgttaatttactacgtctaactaactagttcggtgtacgtagggttaccgaccgttacgggtaccggttcccggaccgaacggtaccagtacgggtagtacgtacgtacggacggtacctaacggttcggcgtacgtaccgtactacgtactttcgtacgttccgttaaccg

SEQ ID NO: 91055 - DNA, 818 bp, Homo sapiens
  misc_feature: GYAE6OF01BU987.5.57.F02.1.454.CMB.1.raw
  modified_base (154)..(154): a, c, t, g, unknown or other
  misc_feature (154)..(154): n is a, c, g, or t
  modified_base (202)..(202): a, c, t, g, unknown or other
  misc_feature (202)..(202): n is a, c, g, or t
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctcagccatcctgtctgtgtctccgagggganagacgccacctctccngcgagggccagtccaagaactagttggtacnctaacttcgacctacggtaaccaaacaaaaacctggaccacgacctacccaagtacctccgtactatttactccgttacactcccaccggacgggtacccacgtgactccgtaacccaacctagtacttaccgaggtacggacgaagggtagggtaccgtaggggaacctaacggtaccgtttactacggttaccgtaaccaaccgtactaccgaacggtaacccgtacggttaaccggttaaccgtacggttaaccgtaggtaaaacgttaccggtttacgggaaccgttttaacgtttttaacttaaccggttaagttaacccgtaaaaccgttaaggttccggtttacgggtacggtaacggtttcccgggtaacccgttaaccgggtaacccgggttttccccgggacccccgggtaagggtaaccccgtaacggtacgggttaacggtaacgttaaaccggtacgggtaaaccgggtaccgttaaacggttgggttacccggtaccgttacgggtaacccctaaccggtaccgttttccggttcgttacccgttttaaaccccg

SEQ ID NO: 91056 - DNA, 584 bp, Homo sapiens
  misc_feature: GYAE6OF01CUAFN.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
tcagatcagacacgcacgaccggtgctcgatttagctcgatataggttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcagggccagtcagacattggagcaacttgcctaggtaaccaaacaaaaacctggaccacgccctcccagacctcctctattttactccgttcactcccaccgacgggcccactcgactcgtaccccaacagtacttcgagtggacaggaggggtcgtagggactaggacttcgacgtctcgaccatacagcagtcgtacagtcgagtaagtcttggcttagtttacttactgtacaacgtagtgtagtcaggtcggcctacggtaccggttccggacccgtaagggaccaggaggtcggaagttacacggacggacgtaacgtggtacggcttcgacctaacctgttccttgttcccttacg

SEQ ID NO: 91057 - DNA, 669 bp, Homo sapiens
  misc_feature: GYAE6OF01CLJD0.5.57.F02.1.454.CMB.1.raw
  modified_base (157)..(157): a, c, t, g, unknown or other
  misc_feature (157)..(157): n is a, c, g, or t
  modified_base (207)..(207): a, c, t, g, unknown or other
  misc_feature (207)..(207): n is a, c, g, or t
  modified_base (616)..(616): a, c, t, g, unknown or other
  misc_feature (616)..(616): n is a, c, g, or t
  modified_base (622)..(622): a, c, t, g, unknown or other
  misc_feature (622)..(622): n is a, c, g, or t
  modified_base (647)..(647): a, c, t, g, unknown or other
  misc_feature (647)..(647): n is a, c, g, or t
tcagatcagacacgcacgaccggtgctcgatttagctcgatatagttggggtttggggggaggaactgctcagttaggacccagacggaaccatggaagccccagcgcagcttctcttcctcctgctactctggctcccagactaccggttgggganatcgtgatgacgcagtctccagccatcctgtctggtgtcggtccgggganagacgcccaccctctcctgcgacgggccagtacaagtaactagttaggtacgacctaacgttacgaccgttacggtaaacccaaaaccgtaaaaaccgtcggacccaacgtcccctaccgaacgtaccttcctacttaagttttacctccgttaccaccgtcccaaccgtacggcctacgtacgactccgtaaccccaacgtagtacttaccgaggtacggacgagggtacgggtcgtaggactacgtaccttacgacgttaccacgacctataccgagacacggtacctaacgtacgttcgaagaacgttcgttaggtactttaggtttactacgttagtaacctaagtagttcggtgtacgtacggtccgtaccgttaccggtaaccgtccgaccgacggactacgnggtagntacgcgacggactaggcgtcggacngacctgtactcgtctgtcctac

SEQ ID NO: 91058 - DNA, 919 bp, Homo sapiens
  misc_feature: GYAE6OF01BMKHZ.5.57.F02.1.454.CMB.1.raw
  modified_base (153)..(153): a, c, t, g, unknown or other
  misc_feature (153)..(153): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggaagagcccaccctctcctgcgagggccaggtccaagaactagtttgggtagctaaacgtttaggcccttagggtaaacccaaaaccaaaaaaaccccgttgggacccaaacggtccccttaccccgaacggaacccttccccttactaactttttaagttccggtttaccaacttaccccgaacccgtacggggtacccctaacgttcggtaacttaccggtacccccaaaacccaacggtactttaccgaacggttcggaccgtaacgggtacggggttaccgttacgggggaacctaagggtaacctttacgaacggtttcctacctaacccaacgttaccgaacggccgtaagggacccgttaaccgaacgggtttaccctaagggtaaaacgttaccggtttacgggtaacctttaagggtttttaaacttaaccgttcgttaacgtaaaccgtaaagttagggtttacggtacgttaagggttccggtacccgttaccgggttaaacccggtttcccgggacccccggtaaacgggggtaaccctaaacccgggtacgggttacggtaaaccgttaacgttacccgggtaacggggtaacccggttaaaccgggtttcggggttaccggggtaaccccggtttaccgggtaaaccccgtaaaccccggttaagttttacccggttaccgggttttacccccttttaaccccggg

SEQ ID NO: 91059 - DNA, 530 bp, Homo sapiens
  misc_feature: GYAE6OF01ERC6Y.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (402)..(402): a, c, t, g, unknown or other
  misc_feature (402)..(402): n is a, c, g, or t
  modified_base (429)..(429): a, c, t, g, unknown or other
  misc_feature (429)..(429): n is a, c, g, or t
  modified_base (434)..(434): a, c, t, g, unknown or other
  misc_feature (434)..(434): n is a, c, g, or t
  modified_base (457)..(457): a, c, t, g, unknown or other
  misc_feature (457)..(457): n is a, c, g, or t
  modified_base (481)..(482): a, c, t, g, unknown or other
  misc_feature (481)..(482): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagngcccacctctcctgcagggccagtcagaactnttgganctaacttgcctaggtaaccaaacaaaaaccgtggacccacgccctcccagtacctcctactactttactccgttcactcccaccgacgggcctactagactcgtacccaaccagtacttcgagtcgcaggaggtcgtgggacagtctcgagtctcacntacagcagacgtacagtctagaacgtnttggnttagtttatatgtacatatgtgntgtgcctgtacgtcggccgagacnngtagactgtacgagtacgatggtacgctgccactatcgttgtcttacg

SEQ ID NO: 91060 - DNA, 830 bp, Homo sapiens
  misc_feature: GYAE6OF01BFD6H.5.57.F02.1.454.CMB.1.raw
  modified_base (152)..(152): a, c, t, g, unknown or other
  misc_feature (152)..(152): n is a, c, g, or t
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
tcagatcagacacgcacgaccggtgctcgatttagctcgatatagttgggtttgggggaggaactgctcagttaggacccagacggaacatggaagcccagcgcagcttctcttcctcctgctactctggctcccagataccggttgggganatcgtgatgacgcagtctccagccatcctgtctgtgtcctcgagggganagacgcccacctctccgngccgacgggccctaaggtcaaacggtaactagttagggtaacaccgtaaacgtttacgaccgtacggtaaacccaaaaaccgaaaaacccgttcggacccaaccgcccttacccgaacgtacctcccttacttactttaactccgttaccactaccccgaaccggtacgggtacccaacgtacgaaccttacccgaaccccctaaaccgtaagttaccgttaaccgaggttaccggacggtaacgggtaccggggtcggtaacggggtaaccgacggttaacctttaccgaagtcccgttaaaccgacctacgtaccgacgacgacggtaccgttaagtacgtacgttaaacgaaacggtcgttaacgggtctttaacggttttaacgttacgtaacgtaacccgtaattaaggttcgggtacgtttaacggtacgttaccgggttaacccgttaacgggttaaacccggtttccggggaaccccgaacgggtaaccccgtaggtaaggtccgggttaaagttaccgtacggtaaacgggtccggtaaccggttgggtaccgacggttccggtaacctaccgttaggtttcgttaccgttgtttaaccccg

SEQ ID NO: 91061 - DNA, 674 bp, Homo sapiens
  misc_feature: GYAE6OF01AZVQ8.5.57.F02.1.454.CMB.1.raw
  modified_base (206)..(206): a, c, t, g, unknown or other
  misc_feature (206)..(206): n is a, c, g, or t
  modified_base (255)..(255): a, c, t, g, unknown or other
  misc_feature (255)..(255): n is a, c, g, or t
  modified_base (558)..(558): a, c, t, g, unknown or other
  misc_feature (558)..(558): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggcctcccagataccggttggggatatcgtgatgacgcagtctccagccatcctgtctgtcgtcctcggagggganagacgcccaccctcgtcctgccgacgggccagtcaacgaactgttgganacgtaacttcgcctacggtaaaccaaaacgaaaacccgtcggaaccacgccctaccacgtacctcctactactttactccgttactaacctccccgaaccgtaccggtacctacgtacgtatacccgtaaccccaaacgtacgtacgttaccgaggtacggacgacgggtacgggtcgtaacgggacacggtactcgaactcgtacactactacgaacgcgtacgtaccgtagtcgtacgtaagtacgtcgttacggtactttaacgtttactacgtataaccaacgtaggtcgtacgggtanacggtacgtacccgtacggttacccgtcggaaccgacggtaccaggtacggtacgaatacggtacggacgtaccgtaaggtgggtcacgtaccgacactacgtcttcgtccttacg

SEQ ID NO: 91062 - DNA, 759 bp, Homo sapiens
  misc_feature: GYAE6OF01AOAOJ.5.57.F02.1.454.CMB.1.raw
tcagatcagacacgcacgaccggtgctcgatttagctcgatatagttggggtttgggggaggaactgctcagttaggacccagacggaaccatggaacgccccagcgcagcttctcttcctcctgctactctggctcccagataccggttggggagatcgtgatgacgcagtctccagccatcctgtctgtcgtctcggaggggagagacgcccacctctcctagcgacgggccagtcaacgaactagttggtacgacctaacgttacgaccgtacggtaaacccaaaactaaaaccgtcggaccacgccctaccgacgtacctacctactactttacgttaccgttacctacctacccgaccggtacgggacctaacgtcgtaaccgtcccgtaacccctaaacccgtagtacgttacgtacggtacggacggtaacgggtacggggttaccggtacgggactaaccgtacgttacggtacgttcctaccgaaccgtactaccgtaacgaccgaacggtaccgtaacgtacgttacgtaggtaaccggtacgttacggtaacgtttacgtttaacgttacgtacgtaactaacgtacgttaggtacggtacgtacgttcggtacccgtacgggttaacccgggtcccgggtaaccggacgggtacctaacggtgtaacggtactaccggtacgggtacggtaacggtagtcgggacggtccgtacgtacctacgtaactttcgttacgttccttcccg

SEQ ID NO: 91063 - DNA, 710 bp, Homo sapiens
  misc_feature: GYAE6OF01BMUVA.5.57.F02.1.454.CMB.1.raw
  modified_base (153)..(153): a, c, t, g, unknown or other
  misc_feature (153)..(153): n is a, c, g, or t
  modified_base (165)..(165): a, c, t, g, unknown or other
  misc_feature (165)..(165): n is a, c, g, or t
  modified_base (200)..(200): a, c, t, g, unknown or other
  misc_feature (200)..(200): n is a, c, g, or t
  modified_base (697)..(697): a, c, t, g, unknown or other
  misc_feature (697)..(697): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctgctcccagataccggttgggganatcgtgatgacncagtctcagccatcctgtctgtgtctcgagggganagacgcccaccctctcctggcgacgggtccagtcaagaactgttaggacgctaacgttagccgttacggtaaccaaaaccgtaaaaaccgtcgggaccaacgccctacccaagtacctccctacgtattttacgtcgttaccaacgtcccgaaccgacgggcctacgtgactaccgtacccaaacgacgtacttcgaacggtggacgtagggtacgggttcgtacggggaactacgtactacgtacgtaccgtccaactacgtacgacgacgacgtaccggtaactacgtcgtaagaaggttaccttgggaactttacgttttaactacgttcgtaacgtaaacctaggttaggtacgtagtacggttaccggtaccgtacggtaacccgttccggggaacccgtacggggaacctacggtaggtacgtaaagtaccgttacgggacgtaaccggtggtttcgggcgtaccgtacgacctaaccgttatccgggttnttacccggttacc

SEQ ID NO: 91064 - DNA, 653 bp, Homo sapiens
  misc_feature: GYAE6OF01EU9VV.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtcgtctccgagggganagacgcccaccctctcctagccaggggccagtcaagaactagttaggtagactaacttagcctacggtaaccaaaccaaaaaccgtgaccacgccctacccagtacctcctactatttactcgttacactccaccgacggccactgactcgtacccaactagtacttacaggtcggacaggtacgggtacgtagggaacacgtaccttacgtaacgtcctaccaacctataccgacgtcgacgtaccgtatacgtcgtagaacgtcgttggactttagtttacttaacgtgttaccaaacgttagtcggttacggtacgtaggtaccggtaccgtaccggttaaccggttccgggaccccgtaaggaaccctaggtagtacggtatacgtacgtcggtaacgtacggtggtaaccgtcgaccgtacgacttagtcgttatccgttaccc

SEQ ID NO: 91065 - DNA, 505 bp, Homo sapiens
  misc_feature: GYAE6OF01CTZEY.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (304)..(304): a, c, t, g, unknown or other
  misc_feature (304)..(304): n is a, c, g, or t
  modified_base (396)..(396): a, c, t, g, unknown or other
  misc_feature (396)..(396): n is a, c, g, or t
  modified_base (430)..(430): a, c, t, g, unknown or other
  misc_feature (430)..(430): n is a, c, g, or t
  modified_base (474)..(474): a, c, t, g, unknown or other
  misc_feature (474)..(474): n is a, c, g, or t
  modified_base (479)..(479): a, c, t, g, unknown or other
  misc_feature (479)..(479): n is a, c, g, or t
  modified_base (491)..(491): a, c, t, g, unknown or other
  misc_feature (491)..(491): n is a, c, g, or t
tcagatcagacacgcacgaccggtgctcgatttagctcgatatagttggggtttgggggaggaactgctcagttaggacccagacggaccatggaagccccagcgcagcttctcttcctcctgctactctggctcccagataccgttgggganatcgtgatgacgcagtctccagccatcctgtctgtgtctccagggganagacgcccacccttctcctagcagggccagtcagaacagttggagcaacgttgcctaggtaaccaaacaaaacctggccagcctcccagacctcctcatttancgttcatccaccgaggccatgatcgtacccaacagtattcagtggacaggagggtctgggacagacttcagtctcaccatcagcagcgtacngtctagaatacttggctagtttatactgtacaanatgtgtcagtggcctagtacgtcgaccaggccagagtgatacgngaggnaacgtggagctncgacatctgtctcg

SEQ ID NO: 91066 - DNA, 743 bp, Homo sapiens
  misc_feature: GYAE6OF01ASCPI.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagacattggagctaacttagcctggtaaccaaacaaaacctggaccagccctacccagacctcctacatttactccgttacactacccaccgagggcctactgatcggtaccccaaccagtacttacgaaggtcggaccgaaggtacggggttcgtacgggggaactaacggtacctttcgaacggttcctacccgtaacccagttaccaacggtaccgtaacgggtaccgttaacctacgggttaccttaaacggaaacggttacgtttccgggtaaccttagtttttaacgtttacctacggttaacctaaacgtaagtttaggtacgggttacttaagggttccggtacccgtttaccgggtaaacccgggtttcccgggacccccgtaaggggtaacccctaaccggtacggggttacgtaacgttacgttaaccggtcgggtaccggtaaacggttgggtacgggtccttagggacccctaccgtaacttccgttggttcccttacccg

SEQ ID NO: 91067 - DNA, 708 bp, Homo sapiens
  misc_feature: GYAE6OF01BONYO.5.57.F02.1.454.CMB.1.raw
  modified_base (247)..(247): a, c, t, g, unknown or other
  misc_feature (247)..(247): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgcccaccctctcctgcgacgggccagtcagaacagttggancaacttacgccttacggtaaccaaacctaaaaaccctggacccacggccctacccaacgtaccttcctactactttacttccgttaccactcccaaccgacgggcccacgtcgactccgtaccccaacagtacttcgaggtcggacgaggacgggtcgtagggacacgtacttcgacgttctacaaccacgtacgacgtacacgtaccgtacgtagttacgtaggtaaacgtcgttagggtaccttagttttaacttaaccgtgttaacctaacgtaagttcgggttacggtcgtaacggtcgggtaccccttaccgggttaacccggttccgggaccccgtaacgggaaccctacggtaacgggtaggtaacttacgtaaccgggacgtaccgggttaaacttggggtaccggtaccgtcgtaacccgtaccgttaacgttcgttccggttcttaacccg

SEQ ID NO: 91068 - DNA, 629 bp, Homo sapiens
  misc_feature: GYAE6OF01A81JA.5.57.F02.1.454.CMB.1.raw
  modified_base (154)..(154): a, c, t, g, unknown or other
  misc_feature (154)..(154): n is a, c, g, or t
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (356)..(356): a, c, t, g, unknown or other
  misc_feature (356)..(356): n is a, c, g, or t
  modified_base (420)..(420): a, c, t, g, unknown or other
  misc_feature (420)..(420): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgaggggagagacgcccacctctcctgcgagggccagtcagaacngttggancaacgttgccgtggtaaccaaacaaaaaccgtggaccacgcctcccaagacctcctctatttactcgttcagtcccacgacggtccactgactcgtacccaacagtactnacggtcgcgaacggtgggtctagggacacgtacttcgagtcctacaccatcagccagtcctaangtctaggaacgtacgttggacctttagtttacttatacgtactaacgtagttacggtggtacgtaggttcgggtacccgttaacgggtaaccgggttcccgggaccccgtaacggggtaccctaacggtaggtacggtaacgttacgtacggtaccgggaacgttacgtgggtacggtcgtacgactacctagtcttcgtcctttaccg

SEQ ID NO: 91069 - DNA, 704 bp, Homo sapiens
  misc_feature: GYAE6OF01AG5ZN.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
  modified_base (248)..(248): a, c, t, g, unknown or other
  misc_feature (248)..(248): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtcgtctccgagggganagacgcccaccctctcctgcagggccagtcagaactagttggtanactaacttcgcctacggtaaccaaacaaaacctggaccacgccctacccagacctcctactactttactccgttaccactcccgaccgacgggtccctacgtgtactccgtaaccccaaccgtagtacttcgaggtcggacgtacgggtacgggtcgtacgggaactacggtactttacgacgttccgtaaccaacccgtacgtaccgaacggcgtaacggtacccgttaacgacgttaccgtaaggtaacgttccgtttacgggtacttaacgtttttaacttaccgtacgttaaccaaacgttaagttcgggtacgtaccgtaggttcggtacccgttaacgggttaaccggtcccggaaccgtacgggaccaggttacggatacgtacggtaccgacgggtactacggttggtacgacgtccgtaacctacgtattcgtcgttaccgtacccg

SEQ ID NO: 91070 - DNA, 639 bp, Homo sapiens
  misc_feature: GYAE6OF01DVNO7.5.57.F02.1.454.CMB.1.raw
  modified_base (201)..(201): a, c, t, g, unknown or other
  misc_feature (201)..(201): n is a, c, g, or t
  modified_base (243)..(243): a, c, t, g, unknown or other
  misc_feature (243)..(243): n is a, c, g, or t
  modified_base (620)..(620): a, c, t, g, unknown or other
  misc_feature (620)..(620): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagatcgtgatgacgcagtctccagccatcctgtctgtgtctccgagggganagacgccaccctctcctgcagggccagtcagaactattgganctaacttagcctaggtaaccaaacaaaaacctggaccagcctaccagacctcctactatttactcgttcactccaccgacggccactcgactcgtaccccacagtacttacgagtcgcgaggagggtcgtagggactacgtacgttcagtcctacaccgatcacgacagtcgtacgtagtcgtagtaacgtacgttggacctttaagtttactttaacgtgttaactaaacgtaagtttggtaggttacgaggttccgggtacccgtacgggtacccggttccgggacccgtaacggggaccctaacgggtacggttgtaacgtacgtaccggaacgggtacccaaacggttggacggtcctaacggccaaaccttnttacgtcggttcttaaccg

SEQ ID NO: 91071 - DNA, 769 bp, Homo sapiens
  misc_feature: GYAE6OF01BAVP4.5.57.F02.1.454.CMB.1.raw
  modified_base (153)..(153): a, c, t, g, unknown or other
  misc_feature (153)..(153): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtcctccgaggggagagacgcccaccctctcctgcagggccagtcagactgttggtagctaacgtgcctaggtaaccaaacaaaaccgtggaccacgacctacccagtacctcctactatttactcgttcactccaccgacggccacgtgactcgtaccccaaccgtagtacgttacaggtcggacgtaagggacggggttccgtaggggaactaacggtacctttaccgacggttaccctaccgaaacccgtacgttaccgaacgggtacctaacgggtacccgttaacgtaacgggttaccttacgggtaaaacggttaccgtttacggggtaaccctttaaacgggttttttaacttaaccggtttagttaacctaaaaccgttaagtttcggttacgggtaccgtacgggttaccgggtacccgttaaccgggtaaacccgggtttccgggaacccccgtaacggggtaccccaacggtacgggttaccggtaagttaacgacggtacgggtaccgtaacggttcgggtacggacgttacgtacccgaccttagttccgttacggtacctttacccg

SEQ ID NO: 91072 - DNA, 828 bp, Homo sapiens
  misc_feature: GYAE6OF01CUZN7.5.57.F02.1.454.CMB.1.raw
  modified_base (156)..(156): a, c, t, g, unknown or other
  misc_feature (156)..(156): n is a, c, g, or t
  modified_base (204)..(204): a, c, t, g, unknown or other
  misc_feature (204)..(204): n is a, c, g, or t
  modified_base (259)..(259): a, c, t, g, unknown or other
  misc_feature (259)..(259): n is a, c, g, or t
tcagatcagacacgcacgaccggtgctcgatttagctcgatatagttgggtttgggggaggaactgctcagttaggacccagacggaaccatggaagccccagcgcagcttctctttcctcctgctactctggctcccagataccggttggggganatcgtgatgacgcagtctcagccatcctgtctgtgtcctcgagggganagacgcccaccctctccgtggcgacgggccagtccaaggaacctagtttgggaancctaaaccgttagcccttacgggtaaacccaaaaccgtaaaaaaccctcggacccaacggtccctacccgagtacctccttactattttacgtccgttaccactacccaccgacgggccctacgttcgacttaccggtaccccaaaccgtacgtaacttccgaggttacggtacgaacggtacggggtaccgttaggggaacgtagttaccgtttcgacgttcctaccaaccgtactaccgacgacggtaccgtacgttaaccgacggttaccttaggaaacgggttacgtttagggaccgtttaagttttaacctttacgtacgttaacctaaacgttacgtttacgggtttacgggtactaacggggtttacccgggtccctttaaccggggttacccggtttacccggggaccccgggtaacggggtaaccccgaacggttacgggttacggtaaaccgtttacggtaacccggtaacggggtaaccggtaaaccgggtttgggtacccgggtccttaacgggaccctacccggttacgtttccgttcgtttcccgtttaaccccg

SEQ ID NO: 91073 - DNA, 665 bp, Homo sapiens
  misc_feature: GYAE6OF01AKORS.5.57.F02.1.454.CMB.1.raw
  modified_base (152)..(152): a, c, t, g, unknown or other
  misc_feature (152)..(152): n is a, c, g, or t
  modified_base (200)..(200): a, c, t, g, unknown or other
  misc_feature (200)..(200): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagataccgttgggganatcgtgatgacgcagtctcagccatcctgtctgtgtctccgagggganagcgcccaccctctcctgcgacgggtccaggtcaagtaactgtttagggtacgctaacgttacgccttaggtaacccaaaacaaaaacctcgggaccacgcctacccagaccttcctctactttctcgttcactccaccgacggccactgtactcgtacccaacgagtacttacgaggtcggacgaggtacggggttctacggggaactacggtactttcgacggttccttacaacccagttacccaggccctaaggtaccgttaacaggttaccgttaagggaacgttacggttacggtaactttaacggttttaacttaccgtagtaaccaacttaagttgggttacgttactacggtcgtcccgtaacggtaccggttccggacccgaggtaccacggagtgtaactcgtacggacggtacgacgttggcggtatacgccctaactagtcctgttcttaccg

SEQ ID NO: 91074 - DNA, 605 bp, Homo sapiens
  misc_feature: GYAE6OF01EZCCW.5.57.F02.1.454.CMB.1.raw
  modified_base (372)..(372): a, c, t, g, unknown or other
  misc_feature (372)..(372): n is a, c, g, or t
  modified_base (403)..(403): a, c, t, g, unknown or other
  misc_feature (403)..(403): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggggacagagcccaccctctcctggccaggggccaggtccagaacattggtagcaacttgcctggtaacctaacaaaaacctggcccagcctcccagactcctctactttatcgttcactcccgaccaggggccactgactcgtacccaaccagactcgagtgacaggagggtcngggcagctcagtctcacatcagcagccgtanacgtctagaaacgtacttgggtacctagttttacttaacgtcgtacaaccgtaattggtagtcgtagttcgggtacccttaggtaaccggtttccgggacccgaacggggtacccacgtaggtgggaatacgttacggacggtcgaaacggttcgggtaggccgttcgacccgtaccaagtttccgtggttacctttacccg

SEQ ID NO: 91075 - DNA, 685 bp, Homo sapiens
  misc_feature: GYAE6OF01DBEJT.5.57.F02.1.454.CMB.1.raw
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtcctccgagggganagacgcccaccctctccgtgcgagggccagtcaagaactgttggacnctaacttagcctaggtaaccaaacgaaaaccgtggaccacgccctaccacgtacctcctctatttactccgttacactccgaccgacgggccctacgtcgtaactccgtacccaacctagtacttcgagtcggacaagggtacgggtcgtagggaactacgtactttacgacggttcctaccacctagtccacgctaacgtccgtaacgtagtaccgtaaggaacgttacgttacggacctttaggtttaacttaaccgtacgtaactaaacgtagttggttacggtcgtaacggttcggtaccccgttacgggtaacccggttcccgggacccgtaacgggtaccaacggttacgtacggtatacgtacggaccggtacggtaacggtcggtacggtccgtacgtacccgtaactagttccctgttcccttacg

SEQ ID NO: 91076 - DNA, 696 bp, Homo sapiens
  misc_feature: GYAE6OF01BF4BF.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctctcagataccgttgggganatcgtgatgacgcagtctccagccatcctgtctgtgtctccaggggganagacgccaccctctcctgcagggccagtcagaacnttggancaacttagcctggtaccaaacaaaaacctggaccagccctccagacctcctctatttatccgttcactcccaccgacgggccactgactcgtacccaaccagacttcgagtcggcaggacgggtctagggactaggactttcgagttcctacgaaccctattaccaagccacggaccgttaacaggttactaggaacgtactttcgggacttaggttttaacttacgttagttaaccaaacgtaagttggttacggtacgtacggttacgggtaccccgttacgggtaacccgtttccgggaacccccgtagggggtaaccccctaacggtaacgggttacgggtaaacctttaacggtccggtaaccggggtaaccgtaaacccgggtttagggttaccgggacccgttacggaccccgtaacccgtaacgtttccggttacgtttaccccg

SEQ ID NO: 91077 - DNA, 679 bp, Homo sapiens
  misc_feature: GYAE6OF01ENAIV.5.57.F02.1.454.CMB.1.raw
  modified_base (155)..(155): a, c, t, g, unknown or other
  misc_feature (155)..(155): n is a, c, g, or t
  modified_base (169)..(169): a, c, t, g, unknown or other
  misc_feature (169)..(169): n is a, c, g, or t
  modified_base (210)..(210): a, c, t, g, unknown or other
  misc_feature (210)..(210): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagactaccggttgggganatcgtgatcggacncagtcctccagcctatcctgtctgtcgtcctcggagggganagcgccctaccctctccgtgaccgacgggccagtcaagaactgttaggacactaacgttcgccgtacgtaaaccaaaacctaaaaccgtcggaccacgccctaccgacgtacctcctacttactttacgtccgttaccaccgtaccccaaccggaccgggtaccctacgtacgtaaccgtcccgtaaccccaaactaggtacttacggacgggtacggacgtaacggggtcggtacggtacggaactacgtcttacgacgttccacacgtataccgagactacgtacgtacgtagtacgtaagacgtacgttacggtactttagtttactcgtatactaatgtcggtgacgtggtacctccgtacggtaccgtccggacggtaaccggactagtaggtacgtacgtacgtcggacggtacgtacggtggaccggtctacgacctacgttatccggttctccgttacccg

SEQ ID NO: 91078 - DNA, 607 bp, Homo sapiens
  misc_feature: GYAE6OF01A39LQ.5.57.F02.1.454.CMB.1.raw
  modified_base (243)..(243): a, c, t, g, unknown or other
  misc_feature (243)..(243): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagccaccctctcctgcagggccagtcagaacagttggtanctaacttagcctggtaaccaaacaaaaaccgtggaccacggcctacccagtacctccgtactattttaactcgttacactccaccacgggccacgtcgatcgtacccaacagtacttcaggtacgcaggtagggtcgtagggacacgtcgttacacgttccgcaccgtatcagcagacgtacagtctagaacgtacttcggtacttagtttacttacgtcgtacaacgtaagttcggtagggtactaggtcggtacccttacggtaaccggtttccggaccggacgggacctaacgaggtaggacttacgcgacggtacgaacgtcgggtacggtctcgtaccacctagtctggtttccttccg

SEQ ID NO: 91079 - DNA, 999 bp, Homo sapiens
  misc_feature: GYAE6OF01DMDKU.5.57.F02.1.454.CMB.1.raw
  modified_base (152)..(152): a, c, t, g, unknown or other
  misc_feature (152)..(152): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggganatcgtgatgacgcagtctccagccatcctgtctgtgtcctccgagggganagacgcccacctctcctggccagggcccaggtccaaggaaacctagttttggggtaacacctaaaccgttttaggcccgttacggggttaaaccccaaaaccgtaaaaaaacccgttcggggaccccctaaggccccctttaaccccgaacggtaaccctttacccccgttaccttaacgtttttaactttaccggtttacctaacgtttcccccaacccggtaacgggggccccctaacgttacggtaaacttaccggttaaccccccgaaacccgtaacggtaaccttttaccgaacggttacgggtacctaaggggtaacggggttcgtacggggaactaacggtaccgtttaccgtacggttcctaccgtaaccctaagttacccgaacggtccgaaggtacccggttaaaccgtaggtttacccgtaaggtaaacggtaaccgttttaggggtacccttaaagggttttttaactttaaccggttacgttaacccgttaaaacgttaacggtttacgggtttaacggggttacctaacgggggttttaccgggaccccgttttaacccgggggttaaaccccgggttttaccccggggtacccccgggtaaacggggggtacccccgtaaacgggttaaccgggtttacgggaaacgttttaacccggtaacccgggtaaacgggtacccgggttaaaacgggtttccgggtaccggggtaaccctttacccggtacccggtaaaccccgttacgttttccgggtttacccgttacccgttttaacccccgg

SEQ ID NO: 91080 - DNA, 711 bp, Homo sapiens
  misc_feature: GYAE6OF01BDLNU.5.57.F02.1.454.CMB.1.raw
  modified_base (155)..(155): a, c, t, g, unknown or other
  misc_feature (155)..(155): n is a, c, g, or t
  modified_base (205)..(205): a, c, t, g, unknown or other
  misc_feature (205)..(205): n is a, c, g, or t
  modified_base (255)..(255): a, c, t, g, unknown or other
  misc_feature (255)..(255): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttgggganatcgtgatgacgcagtctccagccatcctgtctgtgtcctccgagggganagacgcccaccctctcctgaccgagggccagtcaaggaactagttggtanacctaacttcgcctaggtaacccaaacaaaacctggaccacgcctacccagacctcctactactttactccgttacactccaccgacggcctacgtgactccgtacccaactagtacttacgaggtcggacgtagggacgggtcgtacggggaacgtacgtaccttacgacggttacctaccgaacctactaccgacgaccgtaacggtacccgtaacgtacggttaccgtaacggtaaacggttaccggtttacgggaccttttaacggttttaaccttaacgttaccgtaactaaacgttaagttcggttaccgggtactacgggttacggacccgttacgggttaaccggttccggacccgaacgggaccgaagtacggtaggacttaacgtacggaacggtccgaaggttggaccggtcgttacgacctaacgtagttccgttgttcctacg

SEQ ID NO: 91081 - DNA, 873 bp, Homo sapiens
  misc_feature: GYAE6OF01DUXSH.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
tcagatcagacacgcacgaccggtgctcgatttagctcgatatagttgggtttgggagaggaactgctcagttaggacccagacggaaccatggaagccccagcgcagcttctcttcctcctgctactctggctcccagataccgttgggganatcgtgatgacgcagtctccagccatcctgtctgtgtctcgagggganagacgcccaccctctccgtgccgacgggcccaaggtcaaggtaactagtttagggaacgacctaaacgtttacggcccgttaacgggtaaacccctaaaaaaccgtaaaaaaccccgttcggaacccctaacggtacccccttaccccgaacggtaaccccttaccccttaccttaaactttttaaccgttccgttttaccaaccttacccccgaacccggtaacggggtacccctaacgttacggtaaccttacccgggtaaccccccaaaaccggtaaggtaacgtttccggaagggttccggggaacgtaacgggggtacggggttaccggtacggggaaaccttaaccggttaactttaccgacggtttacccctaacgtaaaccctagtacccggaacggtacccgaacggttacccgttaacgtacgggtttaacccgttaacgggtaaaccgttaccggttttaacgggtacctttaaacggtttttttaactaaccggttagttaacccgtaaaacgttagtttacgggtacgttccgtaacgggttccgtcccgtaacgggttaacccggttccggaacccggacgggtaccaacggtggtaacgtagtaccgtcggaacggacgtacgttgggcgactcggacctacgtctcgtcgttaccg

SEQ ID NO: 91082 - DNA, 767 bp, Homo sapiens
  misc_feature: GYAE6OF01BGFMK.5.57.F02.1.454.CMB.1.raw
tcagatcagacacgcacgaccggtgctcgatttagctcgatataggttggggtttgggggaggaactgctcagttaggaccagacggaaccatggaagccccagcgcagcttctcttcctcctgctactctggctcccagataccggttggggagatcgtgatgacgcagtctccagcatcctgtctgtgtctacgaggggagagacgtccacccgtctccgtgacgacgggacctaaggtacaacggaaactagtttaggtaacgacctaaacgtttacggaccgttaacgggtaaacccaaaaaaccgtaaaaaccgtcggaccctaaccggtaccctacccaagtacccttcctacttaactttaacgtccgttacaccgtacccaacggacggacctaacgtagtactaccgtaaccccaaacgtagtaacgttacgaggtcggacggaggtaacgggtcgacgggaactaacgtactttaccgacgtacaccgtaaccacgtacgaacggtcaaggttccggtaatacggtaccgtaagtaaacggtccgttgtaacgttagttttaaccaacgtacgtaactaaacgtacgttagggtcgttaaggcgggttacgaacccgttacgggtaaccgggttccggacccggtaaacggcccgtaaagcggttagtaacgtatacccgggtagtaacccggtaaggttcgggacccggtaggttaacacccttaccctaaagtccgtttaccggttctaacccgg

SEQ ID NO: 91083 - DNA, 722 bp, Homo sapiens
  misc_feature: GYAE6OF01CHGLD.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccacccgtctccgtgccagggccctagtccaagaacctagtttgggaacgcctaaacgttgcccgttacggtaacccaaaaccgaaaaaccgtcggacccacgccctacccagtacctcctactatttactccgttacactccaccgacggcctactgactcgtaccccaacgagtacttcgacggtacgacgaacgggtacgggtcgtacgggactacggtaccttcgacgttcctaccgacctactaccgacgtaccgacggtaccgtaacgtacggtacgtaaggaaacgttaccgtttacgggtactttaacgttttaacttaccgttaacgtactaaaccgttagttcggtacggttcgtaaggttccggtacccgttaccgggtacccggttaccggtacccgaacgggtaccctaagtacggtaggtactacggtacggacgggtacgtaacggttggtaccgtacttaccggacctaaccgttattccgttcgttcccgttacccg

SEQ ID NO: 91084 - DNA, 661 bp, Homo sapiens
  misc_feature: GYAE6OF01BWQLA.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctntcctgcagggccagtcagaactnttggtancaacttgcctaggtaccaacaaaaacctggccagcctcccagacctcctacatttatcgttcatccaccagggccacgtgatcgtccccaaccagactttcgaagtcggactaggaggggtcctaggggtacaggtacctttcgagtcctccaacctatcgagccagccgtaacaggttcaggaacgtacgttggaccttaagttttaacttaccgttagtaccaaacgtagtgttggtcgaagttcgggcccgttacggtaaaccggtttccgggccccgtaacgggaccccgtaacgtagggttacggacgtttaacgtacgggaccggtaccggtaaacgtttcgggtacgggtacccgttaccgggaaccctaaaccccgtagttcccgtttccggtttcctttaaccccg

SEQ ID NO: 91085 - DNA, 499 bp, Homo sapiens
  misc_feature: GYAE6OF01AK82M.5.57.F02.1.454.CMB.1.raw
  modified_base (470)..(470): a, c, t, g, unknown or other
  misc_feature (470)..(470): n is a, c, g, or t
  modified_base (473)..(499): a, c, t, g, unknown or other
  misc_feature (473)..(499): n is a, c, g, or t
tcagatcagacacgcacgaccggtgctcgatttagctcgatatagttgggtttggggggaagaggaagactgacggtccccccaggagtccagagtgcgtcgcaagtattggcagtgtgaaattttgacaccttatatgcagactctgtgaggggccgcttcaccgtgtccagagacaactccaagaacgccgtctatttgcagatggacagcctgagagtcgacgacacgggcatctattattgtacggcggccgagcaatactctcttactttctggagtcagggagtccccggtcactgtctcctcagcctccaccaagggcccatccggtccttcccccctggccaccctcctccaagacgcaccctcgtgggggcacacggcggccctgggctggccctggtccaaggaccttacttccccgtgtcccgtagtctcgtaggcgggcggtgtccggagcggcgacngtnnnnnnnnnnnnnnnnnnnnnnnnnnn

SEQ ID NO: 91086 - DNA, 581 bp, Homo sapiens
  misc_feature: GYAE6OF01A3ZFI.5.57.F02.1.454.CMB.1.raw
  modified_base (202)..(202): a, c, t, g, unknown or other
  misc_feature (202)..(202): n is a, c, g, or t
  modified_base (411)..(411): a, c, t, g, unknown or other
  misc_feature (411)..(411): n is a, c, g, or t
  modified_base (554)..(554): a, c, t, g, unknown or other
  misc_feature (554)..(554): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggganagagccaccctctcctgcagggccagtcagaacattggtagcaacttgcctggtaaccaacaaaaacctggaccaagcctcccagacctcctactatttatcgttcactcccaccgacgggccactcgactcgtaccccaaccagtacttcgagtcggacaggagggtcgtagggacaggtacttcagtctacaccatcagcagcctancgtactagaacgacttgacttagtttattacgtgtactaactaagttcgtaggttacagtcggtaccgtcggtaaaccgttccgggaccctaacgggacccagaacggtgaacttagtaccgaggacgtaacgttggtacggntcggactacaatcccgtgtccgttacc

SEQ ID NO: 91087 - DNA, 753 bp, Homo sapiens
  misc_feature: GYAE6OF01C6ABT.5.57.F02.1.454.CMB.1.raw
  modified_base (154)..(154): a, c, t, g, unknown or other
  misc_feature (154)..(154): n is a, c, g, or t
  modified_base (167)..(167): a, c, t, g, unknown or other
  misc_feature (167)..(167): n is a, c, g, or t
  modified_base (190)..(190): a, c, t, g, unknown or other
  misc_feature (190)..(190): n is a, c, g, or t
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
tcagatcagacacgcacgaccggtgctcgatttagctcgatatagttgggtttgggggaggaactgctcagttaggacccagacggaaccatggaagccccagcgcagcttctcttccctcctgctactctggctcccagataccgttgggganatcgtgatgacgnagtctccagccatcctgtctgtntctcgagggganagacgccaccctntctgcgagggccagtcagaacagttggagctaacgttagcctaggtaaccaaaccaaaaaccgtggaccaacgccctacccagacctcctactatttactccgttacactaccgaaccgacgggtaccctacgttggacttaccgtaccctaaaccaaggtactttacgacggttcggaccgtaagggtacggggttctacggggaactacggtacctttcggacgttcctaccaacctacgtaccgaaggaccaagggtacccgttaacgtacggttacccgtaaaggtaaacgttaccggtttaaggtaccgttttaaggtttttaactttaacccggtttgtaaaccctaaagtaacgttttgggttacgtaccgtaagggttccgggtaccgtttacccgggtaccgggttaccggtcccgaaggggttacccaacggtaggttacggacttaagtccggtaacggacggttaacgttcgggtcggtaccgtaccgtaccgtaaaccgttcttacgtttccggtactttacccg

SEQ ID NO: 91088 - DNA, 713 bp, Homo sapiens
  misc_feature: GYAE6OF01D3RQH.5.57.F02.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (260)..(260): a, c, t, g, unknown or other
  misc_feature (260)..(260): n is a, c, g, or t
  modified_base (423)..(423): a, c, t, g, unknown or other
  misc_feature (423)..(423): n is a, c, g, or t
  modified_base (501)..(501): a, c, t, g, unknown or other
  misc_feature (501)..(501): n is a, c, g, or t
  modified_base (525)..(525): a, c, t, g, unknown or other
  misc_feature (525)..(525): n is a, c, g, or t
  modified_base (674)..(674): a, c, t, g, unknown or other
  misc_feature (674)..(674): n is a, c, g, or t
tcagatcagacacgcacgaccggtgctcgatttagctcgatatagttggggtttggggggaggaactgctcagttaggacccagacggaaccatggaagccccagcgcagcttctcttcctcctgctactctggctcccagataccggttggggagatcgtgatcgacgcagtctccagccatcctgtctgtgtccncggaggggagacgacgcccacctcnccgtgcgacggtccagtacacgaactagttacgggaanacctaactacggtaccgttaccgggaaaccaaaaaccgtaaaaaccgtcgggaccaccgtaccctaacccgtaatacccttaccccgtattaacttttactcgttacaaccgtacccgaaccgacgggacccctagtacgtaacgttacccgacccaaaacgngtaacttcggtaaggtcggaccggaagggtaccgggtagtacgggaaactacggattaccgagtaccctacaccgtancgtagccaagtccgtataacggtntaaggaacttacggttgtaacgttagtttaactagtacgtactaacgtagttcggtagggtacgtacgtcggacctacgggtaacggttccgaaccgggtacgaacgtacgtagggtacgagtacgtaggaccggacgttaaagtcggnggttaacgccgtacgacctacttatcgttacccgttacg

SEQ ID NO: 91089 - DNA, 720 bp, Homo sapiens
  misc_feature: GYAE6OF01DN2E7.5.57.F02.1.454.CMB.1.raw
  modified_base (683)..(683): a, c, t, g, unknown or other
  misc_feature (683)..(683): n is a, c, g, or t
tcagatcagacacgcacgaccggtgctcgatttagctcgatatagttgggtttgggggaggaactgctcagttaggaccagacggaaccatggaagcccagcgcagcttctcttcctcctgctactctggctccagactaccggttggggagagtcgtgatggacgcagtctccagccatcctgtctgtcgtcgtcgaggggagagacgccacctctccgtgcgacgggcagtacagaacgtagttggagactaacgttacgaccgtaacggtaaccaaaacgtaaaaaccgtcggaccacgcctacccagtacctacctattacgtttactcgtacactaccacggacggcctacgtgactacgtacccaactagtactacgaggtacggacgtagggtacgggtcgacgggtactaacggtacttacgtacgtaccgtacaacctacgtacgaacgtaccgagtaaccggttacacggttactaggaaacgtttcggttacgtacctttaaggttttaacttacggtactaacgtaaacgttcgtttagggtacgtacgtaacggttaccgggacccgttaacgggtaaccgttccccggggaactaaccgggggaacctcggtaacggttacgggaacttacgggaccggtagggtacgttaaccggttggacggtaccncgtaacccgtactacgttccgttcggtccttaaccgg

SEQ ID NO: 91090 - DNA, 737 bp, Homo sapiens
  misc_feature: GYAE6OF01D1OHA.5.57.F02.1.454.CMB.1.raw
  modified_base (155)..(155): a, c, t, g, unknown or other
  misc_feature (155)..(155): n is a, c, g, or t
  modified_base (204)..(204): a, c, t, g, unknown or other
  misc_feature (204)..(204): n is a, c, g, or t
  modified_base (253)..(253): a, c, t, g, unknown or other
  misc_feature (253)..(253): n is a, c, g, or t
tcagatcagacacgcacgaccggtgctcgatttagctcgatataggttgggtttgggggaggaactgctcagttaggacccagacggaaccatggaagccccagcgcagcttctcttcctcctgctactctggctcccagataccggttgggganatcgtgatgacgcagtctcagccatcctgtctgtcgtctccgagggganagacgcccacctctccgtgcgacgggccagtcaagaactagttcggaanactaacgttacgaccgtacggtaaccaaaacaaaaccgtcggacccaacgcctacccgacgtacctcctacttatttacgtcgttacacctaccgaccgtacggacctacgtacgtactaccgtaaccccaacgtacgtattacgaacggtcgtacgaagggtacgggtacgtaggggaacctaacgtaccgttacgtacgtaccgtacctaaccgtactaccggaacgaccgtaacgggtaccgttaacgtacgttaacgttaacggtaaacggttaacggttacggtaaccgtttaacgttttaaacgtttaaccgtaagttaaaccgtaaaccgttaagttcgggtacggttacgtaacggtccgggttaacccggtacggtaaccggttcccgggaacccgaaggggtaccaggtacgtagtactagcggacggacgtacgtggtacgtaccgagtacccacgtattccgttgtccgttc

SEQ ID NO: 91091 - DNA, 616 bp, Homo sapiens
  misc_feature: GYAE6OF01A6ZHO.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgccaccctctcctgcagggccagtcagaacattggtagcaacttagcctaggtaaccaaacaaaaacctggaccagcctcccagacctcctcatttactcgttcactccaccgacgggccactgactcgtaccccaaccagtacttcaggtggcgaaggagggtcgtgggaactagtacttcgagttctacgaccatcacgcaggtaccgtacagttctaagaacgtacgttggaccttaggtttacttacgtatacaataagttgtaggttcaggtcgggccgttaacggtaccggttccggacccggtaacggggacccaacgggtagtaggtacgttacgacggtaaggtaccggtaacgttcgggtacggcgtacggaccaccgttattcgttcggttccttaccg

SEQ ID NO: 91092 - DNA, 897 bp, Homo sapiens
  misc_feature: GYAE6OF01E4BTF.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgcccaccctcncctgcgagggccagtccaagaactagtttgggagacctaacgtttacgccgtacggtaaacccaaactaaaaaccgtcggacccacgccctacccagacctcctactattttactccgttaccactacccacgacgggtaccacgtagacttccgtaccccaaaccgtagtacttacgacggttacggaccgtaaggggtacggggttaccgtacggggaaccgaacggttaaccttaccgtaacggttcccttacccgaaaccctacgttaccgaacggtaccgaaccgggtacccgtaaaccgtacgggttacccgtaagggtaaaaccggttacggttttaccgggtaaccgttttaagggttttttaacctttaacccggtttaacgttaacccgtaaaaccgttaacggtttacgggttaccgggttaaccttaacggggtttaacccgggtcccccggtttaaaccgggttaaccccggggtttaccccgggtaaccccgggtaaacggggaaccccgtaaaccggtagggttaacggtaaccgttaacgttacccgggtaacgggtaacccggttaaccgggttcggggttacccgggttacgttacccgggtaaaccccgtacccgttaacgttttcccggttttaaacggtttcccttttaaacccccgg

SEQ ID NO: 91093 - DNA, 780 bp, Homo sapiens
  misc_feature: GYAE6OF01EW3RI.5.57.F02.1.454.CMB.1.raw
  modified_base (154)..(154): a, c, t, g, unknown or other
  misc_feature (154)..(154): n is a, c, g, or t
  modified_base (205)..(205): a, c, t, g, unknown or other
  misc_feature (205)..(205): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtcttgtcgtcgtcgagggganagacgcccaccctctccgtgccgacgggccagtaccgaagtaactagttggacgacctaacgttaccgcctacggtaaacccaaaccaaaaccgtcggaccacgtccctacccagtaccctccttacgtactttactccgttacctaccgaccccgtaaccggacggtaccctaacgtgtaaccgttaccctaaaccccgtaacctaacgttaccttaccggtacgggtacggacggtaacgggtacggggttccggtaacgggtacctaacgggttaccctttacgaccgtttaccctacctaacgtactaccgaacgtaccgtaacggtcccgttaagacggttacgtacggtaaacgtcggtttcgtaacttttaagttttacttaacgtctaacgaaactttggtacgttcggtacgtacggttccgacccggttaaccggtaccggttacccgggacccggtaaccggtaactacggtacgggtacgtaaacgtacggtacggaacgggttaccgacggttcggggactcgaccgttaaccacggttacttcgggttactccgttaccgg

SEQ ID NO: 91094 - DNA, 578 bp, Homo sapiens
  misc_feature: GYAE6OF01CLAXD.5.57.F02.1.454.CMB.1.raw
  modified_base (200)..(200): a, c, t, g, unknown or other
  misc_feature (200)..(200): n is a, c, g, or t
  modified_base (401)..(401): a, c, t, g, unknown or other
  misc_feature (401)..(401): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggngagagcccaccctctcctgcagggccagtcagaacattggagcaacttgcctggtaccaacaaaaacctggaccagcctcccagactcctcatttatcgttcactccaccgagggccactgactcgtacccaaccgagtattccaggtggaccaggagggtctgggacagtacttcagtctcaccatcagacagcgtaacngtctagaagtacgttggctagtttattactgtacaacgtagtggtacgtcgagtcggcctacggtaccgtttccggacccgaagggtacccaacggacggtagggacttacgtacgacggtacggaacttgggtaccggcttacggcccgaacctagttcgttacgtcctttacccg

SEQ ID NO: 91095 - DNA, 734 bp, Homo sapiens
  misc_feature: GYAE6OF01BK4T5.5.57.F02.1.454.CMB.1.raw
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (460)..(460): a, c, t, g, unknown or other
  misc_feature (460)..(460): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagagcccaccctntcctgcgagggcccagtcaagaactagtttggtaagccaacgtttacgcctagggtaacccaaacaaaaacccgtggacccaggccctacccgagtacctcccttactaattttactcgtttacactcccaaccgagggcccacgtgatccggtacccaaccagtacttacgaggtcgcaggagggtcctaggggaccaggtacttcgacgtcctacaccattaccgagacgacggtaccgtanacggttctaggaaacgttcgttacgggacttaagtttttaacgtactacgttaactaaaccgtaagttcggtaacgggttacgtaacgggttaccggaccccgtttaacgggtaacccggtttccggaacccccgggacgggaaccctaaacggcggggttaacggtacttaacgttccgggaaacggggttacccgtaaacgggtttcgggtacgggtacccttacgggaacccgtaacccttaggtttaccgttcggtttccctttacccgg

SEQ ID NO: 91096 - DNA, 667 bp, Homo sapiens
  misc_feature: GYAE6OF01CQXV2.5.57.F02.1.454.CMB.1.raw
  modified_base (250)..(250): a, c, t, g, unknown or other
  misc_feature (250)..(250): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagactaccgttggggagatcgtgatgacgcagtctccagccatcctgtctgtgtctccgaggggcagacgcccaccctctcctggcaggggcccagtcagaactagttggganctaacttagcctacggtaaccaaacaaaaacctggacccagcctacccagacctcctctatttacgtcgttacactccaccgacggcctactgatcgtacccaacagtatcagtcggcaggtagggtctgggaccaggactttcgagttctaccaccgtatacgacgtacctaaggacccgttaacgacgttaccgtaggaacgtaccgtttgggaaccttaggtttactttaacgtagtacaaacgttaagttcggtacgggtactagggttcggtaccgttaccgggtaaccggtttccgggacccgtaacgggacctaccggtaggtaccgggtatacgtacggaacgggaccgtaaacgtcgggtacggaccgttacggacctaccgttagttaccccgtgttacccgttacc

SEQ ID NO: 91097 - DNA, 762 bp, Homo sapiens
  misc_feature: GYAE6OF01AJ1V0.5.57.F02.1.454.CMB.1.raw
  modified_base (155)..(155): a, c, t, g, unknown or other
  misc_feature (155)..(155): n is a, c, g, or t
  modified_base (213)..(213): a, c, t, g, unknown or other
  misc_feature (213)..(213): n is a, c, g, or t
  modified_base (622)..(622): a, c, t, g, unknown or other
  misc_feature (622)..(622): n is a, c, g, or t
  modified_base (694)..(694): a, c, t, g, unknown or other
  misc_feature (694)..(694): n is a, c, g, or t
  modified_base (729)..(729): a, c, t, g, unknown or other
  misc_feature (729)..(729): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagactaccggttggggantcgtgatgacgctagtcctccagccattcctgtctgttcgtcctccggaagggggtanacgaccgtcccctaccccttcgtcccgtaggcccggtacgggaccctaggttccaaagttaaacctggtttcgggaacacctaaacgtttccgacccgttaacggtaaacccaaaaccgtaaaaccgtcggacccaccgtacccgacccgaacgtacccttaccctacttaacgttttactacccgttactaaccctcccgaaccggaccgggtacctaccggtacgtaccgtacccttaaccccgaaactacgtacttaccgaggtcggtacgtaagggtccgggttacgacgggtaaccgtaacgtaccgttacgtaacggtcctaccgaacttacgacacggccgtacgtaccgtacgtcgttacgtagaaccgttacgcgttaccttactttacgtctaacgtanaacgtacgttggtacgtacgtgtaccggtccgtaacgtaccggttccgaccggaccggttaccagttacggngtaacgtacgtcgacgggttaccgagttcggccgntacccggtcttacctacgttctcgtttcctacg

SEQ ID NO: 91098 - DNA, 587 bp, Homo sapiens
  misc_feature: GYAE6OF01A162R.5.57.F02.1.454.CMB.1.raw
  modified_base (154)..(154): a, c, t, g, unknown or other
  misc_feature (154)..(154): n is a, c, g, or t
  modified_base (244)..(244): a, c, t, g, unknown or other
  misc_feature (244)..(244): n is a, c, g, or t
  modified_base (382)..(382): a, c, t, g, unknown or other
  misc_feature (382)..(382): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccgttgggganatcgtgatgacgcagtctccagccatcctgtctgtgtctccaggggagagacgcccaccctctcctgcagggccagtcagaacattggancaattgcctggtaccaaacaaaacctggccagcctcccagacctcctcatttactcgttcactccaccagggccactgactcgtaccccaaccagtattcagtcggcaggacgggtctgggacagctacagtctcacntcagcagcgtacagtctgaagtacttggctagtttactactgactaactaattgtacgtcgagttcggacccgttacggtaaccggtttccgggacccgtacggggaacccacggtacggtagggtaactaagtccgaacgggtaccgtaacgttggtacgggtccttacggacctaacccgtagtttccctcgtttccgttacc

SEQ ID NO: 91099 - DNA, 647 bp, Homo sapiens
  misc_feature: GYAE6OF01B3HFP.5.57.F02.1.454.CMB.1.raw
  modified_base (249)..(249): a, c, t, g, unknown or other
  misc_feature (249)..(249): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgcccaccctctcctgccagggccaggtcaagaacagttggtanactaacttcgacctaggtaacccaaaactaaaaacccgtggaccacgtccctacccagtaccctcctctatttacgtccgttacacttacccaaccgcgggacctacggtagacgtccgtaacccccaacgacgtacgttaccgaggttcggacgaggtaccgggtcgtagggaactaacgtacttcgagttcctacgactacgtcgagctacggtactacgtgtacgtaagtacgtacgttaggacctttaagtttactacgtcgtaactaacgtagtacggtagtcgtagtcggtacctacggtaccgttccggaccggtaacgaccaagtggtacgatacgtaccgacgggtataacgtcggtacggctccgactacacttcttcggtccttacg

SEQ ID NO: 91100 - DNA, 937 bp, Homo sapiens
  misc_feature: GYAE6OF01CJ4JS.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtcctcgagggganagacgcccaccctctcctaggcgacggccagtccaaggaactagttgggtaacgctaaaaccgttgtacccgttacggtaacccaaaaccgtaaaaacccgtcggacccgaacgtacccgtacccgaacggtacccttcccctacgttaacttttaacgtccgttacctaaccttaccccgaacccgacggggtaccctaacgttacggaccgttaccggtacccccaaaccgtagtaaccgttacgtaacggttcggaaccgtaagggttacgggggtaccggttaacggggaaccgtaaacggttaccgttaccgtacgtttacccgttaacccgaaaccgttaccgtaccgaacgggtaccctaaacgggtacccgtttaaccgaacggtttacccggttaagggtaaaccggttaccggtttaaccgggtaaccgttttaaggtttttaaacccgtttaaccggttacggttaaaacccgttaaaccggttaacgtttcgggtaaccgggtttaccgtaaacgggtttccgggtaaccccgtttacccgggttaaacccggttcccggggtaacccgttaacgggggtaaccccaacggttaacgggttacgtaaacgtttaacgaacccgggtaacggggtacccgtttaaccggtacgggttaccgggtacccgttacgaccccggtaacttaccgggtttccttacgggttccttttaaaccccggg

SEQ ID NO: 91101 - DNA, 784 bp, Homo sapiens
  misc_feature: GYAE6OF01AFMPN.5.57.F02.1.454.CMB.1.raw
  modified_base (151)..(151): a, c, t, g, unknown or other
  misc_feature (151)..(151): n is a, c, g, or t
  modified_base (214)..(214): a, c, t, g, unknown or other
  misc_feature (214)..(214): n is a, c, g, or t
  modified_base (712)..(712): a, c, t, g, unknown or other
  misc_feature (712)..(712): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctccagataccggttggganatcgtgatgacgcagtctccagccatcctgtctgtgtctcgaggggagagacgcccaccctcnccgtgccgacgggccaggtcaagaactagtttggacgacctaacgttacgcccttacggtaaccctaaaaccgaaaaaacccgttcggacccaaccggccctaccccgacgtacccttccttactaagttttactccggtttaccacttaccccgaccgtacgggaccctaacgttcggtaactcccgttaccccgaaaaccctagtacgttaccgtaggtacggtaccgaacgggtaacggggttccgtacgggggaactaaccgggtaacctttaccgacggttacctacccgaaccgtactaccgaacgtaccgtaacggtaccggtttaaccgacgtttaccgtaacgtaaacgggttaccgttttagggaacccgttttaaggttttaaccttaacgtacggtaactaacggtaagttcggtacgttacgtacggttacggtcccgtaccggtaaccggttcccggtacccgaacgggtacccgacgtacggnggtactacgtcggacggacggttagtcgggcgtacgttcgaacccgtactagtaccttgttccgtttacccg

SEQ ID NO: 91102 - DNA, 860 bp, Homo sapiens
  misc_feature: GYAE6OF01DP9J4.5.57.F02.1.454.CMB.1.raw
  modified_base (151)..(151): a, c, t, g, unknown or other
  misc_feature (151)..(151): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagataccgttggganatcgtgatgacgcagtctccagccatcctgtctgtcgtctccgaggggagagacgccaccctctccgtgacagggccagtcaagaactagtttggaacgactaaaccgtttagcccttacggtaaccaaaaccaaaaaaaccgttggaccgacgccctacccaacgtacctccctacgttactttaacgtccgttacgaacctacccgaacccgacgggtaccctaacgtaggtactccgtaaccccaaaaccgtagtaacttacgaacggttcggacccgaagggggtaacgggttcgtaagggggtaaccgtaacgttaacgtttaccgtaacggttacctacccgtaaaccctaacgttaccgtaacggaccgtaacgggtacccgtttaacgaaccgggtttactaaacgggtaaaacggttacccgtttaggggtacctttaaagggttttttaaagtttaacccgttaacggttaacctaaaacgttaaacggttagggttacgggttacgtaaacgggttccggacccgttaacgggtaaaccggtttcccgggaaccccgtaaacggggaccctaacggtaacgggttacggtaactaaacggttccgtaaacggggtaacccggtaaacggttcgggttacgtaacccgtttacggaaccaacccggttaacctttaccgttaggttcccttttaacccg

SEQ ID NO: 91103 - DNA, 704 bp, Homo sapiens
  misc_feature: GYAE6OF01CM8BE.5.57.F02.1.454.CMB.1.raw
  modified_base (153)..(153): a, c, t, g, unknown or other
  misc_feature (153)..(153): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtcgtctccgaggggagagacgcccaccctctcctgcgagggccagtcagaacattggagcaacttagcctaggtaaccaaacaaaaaccgtggacccacgccctcccaagtacctccctactattttactcgtttacactccaccgacgggccactgacttcgtaccccaaccagtacttacgagtcggacgaggtacggggtcgtaggggaacaaggtacctttacgacgttacctacccaaccgtaactacgaacgtcgaacggtccggtaaacctacggttacgtacggaaacgttaccgtttacgggactttaacggttttaacttaccggttacgtaacctaaagtacgtttaggttcggtacgttaaggtcggtaacccgttccgtaaccgggtttccggaacccgacgggtaccaacggtaggtaggtaacttacgtacggtaacgggaccgtaacggttgggtaacggccgttacggcccgtaacctatttccgtcgtttccgttaacc

SEQ ID NO: 91104 - DNA, 547 bp, Homo sapiens
  misc_feature: GYAE6OF01AXILH.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgcagggccagtcagaacnttggancaacttgcctaggtaaccaaacaaaaacctggaccacgcctaccagactcctacactttatcgttcactcccaccgagggccactgactcgtacccaactagactcgagtggcaggaggtcgtggacagtacttcgagtctacacatcagctagcgtanacgtnagaagtacgtggactagtttactacgtgtacaactagtgttagtacgagttcggccgtacgtacggtccgacccgaggaccacgagtcgagtagtcgacggtacaagtgtaggctaccggcacctatctgttccgttacg

SEQ ID NO: 91105 - DNA, 743 bp, Homo sapiens
  misc_feature: GYAE6OF01ARCGJ.5.57.F02.1.454.CMB.1.raw
  modified_base (218)..(218): a, c, t, g, unknown or other
  misc_feature (218)..(218): n is a, c, g, or t
  modified_base (459)..(459): a, c, t, g, unknown or other
  misc_feature (459)..(459): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtcgtctcgaggggagagcgccaccctctcngcagggccagtcaagactagttggacgctaaacgttacgccgttaacggtaaacccaaaaccgaaaaaccgtcggacccacggccctacccaacgtaccttccctagttactttacgttaccgttacacctacccaacccggcgggacccacgttcgacttaccgaacccaactagtacttcgacggtcggacggaaggtacgggtcgtacggaactgtaccttcgagtccaccgacctanccgaacgcgtaggacctagactcgtaagacggtcgttcggtaacttacgtttaactcgtacgtaactaacgtagggttcgttacggtacggtacggttacggttacccggtaacgttaccccgggttaccgggaacgaccgggtaaaccgtacgtacgggtaccttaaagtaccgttaaccggggaccggttaacggtaacccggtttgggaacgggttccccggtaaagtaccccgttaaccgttaaccgtttcccgggtttacgttttcccccgttaaaccg

SEQ ID NO: 91106 - DNA, 790 bp, Homo sapiens
  misc_feature: GYAE6OF01CEH7Z.5.57.F02.1.454.CMB.1.raw
  modified_base (157)..(157): a, c, t, g, unknown or other
  misc_feature (157)..(157): n is a, c, g, or t
  modified_base (590)..(590): a, c, t, g, unknown or other
  misc_feature (590)..(590): n is a, c, g, or t
  modified_base (711)..(711): a, c, t, g, unknown or other
  misc_feature (711)..(711): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctggctcccagacttaccggttgggganatcgtgatgacgcagtcctccacgccattcctgttctggtcgtccgtccggaaggggagacgacgcccacccttcgtccgtggaccgacgggacctaggtaccaaagtaaccgttaggtttacgggaacgtaccttaaaacgttcgtacccgttaacggtaaacccaaaaccgtaaaaaccgtcggaccaccgtaccctacccgaacgtacccttccgtacttaactttaccgttccgttacctaccgtaccccgaaaccgtaccgggacccttaccgtacgtaaccttcccggtaacccctaaaccgtaacgttaccgtttacggacggttacggaccggtaaggggtacggggttcgtaacggggaactaacggtaccgtttacgtacgttcctaacctaccgtactaccgaacgcgtacgacgttaacgngttaaccgaagtaacgttcgttacggttactttaagtttaacgtcttacgtaactaaggtagtcgttacgtgtaacggtccgacgttacgggtacccgtcgggaacccgtaggaccgtagnggttaacgacgtaggaccgtacgggtacgtacggttggccggtacgtacaccgtacgtaccttcgtcgttcctaacccg

SEQ ID NO: 91107 - DNA, 566 bp, Homo sapiens
  misc_feature: GYAE6OF01BVRCX.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (310)..(310): a, c, t, g, unknown or other
  misc_feature (310)..(310): n is a, c, g, or t
  modified_base (549)..(549): a, c, t, g, unknown or other
  misc_feature (549)..(549): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagacgcccaccctctcctgcagggccagtcagacattggancaacttagcctaggaaccaaacaaaacctggccagcctccagactcctcatttatcgtcactccacgnggccactgactcgtacccaacagtacttcagtgacgaggacgggtcgtagggacaggtacttcgacgtctcaccatacagcacgctacgagtctagaactcgttgacttagtttacttactagtacaactagtcggtcgtcgagttcgacctacgtaacggttccggacccgacggacctacgtacggtacggtactacgtcgacggtacgtacgttggcgtaccgtcgcccgtaactntcgttcttcgttaaccg

SEQ ID NO: 91108 - DNA, 665 bp, Homo sapiens
  misc_feature: GYAE6OF01AX730.5.57.F02.1.454.CMB.1.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (650)..(650): a, c, t, g, unknown or other
  misc_feature (650)..(650): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccaccctctcctgcgagggccagtcagaacnttggancaacttgcctaggtaaccaacaaaacctggaccacgccctccagacctcctactatttactccgttcactcccaccgacggccacgtgactcgtaccccaacgagtacttacaggtcggacacggtaggggtccgtagggaactacgtacgttcgtacggttcctactaacccgatccgacgccgacgtaccgtacacggttaccgtaggtaaacgtacgttacgtacgttaagttttacttacgttacgtaactaaacgtaagttggttacggttacgtacgggttaccggacccgttacgggtaacccggtttccgggaccccggaacggggtacccaacggtaggtacggaactaacggtacgacgggtaccgtaacggtgtcggtactcgtactacgtacncttccgtgttacccg

SEQ ID NO: 91109 - DNA, 742 bp, Homo sapiens
  misc_feature: GYAE6OF01A857B.5.57.F02.1.454.CMB.1.raw
  modified_base (154)..(154): a, c, t, g, unknown or other
  misc_feature (154)..(154): n is a, c, g, or t
  modified_base (205)..(205): a, c, t, g, unknown or other
  misc_feature (205)..(205): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtcctcagcctatcctgtctgtcgtctacgagggganagacgcccaccctctcctgcgaggccagtcagactagttggactcaacttgccgtaggtaaccaaacgaaaaccgtggaccacgcctaccacgtcctcctactaatttctccgttaccactcccgaaccgtacggccctacgtaggtacctcgtaaccccaaacgtagtaccttacgacggttacggacgtacgggtacgggtccgtaaggggaacttacggtacctttacgacgggttacccttaccgaaaccgtagtaacccgacggaccgtaaccggtaccgttaacggtacgttacgttaaccggtaaacggttacgtttacggtaaccgtttaagttttaacgtaaccgtagtaaacctaacgttagttgggtaccgttggtaacggtaccggtaccgttaccggtaaccggttaccggaccgtaacgggacctacggtcggaagtaacttcgggtaaccggtagggtaacctacggtagtaccgggtactacggacccttaggtacctttcgtaaccgtttccgttaaccg

SEQ ID NO: 91110 - DNA, 678 bp, Homo sapiens
  misc_feature: GYAE6OF01CE8V1.5.57.F02.1.454.CMB.1.raw
  modified_base (153)..(153): a, c, t, g, unknown or other
  misc_feature (153)..(153): n is a, c, g, or t
  modified_base (429)..(429): a, c, t, g, unknown or other
  misc_feature (429)..(429): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagacgcccacctctccgtgcgacgggccagtcagaactagttggagctaacgttacgcctacggtaaccaaaacaaaaaccgtcggaccacgccctaccacgacctcctactatttactccgttacactcccaccgacgggcctacgtgacgtccgtacccaacgtagtacttcgaggtcggacgaggagggtcgtacgggacacgtactacgacgtcctacacctntacgacgcgagtacgtacagtccgtaagaagtcgttggacttagtttacttacgtacgtaactaacgtagttacggtacgtacgtacggttaccgggtaccgttaaccgggttaacccggttcccgggaacccgacggggtaacccgtaaggtacggtaggaacttacgtaccgggaacggtacgtaacggttggtacggtaccgttacgacccgtaaccgttagttcccgttacgttcccgttacccg

SEQ ID NO: 91111 - DNA, 724 bp, Homo sapiens
  misc_feature: GYAE6OF01AXHK2.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgaggggagagacgcccaccctctcctgcgacgggccagtacagaactagtttggagactaacgttacgccgtaacggtaacccaaaaccgtaaaaacccgtggacccacgtccctacccgaacgtaccctcctactacttttacttccgttacctacctccccgaaccgacgggtccctaaccgtgtactccgtaccccaaccgtagtacttcgacggtcggacgacggacgggtacgacggtacgacgtactcgtacgtctacctacacgtcgacgacgtaacgtaccgtaacgtacgttacgttaagaaccggttacgttacggtacgtttaacgtttaacgttaccgtttaacgtaactaacgttacgttagggtacgttacgtacgggttaccggtaccgttaccgggtaaccgggttcccggtacccgacgggaacccgtaggtacggtacggttactacgtacggaacggtacgtacggtggtacggtacgtacgaccgtaactagttcttcgttccgttacc

SEQ ID NO: 91112 - DNA, 800 bp, Homo sapiens
  misc_feature: GYAE6OF01EHBJ5.5.57.F02.1.454.CMB.1.raw
  modified_base (203)..(203): a, c, t, g, unknown or other
  misc_feature (203)..(203): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagattaccggtggggagatcgtgatgacgcagtctcagccatcctgtctgtgtctccgagggganacgacgccctaccctctcccgtggacgaacgggccaaggtcaagtaactagttgggtaacgactaaacgttacggccttaacggtaaacccaaaaaccgtaaaaaccgtcggacctaaccggccctacccaacgtacctccttactaactttactccgttacaactcccgaaccgacgggcctaagtgacttcctaacccaaaccgtagtacttaccgaggtacggactaagggtcgggttaccggaggtaccgaaacggttaccgttacggtaaccgtcctacctaaaccgtacgttacgaaacggtcctaacggggtaacgttaaccgtacgttaacccggttaaaggtaaacccggtacgttttcgggtaacctttaaagggtttttaccttaaacggttcggtaaacctaaaccgtagggtttacgtacgggtacgtaacggttcccgggtaccgtaacccgggttaaaccggttcccgggtaacccggtaacggggtacctaacgtaaacggtgtaaacgtaacggtacgaacggtacggtaaacgtggtacggtcgtacgtaccgtactaaagttccgttgtacccgttac

SEQ ID NO: 91113 - DNA, 584 bp, Homo sapiens
  misc_feature: GYAE6OF01E4E7I.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagccaccctctcctgcagggccagtcagaacattggagcaacttagcctggtaccaacaaaaacctggccagcctcccagactcctcatttatcgttcatccaccagggccactcgatcgtcccaacagattcagtggcagaggtctgggacagacttcagtctcaccatcagcagcgtacagtctagaagacttggctagtttattacgtgtacaactaattggtacgtctaggtacggcccttacggtaacggtttccggacccgtaacggggacccaacggtacgtacggtaacgtaagttccggaacgggtaccgaaacggttcggtacgggaccgttggaccctaacccgtattccgtttcgtccgttttacccg

SEQ ID NO: 91114 - DNA, 643 bp, Homo sapiens
  misc_feature: GYAE6OF01DAK19.5.57.F02.1.454.CMB.1.raw
  modified_base (203)..(203): a, c, t, g, unknown or other
  misc_feature (203)..(203): n is a, c, g, or t
  modified_base (628)..(628): a, c, t, g, unknown or other
  misc_feature (628)..(628): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtcctccgagggganagacgcccaccctctcctgcagggccaggtcaaggaactagttggaagctaacgttgcccttaggtaacccaaacgaaaaaccgtcggaccacgtaccctcccgagacctcctactatttactccgttacactccaccgacggccactgatcgtacccaacagattcagtcggacaggacgggtcgtagggactaggtactttcgacgttctaccaaccgtatcgacgacaacggtccgtaacgacgtactaaggaacgtacgtttaggactttagttttaactaacgttacgtaactaacgtaagtttggtcggttactaggttcggtaccccttagggtaacccgttccggaccccgtaagggaccctaacgtaggtcggaatcggcgaacggtacgtaagttggacggtctacggaccactntccgtgttcttaccg

SEQ ID NO: 91115 - DNA, 529 bp, Homo sapiens
  misc_feature: GYAE6OF01EE8JU.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
  modified_base (358)..(358): a, c, t, g, unknown or other
  misc_feature (358)..(358): n is a, c, g, or t
  modified_base (419)..(419): a, c, t, g, unknown or other
  misc_feature (419)..(419): n is a, c, g, or t
  modified_base (437)..(437): a, c, t, g, unknown or other
  misc_feature (437)..(437): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcccaccctctcctgcagggccagtcagaacnttggtancaacttgcctggtaaccaacaaaaacctggaccagcctccagacctcctctatttatccgttcatcccaccagggccactgatcgtacccaacagacttcagtggcaggaggtcngggacagcttcagtctcaccatcagcagcgtacagtctagagacttgactagtttactacngtacaacaagttgagtcngtcgcctagtaacgttccgacccgaggaccacgacggtgagtactcgtacggacgtaactggcggtacctcgcctacagtctcgtcttaccg

SEQ ID NO: 91116 - DNA, 710 bp, Homo sapiens
  misc_feature: GYAE6OF01DULZ6.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgcccaccctctcctgcgacgggccagtcaagaactagttggaagactaacgttacgaccgtacggtaaaccaaaaccgtaaaaacccgtcggacccaacgtaccctacccgaacgtaaccttcccttacttacttttacgttccgttacactacccgaccgacgggaccctacgttcgaacttccgtaaccccaaaccgtagtacttcgaggtacggacgaggtacgggtcgtagggactaacgtacgttcacgttcctacgaacctacgtacgagaccgtaacgtaccgtaacgtacgtacgtaggtaacgtacgtttggacttagttttacttacgtagtactaaacgtagttcggtcgtacgacggttccggtacccgtacggtacccggttccggacccgaacggtacccgacgtacggttagaacgttacgacggtaacgggaccgttacggtggtacgggtccacggtacccaacgttagttcctcgtttccgttacc

SEQ ID NO: 91117 - DNA, 719 bp, Homo sapiens
  misc_feature: GYAE6OF01DX948.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (252)..(252): a, c, t, g, unknown or other
  misc_feature (252)..(252): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctccgtgacacgggccaggtcagaactattgggtanctaacgttgcctaggtaaccaaaccaaaaaccgtcggaccacgcctacccacgtacctcctctatttactccgttacactccacgacgggcctaactcgactcgtacccaaaccagtacttacgagtcgacgaggtacggggtacgtgggacacgtacttacgacgtctacgaacctactacgagacctaggaccgtaactaggttcgtaaggtaacgtacgtttgggactttaaggtttaaccttacggttacgtaacctaacgttaaacggttggttacgggtacgtacggggttacggtacccgttaacgggtacccggtttaccgggaccccgtaacggggtaacccaacggttaaggtacgggtaaacttacggaccgggtaaacgggtaccgttaacggttgggtcccgggtacgtacgggtaccctaaccgttagttcgttaccgtttcccgttaacccg

SEQ ID NO: 91118 - DNA, 811 bp, Homo sapiens
  misc_feature: GYAE6OF01DU6X8.5.57.F02.1.454.CMB.1.raw
  modified_base (157)..(157): a, c, t, g, unknown or other
  misc_feature (157)..(157): n is a, c, g, or t
  modified_base (207)..(207): a, c, t, g, unknown or other
  misc_feature (207)..(207): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagactaccggttggggganatcgtgatgacgcagtctccagccatcctgtctgtgtcctcggagggganagacgcccaccctctccgtgcgacgggccagtacgaagaactgttacggtacgactaacgttacggcctaacggtaaacccaaaacgaaaaccgtcggaccacgccctacccagaccttcctacttactttactccgttacaccgtacccaacgcggtacctacgttacgacttacccgtaacccaaccgtagtacgttacgaaggtacggacgtaaggggtacggggtaccgtacggggtaaacctacggttaccttacgtaccgttaccctaaccgaaccgtactaccgaacgccgtaacgtaccggtaacgtacgtacgtaaggtaaccggttagttacgggtactttaacgttttaacgttaccgtaaggtaaacctaaacggttcggtttagggtaccgttacggtacgggtttaccggttaccccggtaaccggggtaaccggttaccccgggaccgtaaccggggtaccccgtaaggtcgggttacgggtaaccttaccggtaccgggtaacggtacccggtaacggtttcgggtaaccggacgttaacccggtccttaaaccccgttgtttaccctttcggttctttaacccccgg

SEQ ID NO: 91119 - DNA, 657 bp, Homo sapiens
  misc_feature: GYAE6OF01DTTKI.5.57.F02.1.454.CMB.1.raw
  modified_base (203)..(203): a, c, t, g, unknown or other
  misc_feature (203)..(203): n is a, c, g, or t
  modified_base (391)..(391): a, c, t, g, unknown or other
  misc_feature (391)..(391): n is a, c, g, or t
  modified_base (410)..(410): a, c, t, g, unknown or other
  misc_feature (410)..(410): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagngacgcccaccctctcctgcagggccagtcagaacattggagctaacttgcctggtaaccaaacaaaaccgtggaccacgccctacccagactcctactactttatccgttacacttacccaccgacgggaccctagtgactcgtaccccaactagtacttacgaggtcggacgtagggacggggttcnggggaacacggtcttacgngtcctacaacctataccgagaccgacggacgttaacgagtcgtaggaaacgtacttagggtacttaaggtttttaacttaccgtacgtaactaaacgtagtttcggtagggtacgtaaggttccgggtacctaccgggtaacggtttcccgggaccctacgggggaccaagtagtacggtagtacgtcgaaccgggtacgaacgttggcggtacgtcggacctaacctgtttcctggttccttaccg

SEQ ID NO: 91120 - DNA, 808 bp, Homo sapiens
  misc_feature: GYAE6OF01DUOSM.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtcctcgagggganagacgcccaccctctccgtgcgacgggccagtcaagaactgttaggtacactaacgttacgacctacggtaaaccaaacaaaaccgtcggaccacgccctaccacgactcctactatttactcgttcactccaccgacggacctacgtgacgtacgtacccaaccagtactacgaggtcggacgagggtagggtaccgtagggaactacgtaccgttacgacgtttcctaacctacctacgtacgacgacgtaacgaccggttaacgtacggttaccgtaaggtaaacggttaccgggtttaggtaaccttttaaacggtttttaactttaaccggttacgttaaacccgtaaaacgtttaacggtttacggggtttacgggttaacgggttaacggggttacccgggtacccggttttaaccggggggtaaacccgtttccccgggggaacccggtaaccgggtaacccggaacggtacgggttaaggtaaaccgttaacgacgggtaaaccgggtaccggttaacgggttcgggtaaccgggtccttaacccgggtacccttaaacccgtcggttttaaccttcgggtttaccgttaaccccg

SEQ ID NO: 91121 - DNA, 742 bp, Homo sapiens
  misc_feature: GYAE6OF01DAVA4.5.57.F02.1.454.CMB.1.raw
  modified_base (155)..(155): a, c, t, g, unknown or other
  misc_feature (155)..(155): n is a, c, g, or t
  modified_base (202)..(202): a, c, t, g, unknown or other
  misc_feature (202)..(202): n is a, c, g, or t
  modified_base (724)..(724): a, c, t, g, unknown or other
  misc_feature (724)..(724): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctggctcccagataccggttgggganatgtgatgacgcagtctccagccatcctgtctgtgtctcgagggganacgacgccctaccctctccgtggcgacgggccctagtacgaagaaccgtagttgggtacacctaaacgttacgacccgttacggtaaacccaaaaacgaaaaaccgtccgggacccaacgtacccctacccacgtaaccttcccttaccttaattttaacgttcctacctaaccgtaccccgaacccgagggccctaacgcgtacttacccgaaccccaaccaggtacttcgaacggttcggacgaaggggtacgggtaccggtacgggtaactacggtacgttaaccgcgtttacccaaccacccgtaactacgacgacgtacgtaccgtaagtacgttacgtacgtaacggtactttagggacctttaagggttttactaacggtactaacctaacgtaagtggttacggtcgaagggttccgtacccgttaccggaccgggttcccggaacccgtagggaacgtacgtacgtggtaactgacggtacggacgttagtggaccggtactcggacctaccngtttacgtagttcctacg

SEQ ID NO: 91122 - DNA, 658 bp, Homo sapiens
  misc_feature: GYAE6OF01EIEC4.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (248)..(248): a, c, t, g, unknown or other
  misc_feature (248)..(248): n is a, c, g, or t
  modified_base (310)..(310): a, c, t, g, unknown or other
  misc_feature (310)..(310): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgcccaccctctcctgccagggccagtcaagaacattggtancaacttagcctggtaaccaacaaaaacctggccagcctcccagactcctctatttatcgttnatcccacgaggccactgatcgtacccaaccagacttcgagtggacagggtacgggtactggggacaaggtacttcgacgtcctcctaaccaataccgagcctaggccgtaactagttaccttaggaaagtaccgtttagggaccttaaggttttaacttacgtgttaacaaactaacgttgggttgtacgtaaggtcgggtacccttacgggtaaccggtttccggacccgaaggggaccccaaggtacggttagggacttaaggtccggaacgggtaccgtaaacggttgggtaccgggacttaccgggacctaacccgtaatttcccgttggttccctttaaccgg

SEQ ID NO: 91123 - DNA, 588 bp, Homo sapiens
  misc_feature: GYAE6OF01C7LON.5.57.F02.1.454.CMB.1.raw
  modified_base (251)..(251): a, c, t, g, unknown or other
  misc_feature (251)..(251): n is a, c, g, or t
  modified_base (575)..(575): a, c, t, g, unknown or other
  misc_feature (575)..(575): n is a, c, g, or t
  modified_base (581)..(581): a, c, t, g, unknown or other
  misc_feature (581)..(581): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgaaggggagagacgcccaccctctcctgccaagggccaagtcagaacagttggaancaactagcctggtaaccaaacaaaaacctggaccagccgtccaagacctcctctatttaagtcgttacactccaccgagggcccatcgaatcgtaccccaaccgagacttcaagtggacaggaacgggtctacggggacaagaccttacagttctacaaccgtatccagcaacgcgtaacagtctagaagtacttggactagtttaattacctagtcaaactatcgtgggtactagtcggaccttacggaacgttccgacccgtaagggacctaacgagtaggatacgtcaacgggtacaacgttggacgtctacaccgtaacncttacngttctac

SEQ ID NO: 91124 - DNA, 709 bp, Homo sapiens
  misc_feature: GYAE6OF01D6G69.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtcgtctccgagggganacgacgcccacccttctcctgccgagggccagtcaagaactagttggtacgacctaacgttacgaccgttacggtaaacccaaaaccgtaaaaaaccgtcggacccaacgccctacccaacgtacctccctacttattttactccgttacactcccaacgacgggacctactgactccgtacccaacgagtacttcgacggtggaccgaggtacggggtactacgggactaacgtacttcgacgtcctacgaactacgtacacgtaccaaggtccgtaacgtacgtaccgtaggaacgtacggttgtaccgttaagttttacttacgtagtaacctaacgtagttcgttacggctaacgggttcggtaacccgttaacgggtaccgtttacccgggacccgtaacgggaccgtaaccgtaggtaacggtacttacgtacggtaacgggtacgtaccggtggaccggtcgtacgacccgtaacgtattcgttcgttccgttacccg

SEQ ID NO: 91125 - DNA, 636 bp, Homo sapiens
  misc_feature: GYAE6OF01CXB1N.5.57.F02.1.454.CMB.1.raw
  modified_base (201)..(201): a, c, t, g, unknown or other
  misc_feature (201)..(201): n is a, c, g, or t
  modified_base (222)..(222): a, c, t, g, unknown or other
  misc_feature (222)..(222): n is a, c, g, or t
  modified_base (354)..(354): a, c, t, g, unknown or other
  misc_feature (354)..(354): n is a, c, g, or t
  modified_base (621)..(621): a, c, t, g, unknown or other
  misc_feature (621)..(621): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagatcgtgatgacgcagtctccagccatcctgtctgtgtcgtccggggganagcgccacccgtctcctgcgngggccagtcagaactgttggacgacacttagcctaggtaacccaaacaaaaaccgtggaccacgccctacccagacctctctatttactccgttcactcccaccgacggcctacgtgactcgtaccccaacngtactcgaggtcggcaggtacgggtcgtacgggacagtacttcgtacgtcctacaacctatcgacgcacggtaccgtactagttcgtaacggaacgttcgttacggtacgttagttttacgttacgtagtaccaaagtattcggtggtacgaggtccgtaccgtaccggtaaccggttccggacccggtaaggaccctagtacggtacgtagtacttccggaagggtcctaacggttgggcgtcgtacgacctacctagttccgttntccgtttcgtacccg

SEQ ID NO: 91126 - DNA, 752 bp, Homo sapiens
  misc_feature: GYAE6OF01CMC45.5.57.F02.1.454.CMB.1.raw
  modified_base (154)..(154): a, c, t, g, unknown or other
  misc_feature (154)..(154): n is a, c, g, or t
  modified_base (255)..(255): a, c, t, g, unknown or other
  misc_feature (255)..(255): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagcctatcctgtctgtcgtctaccgaggggtagagacgcccaccctctccgtgcgacggccagtcaagaactgttcggacnctaacttgccgtacggtaaaccaaaaccgaaaaccgtcgaccacgtccctaccacgtaccttcctactatttactccgttacactccgaccgacggtcctacgtgtactccgtaacccaaacgtagtacttcgtaggtcggacgtaaggtacgggtacgtagggaactacgtacttacgacgtcctacaaccgtataccgacgtaccgtaacggtaccgttaaccgtacggttaccgtaaacgggtaacgttaccgttacgggttaactttaacggttttaactttaacggtaacgttaaactaaaggtttaacgtttcgggttaacgggttacctaacgggttccggtaccccggttaaccgggttaacccgggtcccggaacccgggtaacgggacctaacggtacggttagacgttaccgtaacggacgggtaacggtacggtcggtcgtaaccgtcgacccgtacgttatcccgtttacgttccttaaacccg

SEQ ID NO: 91127 - DNA, 861 bp, Homo sapiens
  misc_feature: GYAE6OF01EXPON.5.57.F02.1.454.CMB.1.raw
  modified_base (253)..(253): a, c, t, g, unknown or other
  misc_feature (253)..(253): n is a, c, g, or t
  modified_base (828)..(828): a, c, t, g, unknown or other
  misc_feature (828)..(828): n is a, c, g, or t
tcagatcagacacgcacgaccggtgctcgatttagctcgatatagttgggtttgggggaggaactgctcagttaggacccagacggaaccagtggaacgccccagcgcagcttctcttcctcctgctactctggcctacccagacgtaccggttggggatatcgtgatggacgcgacgtcctaccacgcctacttcccgtgttcctgttcgtccgtacggaaggggacacggaccgtccctacccttcgtccncggaccgacgggcctagtaccaaagtaacttgttacggtactaaccgtaacgttaccgtaccggtaaccggtaaaacccaaaaacccgtaaaaccggtcccggacccgtaaccgtaccctaccccgtaaacgttaacccccttccttaactttaacgttttaccgttaccgtttaccctaaacccgtaccccggaacccggtaaccgggtaccctaaaccggttcggtaaccccgtttaaccccggaaccccgtaaaacgttacggttaccgttaccggaggttacccggggtatacggggggtacgggttaccggacggacggtaaccttagtccgtacgtcctaacgtaaccagtacgacggtaacgtaccggtaccgacgttaacgtccggtaaagtaaccggttacgacgtttaacccgtttatttaccgtacgttaacgtaaacgtattaaccggttggaaccggtacgtacgttaccggacccgtttacgggtaaccgtccgaaacggggtaccctaacggagtggtaacgacgtacggaggacccgtaggaccggttcggaacgtccnccgttaacccgattcccggtacttccgtaactc

SEQ ID NO: 91128 - DNA, 654 bp, Homo sapiens
  misc_feature: GYAE6OF01BQ8ZK.5.57.F02.1.454.CMB.1.raw
  modified_base (203)..(203): a, c, t, g, unknown or other
  misc_feature (203)..(203): n is a, c, g, or t
  modified_base (221)..(221): a, c, t, g, unknown or other
  misc_feature (221)..(221): n is a, c, g, or t
  modified_base (246)..(246): a, c, t, g, unknown or other
  misc_feature (246)..(246): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgcccaccctctccngcaggccaagtcagaactattgganctaacttgacctggtaaccaaacaaaaacctggaccagcctccagactcctcatttatcgttcatcccacaggaccatgatcgtacccaaccagtattcagtggcacggaggtcgtgggacagtactcgagtctcaacctatcagcacgtcgtaactagacctaggaagtacgttagggacttacggttttattaacgtcggttaaccaaacgtaagtttacggtggttaaccctaggtaccgggttacccgttaccgggtaaaccggtttcccgggacccggtaacgggaccccgtaaacgtacggttaacgggacgtaacgttaccggaagggtaacccgtaaaccggtggttacgggacgttaccggtaccaaccctaagttcccgttgttcccggtttaaaccc

SEQ ID NO: 91129 - DNA, 689 bp, Homo sapiens
  misc_feature: GYAE6OF01DGKN2.5.57.F02.1.454.CMB.1.raw
  modified_base (200)..(200): a, c, t, g, unknown or other
  misc_feature (200)..(200): n is a, c, g, or t
  modified_base (240)..(240): a, c, t, g, unknown or other
  misc_feature (240)..(240): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagatcgtgatgacgcagtctcagccatcctgtctgtgtctccgagggganagacgcccacctctcctgcagggccagtcagacagttgancaacttgcctgtaaccaacaaaaactcggaccagcctaccacgacctcctctatttactcgttacactccacgacggccatcgactcgtacccaacagtacttcagtcgacagtacggtcgtacgggactacgtacttacgacgttctaccgtaactacgtacctacgacgtaacgccggttaacaggtaccgtaggtaaacgtacgtttaggacctttaaggtttttaacttaccgttcgtaactaaacttacgttgtacggttacgaacggttcggtaaccctttaccgggtaaccggtttccgggaaccccggtaaggggtacccctaacggtacggtaggtaaacttcggtaccggtaagggtacccgtaacggtttacgggtaccgggtccgttaacggacccttaaacccggtatttcccgttaggtttcccctttaacccgg

SEQ ID NO: 91130 - DNA, 682 bp, Homo sapiens
  misc_feature: GYAE6OF01EV2CH.5.57.F02.1.454.CMB.1.raw
  modified_base (154)..(154): a, c, t, g, unknown or other
  misc_feature (154)..(154): n is a, c, g, or t
  modified_base (205)..(205): a, c, t, g, unknown or other
  misc_feature (205)..(205): n is a, c, g, or t
  modified_base (461)..(461): a, c, t, g, unknown or other
  misc_feature (461)..(461): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctccagataccggttgggganatcgtgatgacgcagtctccagccatcctgtctgtcgtcgtccgagggganagacgcctaccctctcctgcgagggccaggtacaacgaactgttacggtagactaacgttacgccgtacggtaaccaaacaaaaaccgtcggaccacgccctaccacgtacctcctactatttactcgttcactcccgacgcgggacctacgtgacttccgtacccaaacctagtacttcgacgtcggactagggacgggttcgtaggacgtagtaccgttcgacgtcctaccacatccgagctaacgtcgtaacncgttactaaggtaacgtcggttacggactttaagtttaccttacgttacgtactaaagtcgtttaggtacgtacgtacggttcggtacccgtacgggttacggttcccggacggtaaccggaaccgtacggtacggttacggtactaacgtacggaacgggtacttacggtggaccgtacgtaccgtacctacggttaattcccgttgtacccgtttaccg

SEQ ID NO: 91131 - DNA, 800 bp, Homo sapiens
  misc_feature: GYAE6OF01AN275.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (216)..(216): a, c, t, g, unknown or other
  misc_feature (216)..(216): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccacctctccngcagggccagtcagactagttggtacgcaacttgcctacggtaccaaacaaaaacctggaccacgcctacccaagaccttcctctatttactcgttcactcccaccgacgggtccacgtgatcgtacccaaccctagacttcagtacgcgaacgtagggtcctacggggactacggacctttacgacgtaccttaccgaacctacgttaccgaaggccgtaacggtaccgttaaccgtaaggtttacctaacgggaaaacggttacctttacggggtaaccttaaacgggtttttaacgtttaaccgttaacgttaacccggtaaaacgttacgttaacgggtttccggttaacgtacggggtttacccgggtacccgttacccggggttaaaccgggttacccgggtacccccggtaaaccgggggtaaccccggtaacggtaaaccgggtttaccggtaaacgttaacgttacccgggaaacgggttacccggaaaccggtttccggggttacgggaacccgtttaggaaccccggttaaacccgttagtttaacccgttacggttcccgtttaaaccccgg

SEQ ID NO: 91132 - DNA, 802 bp, Homo sapiens
  misc_feature: GYAE6OF01CMFR9.5.57.F02.1.454.CMB.1.raw
  modified_base (154)..(154): a, c, t, g, unknown or other
  misc_feature (154)..(154): n is a, c, g, or t
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgaggggngagacgcccacctctcctggcagggccagtcagactattgganctaacttgcccttaggtaaccaaactaaaaacctggaccagacctcccaagacctcctctaattttactcgttacacttacccgaccgacgggccctactgaacttccgtaaccccaaccgtagactttacgacggtcgacgtaggtaaggggtccgtaggggaactacggtacctttacgaacgttcctaccaacctagttccgaacggtccgaacgtccgttaactacggttacccgtaggtaaactaccggtttaggaccgtttaacgttttaacttaacgttacgttaacctaaacgtttaacgtttaggttacgggtaccgtaaggttaccgggtaccccgtttaaccgggtaaccgggttttaccccggggacccccggtaacgggggtaacccttaaaccgggacgggtttacgggtaaacttaaccgggttaccggaaaccggggttaccggtaaaacgggtttcgggttaacccggggtacccgtttacgggaccccgttaaacccggttacgtttaccccgtttcgggtttaccctttaaaccccgg

SEQ ID NO: 91133 - DNA, 639 bp, Homo sapiens
  misc_feature: GYAE6OF01EJC5T.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcagggccagtcagaacattggancaacttagcctggtaaccaaacaaaaacctggaccagcctcccagacctcctactatttactcgttcatccctaccgagggcccactagactcgtacccaaacctagattccagtggcaggagggtcgtgggacagcttcagtctcgacatcagtcacgcgtacagtctaggaacgtcgttgggactaagttttacgtactgtaccaaactagtcggtaggtaccgtaggtacggtcccgtacggtaaacccggttttccgggaccccgaacgggggtaaccctaacggtaggttacggaaattaacggtaccgaacgggtaccggaaacggttcggtacggggtaccttcggacccgtaacccgttagtttcgttaacgttcccgtttaacccg

SEQ ID NO: 91134 - DNA, 790 bp, Homo sapiens
  misc_feature: GYAE6OF01DOLKU.5.57.F02.1.454.CMB.1.raw
  modified_base (159)..(159): a, c, t, g, unknown or other
  misc_feature (159)..(159): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactcgtcggctcccagactaccggttggggganatcgtgatgacgcagtctccagcctattcctgtctgtcgtccgtccggaggggagagaccgcccctacccttctccgtgaccgacggggccaggtacaacgaactaggttgggaactaccttaacgttacggtaccgttaacggtaaacccaaaaccgtaaaaacccgtcgggaaccctacggaccctacccgacgtaacccttccctaacgttacttttaacgttccgttaaccaccttaccccaaccggtccgggtaccctaacgtcgtaaccttaccgtaacccctaaccgagtactttacggaacggtcggaacggtacggggtaggggtaccgacggggtaactacggtaacttacgaaccgtttccctaaccacgtactaccggacgtccgaacggtactaacgagttaccgtaacggaattcgtacggtattacggtttataccggataccgaaagtcgttaggtcgtacggacgttaccgggtcccgtacggttaccggtccccggaggaaccggtacccaacggtgggtaaacgtactacgtaccgggagggttaaccaggttcgggccggtaaccttcggtaaaccctccgttaaacggttcgtttcccctagtttccccg

SEQ ID NO: 91135 - DNA, 722 bp, Homo sapiens
  misc_feature: GYAE6OF01C2M9S.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (675)..(675): a, c, t, g, unknown or other
  misc_feature (675)..(675): n is a, c, g, or t
tcagatcagacacgcacgaccggtgctcgatttagctcgatataggttgggtttgggggaggaactgctcagttaggacccagacggaacatggaagccccagcgcagcttctcttcctcctgctactctggctcccagataccggttgggganatcgtgatgacgcagtctccagccatcctgtctgtgtcgtcgagggganacgacgccaccgtctcctgacgagggcctagtacagaactgttgggaatactaacgttacgccgtaacggtaaaccaaaccgaaaaaccgttcggacccacggtaccctacccgaagtaccctactacttactttactccgttacactaccacgacggacctacgtcgacgtccgtaacccaacgtacgtaacgtcgtaacggtcggaccgaacgggttacgggtaccggtacggggaacctaaacggtaccgttacgtaacggtcctaaccgtaactacgtacgtacgacgttacgacgttaacgtacgtcgtagaaacttcggttacgtacgtaattttcgtacgttagaacttaacgtagttacggtagtaccgtacggtaccgttccgtaaccggttaccgtaccgggtaacccggaacgtacggtaaccgtaggtacgtaagtaccgtacgtacgggtactaaccgngggtaccgtacgaccgtaccgacccttaggtccttcgtaccgttccc

SEQ ID NO: 91136 - DNA, 695 bp, Homo sapiens
  misc_feature: GYAE6OF01ELM77.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgcccaccctctcctgccgagggccagtcaagaacngttggtanacaacttgccgttaggaacccaaacaaaaaccgtcggaccacgcctacccagacctcctctatttatcgttcatcccacacgggccactgactcgtacccaacagtacttcgaggtcggaccgaggtaagggtcgtacggggactaacggtaccttcgacgttctaccaacctaactccgaacggtaccacggtaccggttaaccaggttaccttaagggaaacgtacccggtttaagggacctttaaggtttttaaccttacgttacgtaaccaaacgttaagttcgggttaggttaccgtaagggtccggtacccgttacgggttaaacccgggtttcccggaccccgtaaggggaacccctaaggtacggtagtacgtacgacgtacgggtacgtaaacgtggtacggcctaggcctaacctagttccgtgttcgttacccg

SEQ ID NO: 91137 - DNA, 842 bp, Homo sapiens
  misc_feature: GYAE6OF01EQTWZ.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (247)..(247): a, c, t, g, unknown or other
  misc_feature (247)..(247): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgcccaccctctcctgcagggccagtcagaacagttggtanctaacttacgcctacggtaaccaaacaaaaacctcggaccacgccctacccacgaccttcctactatttactccgttaccactacccaccgacgggaccctacgtagacgtaccgtaccccaaaccgtagtacttccgaaggtcggaccgaagggtacggggtcgtaggggaacctaacggtaccgttacgtaacggttcccttaccgaaccctaacgttaccgaacggaccggtaacggtaccccggttaacgtaacggttaccgttaacggtaaaacggttaccgtttacgggtaaccgttttaacgtttttaacgtttaaccgttaacgttaaccgtaaacgttaaacggtttcgggttaaccgggttacgtaacggggttacccgggttaacccccggttaccgggttaaacccgggtttaccccgggaacccccggtaaacggggtaaccccggaacgtaacggggttacgggtaaacgttaaccggttaccgggtaacgggtaacccgggttaacgttcggggtaccgggtaccgttaccggtaaccctaacccggttaacgtttcgttaccggttcccgtttaacccg

SEQ ID NO: 91138 - DNA, 624 bp, Homo sapiens
  misc_feature: GYAE6OF01B81BJ.5.57.F02.1.454.CMB.1.raw
  modified_base (153)..(153): a, c, t, g, unknown or other
  misc_feature (153)..(153): n is a, c, g, or t
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccaggggnagagcccaccctctcctgcagggccagtcagaacnttggancaacttgcctggtaaccaaacaaaacctggaccagcctacccagactcctacatttactcgttcactccaccgagggcccactgactcgtacccaacagtattcagtggacaggagggtctagggacagtacttcgacgtctcacctatacagcacggtctactagttactaggaaacgtacgttggacttagttttattactagtaccaagtagtggttacggctaggtccggtaccgttacggtaaccggtttccggaaccccgagggtaacccctaggtacggttacggaacgttacgtacccggtacgggtaccgtaacggttcgggtacgggccttacgggacccaaccttaagttcccgttcggtttcccgttaccg

SEQ ID NO: 91139 - DNA, 872 bp, Homo sapiens
  misc_feature: GYAE6OF01DRCAN.5.57.F02.1.454.CMB.1.raw
  modified_base (155)..(155): a, c, t, g, unknown or other
  misc_feature (155)..(155): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagactaccggttgggganatcgtgatgacgcagtctcagccatcctgtctgtcgtctccgaggggtagacgacgccctaccttcgtccgtgccgacgggcctagtaccaagtaactggttggtacgtacctaaacgttcgaccgtacggtaaacccaaaaccgtaaaaccgtcggaccctacgcccctacctacgtacccttccttacttaacttttaccgtccgttacctacttaccccgaacccggtacgggtaccctacgttaccgtaacgttacccgtaaccccgaacgtacgttaacgttacggacgggttacggacggtaacggggtacggggtaccggtaacggggtaccgtaacgggtaacctttacgacggtttaccgtaccgtaacccgttacgtaccgtaacgggtcctaacgggtaccgttaaccgtacggttacgttaacgggtaaaccgttacggttacgggtaacgttttacggttttaaccgttaaccggtacgtttaaacgaaacgtttacgggttaccggttacgggttactaaggggttcccgggttacccgtttaaccgggttaacccggttaccgggaacccggttaacccggggtactaaccgggtaaggtttacgaaccgttaaccggtacggaccggggttaaccgttaacgttcgggtaaccggtccgtcggtaacccttacggtacctttcggtacgttttcgtacccc

SEQ ID NO: 91140 - DNA, 770 bp, Homo sapiens
  misc_feature: GYAE6OF01CQGBT.5.57.F02.1.454.CMB.1.raw
  modified_base (155)..(155): a, c, t, g, unknown or other
  misc_feature (155)..(155): n is a, c, g, or t
  modified_base (256)..(256): a, c, t, g, unknown or other
  misc_feature (256)..(256): n is a, c, g, or t
  modified_base (357)..(357): a, c, t, g, unknown or other
  misc_feature (357)..(357): n is a, c, g, or t
tcagatcagacacgcacgaccggtgctcgatttagctcgatatagttgggtttgggggagaactgctcagttaggacccagacggaaccatggaagcccagcgcagcttctcttcctcctgctactcgtggcctcccagactaccggttgggganatcgtgatgacgcagtcctccagcctatcctgtctgtcgtctcgaggggatagacgcccaccgtctccgtgcgaacgggccagtcaagaactagttcgganacctaacgttacgccgtaacggtaaaccaaaaccgaaaaaaccgtcggacccaacgtaccctaccgaacgtaccctaccttatacttttacgtaccttacncctacccgaccgacggtccctaagttcgacgttaccctaaccccgaactaacgtataccgaaggtcgacggtaaggtcgggtcgtaggggaactaacggtacttcgaacgtcctaaccaacgaactcgaacggcgtaacggaccttaacgaggttaacgtacggtaaaacgtacgtttaaccgggacttttaagttttacgtaaccgttaacggaaaccttaaacggttaagtttcgggaaccggtcgttaacggggttcccgaacccggttaaccgggttaccggtaccccgggtacccgtaagggaacccgtacggttaaggtaggttacctaacggtaccgtaacggggtaacttaggtcggccgggtaactcggttaccaccttaggtttccctaagttccccgttaac

SEQ ID NO: 91141 - DNA, 886 bp, Homo sapiens
  misc_feature: GYAE6OF01CUYYL.5.57.F02.1.454.CMB.1.raw
  modified_base (205)..(205): a, c, t, g, unknown or other
  misc_feature (205)..(205): n is a, c, g, or t
  modified_base (253)..(253): a, c, t, g, unknown or other
  misc_feature (253)..(253): n is a, c, g, or t
tcagatcagacacgcacgaccggtgctcgatttagctcgatatagttgggtttgggggaggaactgctcagttaggacccagacggaaccatggaagccccagcgcagcttctccttcctcctgctactctggcctcccagataccggttgggagatcgtgatgacgcagtctccagccatcctgtctgtcgtctccgagggganagcgcccacctctccgtgcgagggcctagtcaagaactagttgggacncaaacttgaccttacggtaaaccaaaaccgaaaaaccgtcggaccacgccctacccacgtacctccctactattttaacgtccgtttaccacgtacccgaaccgacgggtacccacgttacgtagttacccgtaccccaaacgactacttcgtacggtcggaccgaacggggtacgggtacgttaggggaacctaacggttaccgtttacgacgttacccttaccgaacctacgtacgacgtaccgtaacggtcccgttaacgtaacgggttacgtaacggtaaacgggttacgtttacgggaaccgtttttaagttttaacgtttaaccgttaacgttaaccgtaaaacgttacggtttacgggtttaccgggtaacggttaacgggtttcccgggtaccccggttttaaaccggggttaacccggggtttcccccgggtaaccccgggtaaccggggtaccccgtaaaagggtttaggggttaccgggtaaaaccgtttacggttaaaccccgggaaacggggttaaaccccgggttaagggtttcgggtaccccgggttcgttaaaccgggtaaaccccgttacccgttaaaggttttcccccgttcgtttttaaccccgttttaccccg

SEQ ID NO: 91142 - DNA, 695 bp, Homo sapiens
  misc_feature: GYAE6OF01CXAQG.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcgacgggccagtcagaactgttggagctaaacttgacctaggtaaaccaaacgaaaaaccgtggaccacgccctaccagtacctctactatttactcgttacactccacgacggccactcgactcgtacccaactagtacttcaggtggacgaggtacgggtcgtgggaactacggtacttcgacgtctcaacactctagcagccgtaacgcgtacgtagaacgtacgtaggtacttagttttatactagtactaaatagttcggtacgtcgtagttaccggtacccgttacgggttaacccggtccgggaaccccgtaacggggtacctacggtaaacgggttacggaacgtttaacggtacccggaaaggggtttaaccccggaaaggtttccgggtaacggggttccccgttaaacgggtaccctaaacccgttagggtttacccgttccggtttacccggttttaacccc

SEQ ID NO: 91143 - DNA, 794 bp, Homo sapiens
  misc_feature: GYAE6OF01C06JG.5.57.F02.1.454.CMB.1.raw
  modified_base (209)..(209): a, c, t, g, unknown or other
  misc_feature (209)..(209): n is a, c, g, or t
  modified_base (261)..(261): a, c, t, g, unknown or other
  misc_feature (261)..(261): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagagtaccggttggggagatcgtgatgacgcagtctccagccatcctgtctgtcgtccgtccgaagggganagaccgccctaccctctcctgcgacgggccagtaccaagaactagttagganactaacttagcctacggtaaacccaaactaaaaaccgtcggacccaacgaccctacccgaacgtacctcctactaacttttacgtcgttaccacctccgaaccgacggacctagtcgtactccgacccaacgtagtacttcgacgtggacgtaggtagggtcgtagggactacgtacgttacgacgtctacctactacgtccgaacgaccttacggtaccgtaacggtacgttacggttaaacggtaacgttaacggtttaacggttaccgtttaaagtttttaccgtaacgttacgtaaaccttaaagttaacgttcgggttaacgttacgtaacggttccgggtaacccgttaaccgggttaaccggttacccgggaaccccggtaaggggttaacccaacgggttacgggttaaacgacgtttaacccggacggggtaaaccggtaccgggtaacgttcgggtaacccgggttctaaccgggtaccctaaacgtttcggtttacccttcggttttcccctttaaacccgg

SEQ ID NO: 91144 - DNA, 835 bp, Homo sapiens
  misc_feature: GYAE6OF01EKDJZ.5.57.F02.1.454.CMB.1.raw
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtcgtctccgagggganagacgcccaccctctcctgccgaggccagtcaagaactagttggagctaacgttgcctacggtaaccaaacaaaaaccgtggaccacgcctacccagacctcctactatttactcgttacactcccaccgacgggccctacgtcgactccgtaccccaaacctagtaacttccgaaggttcggaccgtaagggtacggggttacgttacggggaaccgaacggttaaccgtttaccgaacggttcccctaacccgaaacccgtaacgttaccgaacgggtacctaacgggtacccggttaaccgtaggttaaccccgttaaggtaaaccggttaaccggtttagggtaaccgtttaaacgttttttaaacgtttaccgttacggtttaaccctaaaacggtaacgttttcgggttaacggttaccggttagggttacccgggtaaccccgtttaccggggtaaaacccggttttccccgggaccccgggtaaacggggacccgttaaaccggagggtttaacggggtaacttaacggtaccggtaaacggggtacgtaaacggttcggggtacggtacccgtacgacccggttaaccctaggttttaccgttccgttccgtttaaccccgg

SEQ ID NO: 91145 - DNA, 826 bp, Homo sapiens
  misc_feature: GYAE6OF01DEKZR.5.57.F02.1.454.CMB.1.raw
  modified_base (805)..(805): a, c, t, g, unknown or other
  misc_feature (805)..(805): n is a, c, g, or t
tcagatcagacacgcacgaccggtgctcgatttagctcgatatagttgggttggggagaactgctcagttaggacccagacggaaccatggaacgccccagcgcagcttctcttcctcctgctactctcggcctccagtactaccggttggggatatcgtagactcggacgcagtcctccagccatcctgtctgtcgtaccgtcggaggggacacggaccgccctaccccttccgtccgtacggaccggtacgggacctaacggtaccgaaagtaaccgttagtttcgggaactaccgtaaacgtttaccgacccggtaaccggtaaacccaaaaaccgtaaaaaccgtcgggaaccctaaccggtcccctacccgtaaacgtaccccttacccttaacgtttaacctttaccgttaccgttaacccaacccgttaacccgaccggaacgggtaccctaaccgtacgtacgtaccccgtaacccgaaacgtacgtacgttacggacggtacggacgtaacgggtacggtcgacgggtacaacgttcctacgactcctacgacctagaccacggcctaacgacgtaccgtacggtacgtaaacgtaagttccgttagggtacctttaagtttacctaaccgtacgtaactaacggttaggtcggtttaacgggtacgttacggaaccggtaccggtttacggaacccggttcccgggaaccgtaacggccgtaagtaaccggttggaacttaaccgcgggtaaacggtccggtaacggttgaaccggtctaaccgtacgtaccgtntccggtttccgttacgtaccg

SEQ ID NO: 91146 - DNA, 657 bp, Homo sapiens
  misc_feature: GYAE6OF01DQ9PA.5.57.F02.1.454.CMB.1.raw
  modified_base (152)..(152): a, c, t, g, unknown or other
  misc_feature (152)..(152): n is a, c, g, or t
  modified_base (202)..(202): a, c, t, g, unknown or other
  misc_feature (202)..(202): n is a, c, g, or t
  modified_base (363)..(363): a, c, t, g, unknown or other
  misc_feature (363)..(363): n is a, c, g, or t
  modified_base (634)..(634): a, c, t, g, unknown or other
  misc_feature (634)..(634): n is a, c, g, or t
tcagatcagacacgcacgaccggtgctcgatttagctcgatatagttgggttgggggaggaactgctcagttaggacccagacggaaccatggaagccccagcgcagcttctcttcctcctgctactctggctcccagataccgttgggganatcgtgatgacgcagtctccagccatcctgtctgtgtcctccgagggganagacgccccacccgttctccctggccgacgggcccaggtcaaggaaacctagttggagccaacttagcctaggtaaccaaacaaaaacctggacccagcctccagactcctctatttactcgttcactccacgacggccactgactcgtacccaacgagtnttcagtgacgaggtagggtcgtaggactaggactttcgacgtcctacaactacgtacgacgacgaacgtccgtactacggttacaggtaacgtacgttggtacttacgttttaatacctacggtactaaacgtagttcggtaggtacgtaggtacggtacctaacgggtaccgttccgggacccgtaacgggacctaacggtacggtacgtacgtacgtaccgaacggggtacttaacggtcggtaccggcgttacggacctaaacccgtntttcccgttcggttccttaaccg

SEQ ID NO: 91147 - DNA, 779 bp, Homo sapiens
  misc_feature: GYAE6OF01B6H0E.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
  modified_base (253)..(253): a, c, t, g, unknown or other
  misc_feature (253)..(253): n is a, c, g, or t
  modified_base (744)..(744): a, c, t, g, unknown or other
  misc_feature (744)..(744): n is a, c, g, or t
tcagatcagacacgcacgaccggtgctcgatttagctcgatatagttgggtttgggggaggaactgctcagttaggacccagacggaaccatggaagccccagcgcagcttctcttcctctgctactctggctcccagactaccggttgggganatcgtgatgacgcagtctccagccatcctgtctgtctcgtcggaggggancgacgcccacctctccaggcgacggcctagtacaagaactgttacgganacctaacgttacgccgtaacggtaaaccaaaaccgaaaacccgtcggaacccaaccggtacccctacccgaacgtaccttacccctatttaacttttaccgtccttaccaacctaccccgaaccgaccggacctaaccgtgtaactaccccgttaacccaaacgtaacgttacgttaccgaagggtaccggaacggtaacgggacggggttacggaacggggaaaccacggttaaccttacgtaccgtcccttaacaaacccgtataccgacggtcctaaggtacttaaccgagttacgtaaggtaaacggttcggtttcggtaaactttagttttaaaccctagaacgtttaaacccgaaagtttaggttacggtagggtacctcgggtacccgtaccgttaacccgtacccgggacggaccccgaaggacccaacggtaggtagtaactaccggtacgaacggtagttaacggtcggtccggttaaccnggtaccctaacgtcgtttcgtcgttaccttaaccg

SEQ ID NO: 91148 - DNA, 894 bp, Homo sapiens
  misc_feature: GYAE6OF01C9HMF.5.57.F02.1.454.CMB.1.raw
  modified_base (156)..(156): a, c, t, g, unknown or other
  misc_feature (156)..(156): n is a, c, g, or t
  modified_base (165)..(165): a, c, t, g, unknown or other
  misc_feature (165)..(165): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctcggctccagactaccggttgggganatcgtgagngacgcagtcctcacgccactcctgtctggtcgtccgtaccggaggggacgacgcgacccctacccttctccgtggccggacgggacctaggacaacgtaagtgttagggacactaacgttacgccgtaacgtaaccaaaactaaaacggtcgactaccgccctaccgactcctcttacttactttacctcgtacactacccgacgcggtaacctacgtcgtaaccttacccggaaccctaaacgacgtttacgtaacggtcggtaacggtaccgtaaggggttaccgggtacggtaacgggtaccgttaactaccggtttaacgaaccgttccctaaccgtaacctaacgtacgggaccaacggtaccgtaccggttaaccgtccgttaaggtaaacggttaacgtttaccggttaggttaacgtttaaagtttttacccgtaacgtttacggaaaacccttagggtttaacgttgggggtttaacggaacccgtttaggggttaaccccgtaccgggttttaacccggaaaccccggggttacccggttacccgggaaccccggtaacgggttaccgggaaacgggttacggaaacccgtttaacgggggaacccccggtaaacggggttacctaaaccggggttcgggttccccggtaaggtttacccccgggaactttaccggttaaacccgtttttcccgggtgtttaaacccccgtttcccggg

SEQ ID NO: 91149 - DNA, 755 bp, Homo sapiens
  misc_feature: GYAE6OF01CHS4E.5.57.F02.1.454.CMB.1.raw
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtcctccgaggggnagacgcccaccctctcctgcacgggccagtcaagaactgttacggagactaacgttacgcctacggtaaccaaacaaaaccgtggaccacgccctaccagtacctcctctatttactccgttcactcccaccgacggccacgtgactcgtacccaacagtacttcgacggtgacgaggacgggttcgtacgggaactacgtacttactacggtcctacccgacctactaccgagcccgtaacggtaccgttaaccgacggttaccgtaaggtaaacgtaccgtttaggggtaacctttaacggttttaacttaaccgttcgttaaacctaacgttaaacgtttacgggttaggtacgttaacggggttccggtaacccggtttaccgggttaacccggtttacccggggaccccggtaaaccgggggtaccctaacgggtaacggttacgggaacgttaaccggtaaccgggtacgggtaaacgggttaacgttcggggtaacggcgttacccggacttacccgtaacgttccgttcgttacccgttacccg

SEQ ID NO: 91150 - DNA, 682 bp, Homo sapiens
  misc_feature: GYAE6OF01C15EE.5.57.F02.1.454.CMB.1.raw
  modified_base (155)..(155): a, c, t, g, unknown or other
  misc_feature (155)..(155): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctggctcccagactaccggttggganatcgtgatgacgcagtctcagccatcctgtctgtgtcctcgagggganacgacgccctaccctctccgtggccgaacgggccaggtaccaaaggaacctaggtttcgggtaaacgaccttaaaccgttacgcccgttaacggtaaaacccaaaaccgtaaaaaaccgtcgggacctaaccgaccctacccaacgtaccttcctactaatttaactccgttacactccaacgacggcctacgtcgacttccgaaccaactagtactcgagttcggacgaggtaggtcgtagggactaggtaccttgacgtccacgaactgtacgacgacgacgtacgtacgtacgtacgtacgaacgtacgttcgacgttatttatactagtacaacgtagttcgtacgtacgtaggtcgtaccgtacggtacgtaccggacccgacggtaccgaacgtaggtacgacttacgacggtaacggtacgtaacggttcggacgggttctacgaacccttacgttgtccttcgttcttacc

SEQ ID NO: 91151 - DNA, 904 bp, Homo sapiens
  misc_feature: GYAE6OF01CHJD9.5.57.F02.1.454.CMB.1.raw
tcagatcagacacgcacgaccggtgctcgatttagctcgatatagttggggttgggggaggaactgctctagttaggacccagacggaaccatggaacgccccagcgcagcttctcttcctcctgctactctggctacccagacgtaccggttggggatatcgtgatggacgcagtctcagccatcctgtctgtgtctccgaggggacgagacgcccaccctctcctgcgagggccagtcagaactagttggtagctaacgttacgaccttacggtaaacccaaaaccgtaaaaaaacccgtggggacccaaacggccccttaaccccgaacggtaacccctttccccgttaccttaaactttttttaaccgttacccggttttacctaaacctttacccccgtaaaccccggaacggggggtaacccctaaccgttacggtaaaccgtttcccgggttaaccccccaaaaccgtaacgggttaactttaccggaacgggttcgggacgtaacggggtaaggggttccggtacggggaacgtaacggtaaccctttcgaaccggttaccttaacccgaacccgtaacggttaccgaacgggtaccgaacgggttaccgttaaccgtaacggttaccgtaagggtaaaacgttccggttacgggtacctttaacgtttttaaactttaccgtaggtaaccctaaacgtaaaggtttcggttaacgggtacgtaacgggttccgggtaacccgttaacggggtaaaccggtttcccgggaacccggtaacgggggaccctaaccggtaacgggtacggtaacttaccggtacggaacggggtaccgtaaacggttggttaaccgggactacgtaccctacgtacgtttcgttcgttcctttacccg

SEQ ID NO: 91152 - DNA, 639 bp, Homo sapiens
  misc_feature: GYAE6OF01ET506.5.57.F02.1.454.CMB.1.raw
  modified_base (155)..(155): a, c, t, g, unknown or other
  misc_feature (155)..(155): n is a, c, g, or t
  modified_base (545)..(545): a, c, t, g, unknown or other
  misc_feature (545)..(545): n is a, c, g, or t
  modified_base (609)..(609): a, c, t, g, unknown or other
  misc_feature (609)..(609): n is a, c, g, or t
  modified_base (615)..(615): a, c, t, g, unknown or other
  misc_feature (615)..(615): n is a, c, g, or t
  modified_base (632)..(632): a, c, t, g, unknown or other
  misc_feature (632)..(632): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctccagagtaccggttgggganatcgtgatgacgcagtctccagccatcctgtctgtgtctcgaggggagacgcgcccacctctcctgccgagggccagtcaagaactagttgggtaacacctaaacgtttcgaccgttacgggtaaacccaaaaacaaaaaacccgtggacccaacggtccctacccagtaccttcctacttatttactccgttacacttcccaacggaacggcccaacgtgaactccgtaacccaaacctagtacttcagggtcgacgagggaaggttcggagggactaacggactttcgacgtacctcaactctcagctaagcccgtatacggtactgaaacgttacttgggtaacttagttttaactacgttacgtactaactaagtcggtagtacgngttacggtcccgtacgtacgttccggacgtaggccaagtagctaatacgcggacgtagtaccgntcgggntacgccactatccgttntccgtac

SEQ ID NO: 91153 - DNA, 777 bp, Homo sapiens
  misc_feature: GYAE6OF01B86HX.5.57.F02.1.454.CMB.1.raw
tcagatcagacacgcacgaccggtgctcgatttagctcgatatagttggggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgcccaccctctcctgcgacgggccagtacaagaacgtagttggtaacgccaaacgttacgaccgtacggtaaccaaaacctaaaaaccgtcgaccacgccctacccagtcctcctactatttactccgttacactccaaccgacggaccactacgatccgtacccaacagtacttcgacggtggacgaagggtacgggtcgtacgggtactacggtaaccgtttcgacgtttccctaccgaaccgtactaccgaacggaccgacggtacccggtaacgtaaccggttcgtaaacggaacgttaccgggtttaacggttaccgtttaacgtttttaccgttaacgtaccgtttaaactaaacgtttagtttacgggtacgggtttacgaacgggtttaccggtaccccgttaccgggttaaacccgggtttccccgggaacccgttaaccgggggaccctaaaggttacgggtacggttaaccgtaacgtcgggtaaacgggaccgggtaacgttggggtaccgtaccgttacggacccaccgttactaccgtttccgttcccgttacccg

SEQ ID NO: 91154 - DNA, 705 bp, Homo sapiens
  misc_feature: GYAE6OF01BAAHO.5.57.F02.1.454.CMB.1.raw
  modified_base (153)..(153): a, c, t, g, unknown or other
  misc_feature (153)..(153): n is a, c, g, or t
  modified_base (189)..(189): a, c, t, g, unknown or other
  misc_feature (189)..(189): n is a, c, g, or t
  modified_base (245)..(245): a, c, t, g, unknown or other
  misc_feature (245)..(245): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtntctccgaggggaagacgcccacctctcctgcgacgggccagtcagaactgttgganctaacttcgcctacggtaaccaaacaaaaccgtggaccacgtcctacccagacctcctactatttactcgttcactaccaccgaggcctacgtacgactcgtaacccaacagtacttcgaggtcgacgtaggtacgggtcgtagggactaacgtacttacgtacgttacctaccaaaccgtacgttaccgaacgtacgtaccggtaacgttaaccgtacggttaaccgtaagggtaaacgttaccgtttacgggaacgttttaaggttttaacttaaccgttagtaaccttaaacgtaagtttcggtacgtacgtacggttcggtacccgttacgggtaacccgggttaccggtacccggtaacgggtaccctacggtaaggtacggtaacgttaacgtccggaaggtaccgtaacgttcggacgtcgtacgtactaccgtaattcgtacgtcttacccg

SEQ ID NO: 91155 - DNA, 694 bp, Homo sapiens
  misc_feature: GYAE6OF01CJNEN.5.57.F02.1.454.CMB.1.raw
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctggctcccagataccgttggggagatcgtgatgacgcagtctccagccatcctgtctgtgtctccagggganagagcccaccctctctgcagggccagtcagaacattgganctaacttagcctaggtaaccaaacaaaaacctggaccagccctacccagaccttcctacattttactcgttacactaccaccgaggaccaactgacttcgtaccccaaacgtagacttaccgaagtggaccgaggtacgggtcgtagggaacagtaccttacagttccaccacctatacagctacgacgtacagtcctagtaacgtacgttacggtctaagttttattaccgttagtaacctaaacttaagttcggttacgttacgtaacgggttcccggtaccttaccgggttaaccggttcccggaccccggtaacgggtaccctaaacggtaccgggtacggtaaccgttaacgttaaccgacggggttaacccgtaaacgttcggggttcgggaccttaacggtaccccgtaacccgtaacgtttcccggttagttcccctttaaccg

SEQ ID NO: 91156 - DNA, 674 bp, Homo sapiens
  misc_feature: GYAE6OF01C2228.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctcgagggganagcgccacctctcgtgccgaggccagtcaagaactgttggagacctaacgttagcctaggtaaccaaacgaaaaaccgtcggaccacgccctacccagtaccctcctacgtactttaactccgttcactccaaccgacggacctagtcgtactccgtaacccaaccgtagtacttcgagttcggacgtagggtacgggtcgtagggacaacggtacttacgacgttcctaccaacctataccgacgtacacgtacgtaactgtacaagtaacgtcgttaggtacttagtttaacttacgtacgtaaccaaagttgtacggtcgtacgtacggtcggtcccttaacgggaaccgttccggacccgtaagggaccctaacggtagttacgggaccttagtaccgggacggtaccgttaaggtccggttacgtacgtacgtaacccgtacaaggttcccttcggttacccttaccg

SEQ ID NO: 91157 - DNA, 757 bp, Homo sapiens
  misc_feature: GYAE6OF01C1NBZ.5.57.F02.1.454.CMB.1.raw
  modified_base (156)..(156): a, c, t, g, unknown or other
  misc_feature (156)..(156): n is a, c, g, or t
  modified_base (207)..(207): a, c, t, g, unknown or other
  misc_feature (207)..(207): n is a, c, g, or t
  modified_base (267)..(267): a, c, t, g, unknown or other
  misc_feature (267)..(267): n is a, c, g, or t
tcagatcagacacgcacgaccggtgctcgatttagctcgatatagttggggtttgggggaggaactgctcagttaggacccagacggaaccatggaacgccccagcgcagcttctcttcctcctgctactctggctcccagataccggttgggganatcgtgatggacgcagtctccagccatcctgtctgtcgtctccgagggganagacgccctaccctctccgtagcgacgggccctagtaccaaagtaacgtagttgggaacnctaaacgttacgtcccgttacgggaaaaccctaaaaccgaaaaaccgtcggacccaacgtccctaccacgtacctcctactatttactccgttacacctccaccggaacggccctaagtcgtaactccgtacccaaacgtagtacttacgagtcggacgtagggtacggtacgtaggggactacgtacgttacgacgttcctacgtacctagtaccgacgacgtaacggtaccgtaacgtaacggtctaaggtaacgtacgttacggtaacgtttaacttttaagtaccggacttaacgtaaacttaggtttggacgttacgtaaccgggttggtaccccgtttaagggttacccgggttcccggaccgtaaacgggtccaaacggttacggtacgggtacttaacgccggtaaacggggaacgtttaacggtcgggtacggtacctcggaaccccgttaacgttacgtttccgtcgttactttacccgg

SEQ ID NO: 91158 - DNA, 767 bp, Homo sapiens
  misc_feature: GYAE6OF01CUG0F.5.57.F02.1.454.CMB.1.raw
  modified_base (155)..(155): a, c, t, g, unknown or other
  misc_feature (155)..(155): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctctctggctcccagactaccggttgggganatcgtgatgacgctagtcctccagcccattcctgtccttggtcgtacctccggaaggggacgagaccgccctaccctctccgtggccgacgggtaccagtccaagtaactagttaggtaacgactaaaacgttcgacccgttaacggaaacccaaaaccgtaaaacccggtgacccaaccggtccctaaccgtacgtacctcctacttacgtttactccttacaccgtacccgaccgacggcctaactaggtactaccgtacccaacgagtactcgaggtcggacgtaagggtcgggtacgtacggaacgtaacggtacttaccgaggttacccacctaacgtaacgtacgaacgcgtaaccggttacgaccgtagttacgaacgtaacttacggtacggtactttaacggttacttacgtacgtaactaacgtaacgttggtacggtaacgtacggttaaccggcctaacgggttaccgtacccgggaacggcccgttaaaggaccgtaggtaaccgggtattaacggggaccgtaagggacccgtttaaaggtccgggcgtacttaacccgggaaccttacgtaagtttcccgtacgtcccggtttaacc

SEQ ID NO: 91159 - DNA, 788 bp, Homo sapiens
  misc_feature: GYAE6OF01DBLKO.5.57.F02.1.454.CMB.1.raw
  modified_base (161)..(161): a, c, t, g, unknown or other
  misc_feature (161)..(161): n is a, c, g, or t
  modified_base (243)..(243): a, c, t, g, unknown or other
  misc_feature (243)..(243): n is a, c, g, or t
  modified_base (499)..(499): a, c, t, g, unknown or other
  misc_feature (499)..(499): n is a, c, g, or t
tcagatcagacacgcacgaccggtgctcgatttagctcgatatagttgggtttgggggagaactgctcagttaggacccagacggaaccatggaacgccccagcgcagcttctcttcctcctgctactctcggcctacccagtacttaccggttggggganattcggtgatcgacgcagtcctccacgcctatcctcggtctgttcgtccgtccggaggggacgacacgccctaccctctccnggcgacgggacctagtaccgaagtaacgttgttacgggaactacgttaacgttacgacccgttaacggaaacccaaaacgtaaacggtccggaccaccgaccctaccgaactcccttaccttatttacgtttactccgttaccacctacccgaaccgtcggtaaccctacgtaccgtacgacccaaccgtaacgtacttacgtaccggtaggtacggacgggtaagggtacgggtagtaccgggtaacacgttacncgtaacctccgtaacaacgcctaggccgtaccgaggtacctaagttaccgtaggtaacggttaaccgttggtaacccggttaagtttttaaaccgtcgtttaaaccgtaacgttaaacgtaacggtttccgggtggtttaccccggagtttacggacccccgggtttagaaacccggggtttccgtaacccgggaccgtaccggaactaacggttaggacgtacgttacggacgtaacggttcgaacgtcgtcgacttacaaggtccctaggttaccctgtccgttacc

SEQ ID NO: 91160 - DNA, 738 bp, Homo sapiens
  misc_feature: GYAE6OF01DAXQK.5.57.F02.1.454.CMB.1.raw
  modified_base (253)..(253): a, c, t, g, unknown or other
  misc_feature (253)..(253): n is a, c, g, or t
  modified_base (677)..(677): a, c, t, g, unknown or other
  misc_feature (677)..(677): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagactaccggttggggagatcgtgatgacgcagtctccagccatcctgtctgtctcctccgaggggagagacgcccaccctctcctggcgacgggccagtcaagaactagttgganctaacgttacgcctacggaacccaaaaccgaaaaccgtcggacctacgaccctcccgaacacctcctactatttacgtccttacaacctaccgaccgacgggcctacgtacgacgtccgaaccccaacaacgttactcgaggtacggacgtagggtacgggtacgtaggactaacggtctacgtacgtacctaccgactacgacgacgaccgtaacggacccttaagaccggttaactaaggtaacggtaccgttaggtacctttaagtttacttaaccgtcgtaaactaacgtacgttgggttaccgtacggtacggttaccggaccgttaaccggggtaccggttcccggaacccggtaacgggtaccgacgttaacgggtacggtaactacgttacccgggaaagggtacggttaaccggngggttcccgggtacgtaccgtacccgaacttcccggtttacgtccgtttaccgtttacccg

SEQ ID NO: 91161 - DNA, 529 bp, Homo sapiens
  misc_feature: GYAE6OF01C3EH1.5.57.F02.1.454.CMB.1.raw
  modified_base (308)..(308): a, c, t, g, unknown or other
  misc_feature (308)..(308): n is a, c, g, or t
  modified_base (357)..(357): a, c, t, g, unknown or other
  misc_feature (357)..(357): n is a, c, g, or t
  modified_base (504)..(504): a, c, t, g, unknown or other
  misc_feature (504)..(504): n is a, c, g, or t
  modified_base (508)..(529): a, c, t, g, unknown or other
  misc_feature (508)..(529): n is a, c, g, or t
tcagatcagacacgcacgaccggtgctcgatttagctcgatatagttgggtttggggggaagaggaagactgacggtccccccaggagtccagagtgcgtcgcaagtattggcagtgtgaaattttgacaccttatatgcagactctgtgaggggccgcttcaccgtgtccagagacaactccaagaacgccgtactatttgcagatggacagcctgagagtcgacgacacgggcatctattattgtacggcggccgagcaatactctcttactttctggagtcgaggagtcccggtcactgtcctcncagcctccacgaacgggccagtccgtcctcccccgtggcccaccctccncacgacgccaccgtcgtcgggcacgacggccgccgtcgggctcggccgtgggtaccaagggtcctaccgtttcccggtcgtctcgtattccgtggacgggccggggtctcggaccggacggggtcccgataacggtagtcgactagntcgnnnnnnnnnnnnnnnnnnnnnn

SEQ ID NO: 91162 - DNA, 703 bp, Homo sapiens
  misc_feature: GYAE6OF01DI032.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagatcgtgatgacgcagtctccagccatcctgtctgtgtctccgagggganagacgcccacctctcctgcgaggccagtcagaacagttggtagctaacgtagcctaggtaacccaaacaaaaacctggacccaacgccctcccaagacctcctactatttactccgttcactaccaccgtacggccctactcgaattccgacccaaaccagtattcaggtcgagacggtagggtccgtagggaactacggtactacgacgttccacctaacccgattaccgagaccgtaacggtaccgtaaccgtaggttaccctaagggtaaacgtacgtttaggacctttaaggttttaacttacgtagtacaaagttacgttggtagtaccgtaggttaccgggtacccttaccggggttaccggttaccccgggaccgtaaccggggaaccctacgggtaaggtaccggtagtacgtaccgaaacggggtaaccgtacggtagggttccggacgttccggaacctaaccgtctttaaccggttcgttaacgttacccg

SEQ ID NO: 91163 - DNA, 823 bp, Homo sapiens
  misc_feature: GYAE6OF01BH4SZ.5.57.F02.1.454.CMB.1.raw
  modified_base (154)..(154): a, c, t, g, unknown or other
  misc_feature (154)..(154): n is a, c, g, or t
  modified_base (206)..(206): a, c, t, g, unknown or other
  misc_feature (206)..(206): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgctagtctcagccatcctgtctgtcgtcctacggagggganacgacgccctaccctctccgtgcgacgggccacgtacaagaactagttggtaacgacctaacgttacgaccgttacggtaaaccaaaccgtaaaaaccgtcggacccaacgtccctacccgacgtacccttcctacttaacgttttacgttaccgttacctaacctacccgaccggtacgggtaccctaacgttcgtaacgtaccgttaaccccaaaccgtaacgttacttaccgaggtacggacgtaagggtacggggtaccggtacgggaactacgtaccgttaccgtaacgtaccgtaccaaccgtataccgtaacggtacacggtaccgtaacgtacgttaccgttaagggtaacggtttaacggttgggtaaccgttttaacgttttaacgttaccgttaacggtaaccgtaaacgttaaggtttacggtacggttaacgttaccgggttaccggtacccggtttaacccgggtaaccgggttacccggtacccggtaacggaacccgtaacggtacggtacggttaaacgtacggttaacggtacggaccggttaacggtggtaaccggcgtaacgttacccgacttaccggttccgttcttcgttacccg

SEQ ID NO: 91164 - DNA, 890 bp, Homo sapiens
  misc_feature: GYAE6OF01BSLQ2.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcagggccagtcagaactagttgganctaacttagcctaggtaaccaaacgaaaacctggaccacgccctacccagaccttccctactattttactccgttacactcccgaaccgtacgggaccctaacgtacgacttaccgtaccccaaaccgtagtactttaccgaaggttcggaccgtaagggtacggggttccgtaggggtaaccgtaacggtaccgtttacgaacggtttcccttaccgaaccccgtaattaccgaacggtaccgtaacgggtacccgtaacgtaacggtttacccgttaaaggtaaaccggttaaccggtttacggggtaaccgtttaacggttttttaacgtttaaacccgttacgggtttaaaccctaaacggttaaacggttttacggggttaccgggttaacggttaacgggtttacccggggttaaccccgtttaacccggggttaaacccggggttttccccggggtaacccccgtaacgggggtaaacccccgtaaccggttaacggggttaacgggtaaccgtttaacgggttaacccgggaaccggggttaaccggttaaacggttccggggttaccgggtacccgttaaccgggtacccgtaacccgttaacgttacccggttttccggttaccctttacccgg

SEQ ID NO: 91165 - DNA, 738 bp, Homo sapiens
  misc_feature: GYAE6OF01AWYNX.5.57.F02.1.454.CMB.1.raw
  modified_base (155)..(155): a, c, t, g, unknown or other
  misc_feature (155)..(155): n is a, c, g, or t
  modified_base (207)..(207): a, c, t, g, unknown or other
  misc_feature (207)..(207): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggcctcccagactaccggttgggganatcgtgatgacgcagtctccagcctatccgtgtctgtcgtctcggagggganagacgcccacccttctcctgacgaccgggcctagtcaacgtaattagttacggacactaacgttcgccgtacggtaaaccaaaacaaaaccgtggacccacgccctaccacgtacctcctactagttttactccgtctaccgtacccgacgcggcctacgtcgaacctccgtaacccaacgtgtaactcgaaggtcgtagagggtacggtcggtacggactacgtacgttcgtacgtacctcctaacgctacgacgacgtacccggtagtaaccgtgttaacggaagttaaaccgttcggtcgtttaacctttagtttaacctttacgtacgtaaccgtaaaccgtttggtttaaccggttcggtaacgttacggtacgggttaccctacccggggtttaaaccggtccccgggttaaccgaccggtaacccgaagtccgggtaacgtctaaaccgtcgggaccgttacggaacgttcggttaaccgccacgttaacgcccctttaaggtccttcggttccctttaacccg

SEQ ID NO: 91166 - DNA, 605 bp, Homo sapiens
  misc_feature: GYAE6OF01AKE15.5.57.F02.1.454.CMB.1.raw
  modified_base (206)..(206): a, c, t, g, unknown or other
  misc_feature (206)..(206): n is a, c, g, or t
  modified_base (384)..(384): a, c, t, g, unknown or other
  misc_feature (384)..(384): n is a, c, g, or t
  modified_base (424)..(424): a, c, t, g, unknown or other
  misc_feature (424)..(424): n is a, c, g, or t
  modified_base (561)..(561): a, c, t, g, unknown or other
  misc_feature (561)..(561): n is a, c, g, or t
  modified_base (591)..(591): a, c, t, g, unknown or other
  misc_feature (591)..(591): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggcctcccagataccggttggggagatcgtgatgacgcagtctccagccatcctgtctgtcgtctccgagggganacgacgccctaccctctccgtgcgacgggccagtcgacgaactagttggatactaacgttcgccgtacggaaaccaaaacaaaccgtggacccacgccctaccagtacctcctatatttctcgtcactacccgacgacggcctagtcgtactccgacccaacgtatactcgagtcggngaagggtcggtaccgtaggactacgtacttcgacgtaccnccactcacgacgctacgtacgtagtatcgaaggtactacgttcgtactttagttaactcgtaatactaagtgttcggtcgtagcgttcgggtaccttacggtaccggttccgaccgaggacctgtacggtgtaacgngtcgaggtacgacgtgtacgcctagctacngtttcctgttctac

SEQ ID NO: 91167 - DNA, 741 bp, Homo sapiens
  misc_feature: GYAE6OF01C7AXT.5.57.F02.1.454.CMB.1.raw
  modified_base (154)..(154): a, c, t, g, unknown or other
  misc_feature (154)..(154): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctcgaaggggnagcgcccaccctctcctgcgacgggccagtcagaaactgttggagacctaacttacgccgtaacggtaaaccaaaaccgaaaaaccgtcggaccacgtaccctaccaacgtacctccctacttaacttttacgtccgttacctaccgtacccaaccggtacgggccctaacgtgtaacctcggtaaccccaaactagtaacttccgaggtcggacgtagggtacgggtcggtagggaactacggtacttacgacgttccacacctacgtacgacgtcgaacggtccgtaacgtaggtaccgaaagttaacggtcctttaagggaccgtttaagtttaacgttaccgttacgtaactaaaccggttagtaggttaccgggttaacgtacgggttacccggtacccggtttacggtaaccgggttcccggaaccggtaaccggtaccgaagtcgggtagtaacgtacggaccggtacgggtactaaccgttgggtaacccggcgtaccgtaccgtactaattccgttaacgtcccttaccg

SEQ ID NO: 91168 - DNA, 828 bp, Homo sapiens
  misc_feature: GYAE6OF01EE9BE.5.57.F02.1.454.CMB.1.raw
  modified_base (151)..(151): a, c, t, g, unknown or other
  misc_feature (151)..(151): n is a, c, g, or t
  modified_base (169)..(169): a, c, t, g, unknown or other
  misc_feature (169)..(169): n is a, c, g, or t
  modified_base (200)..(200): a, c, t, g, unknown or other
  misc_feature (200)..(200): n is a, c, g, or t
  modified_base (217)..(217): a, c, t, g, unknown or other
  misc_feature (217)..(217): n is a, c, g, or t
  modified_base (366)..(366): a, c, t, g, unknown or other
  misc_feature (366)..(366): n is a, c, g, or t
tcagatcagacacgcacgaccggtgctcgatttagctcgatatagttgggtttgggggaggaactgctcagttaggaccagacggaaccatggaagccccagcgcagcttctcttcctcctgctactctgctccagataccggttgggganatcgtgatgacgcagtcncagccatcctgtctgtcgtctcgaagggganagacgcccacctctccngcgagggccagtcaagaactgttggtagacctaagttacgccgtacggtaacccaaaacgaaaaaccgtcggaccacgcctacccatacctcctacttattactcgtacactccacgacggaccagtcgacttaccgtacccaaaccgngtaacgttaccaggttacggacgtaaggggtagggttccgaggggaacctaggtaccttacgtacggtccctaacaaccctattaccggaacgtaccgtaacgggtacccgttaacgtagttacggtttaaacggaaacgtaccgtttagggtaaccctttaagggttttaaactttacccgtagttaaacccgtaaaacggttaacgtttcggggttacggttaaccgtaacgggttaccggggtaccccggttttaaccggggtaaacccggggttttccccgaacccgggtaaaccggggtaccctaaacggtagggttaaaccggtacgttaaaccgtaccggggttaagggtaacccggttaaacggtttggggttaacccggggttacctaacccggggtaacccttaaacccgttaggttttaccgggtttaactttcccggtttaaaacccccg

SEQ ID NO: 91169 - DNA, 774 bp, Homo sapiens
  misc_feature: GYAE6OF01BSZBM.5.57.F02.1.454.CMB.1.raw
  modified_base (152)..(152): a, c, t, g, unknown or other
  misc_feature (152)..(152): n is a, c, g, or t
  modified_base (766)..(766): a, c, t, g, unknown or other
  misc_feature (766)..(766): n is a, c, g, or t
tcagatcagacacgcacgaccggtgctcgatttagctcgatatagttggggtttgggggaggaactgctcagttaggacccagacggaaccatggaacgccccagcgcagcttctcttcctctgctactctggctccagataccggtggganatcgtgatgacgcagtctcagcctatcctgtctgtgtcgccggaggggacagacgccctaccctctccgaggcaacgggtccaaggtacaagaaacgtagtttagggaacacctaaacgttacgaccgttaacggtaaacccaaaaacgaaaaaccgtcggaaccaaccggccctaccaacgtactacctacttatttaacgtccgttacacacccgaacgacggacctactcgaacgtaccgtaacccaaaccgtaagtacgttacggtaacggtacggaacgaacggggtacgggtacggtacgggaactaacggttaaccgttcgtaacgttacctaacccgacgaacgtacgaaccgaggaacgtacgtaacgtacggtacttacgaaacgttacgtacggtaacttaaggtttaacttaccgtagttaaaccaaacttagggttagtacgggttaacgcggttacccgggtacctaaccgggggttaaaccgtccgggaacccgaacgggaaccgaacggtaaggttacgggaacgttaagtaccgggtaagggaccgtaaacgttcgggtgggtacctacggacctaaccgttatcgtttacccgttnttaacccg

SEQ ID NO: 91170 - DNA, 678 bp, Homo sapiens
  misc_feature: GYAE6OF01CO3VG.5.57.F02.1.454.CMB.1.raw
  modified_base (615)..(615): a, c, t, g, unknown or other
  misc_feature (615)..(615): n is a, c, g, or t
  modified_base (663)..(663): a, c, t, g, unknown or other
  misc_feature (663)..(663): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagacgacgccctaaccctctcccgtaggcgacggggcccagtccaagaacctagtttcgggtaagcctaaacgtttacggcccttacggtaaacccaaaaccaaaaacccgtcggaccaacgccctacccagtaacctcctactaattttacgtccgttaccacttaccccaccgacgggtcccaacgtcgacttccgtaccccaacgaacgtacgttcgtaggtcggacacgggtaggggtcctagggactacgtacttcacggtactccacctatacgacgtacgacgtcgtaccgagtccgtagtaacgtacgttaggtacttagttttaactacgtacgtacctaaatacgtggtcggtactaggtcggtaccttacgggtaccgttccggacccgtacgggacctacggnggtagtactcgtacggacgacgtaacgtggttacgcgtcgaccctacnttcgtcgttcctacg

SEQ ID NO: 91171 - DNA, 757 bp, Homo sapiens
  misc_feature: GYAE6OF01CO4Z9.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtcgtcctcgagggganagacgcccacctctcctgcgagggccagtcagaactagttggagctaacgttagcctacggtaaccaaacaaaaaccgtcggaccaacgccctacccagacctcctactattttaactccgttacactacccgaaccgacgggtacctaacgtcgtactccgtaacccaaaccgtaagtaacttcgaggttcggacgtaagggtacgggtcgtacgggaactacgtaccgttacgacgtcctaccaacctacgtaccgacgaccgtaacggtaccgtaactaggtaccgtaaacggtacgtaacgtttcggaccttaaggttttaacttaacgttgtaaacctaaacgttagttcggttacggttacgtaagggtcccggtaccgttaaccggtacccgggttccgggaaccccggtaaggggtaaccctaccggtaaggttacggtaaccttaaacggtccggtaaacgggtaccggtaaaccggttggggttaccgggtaccttacggtaccccgtaaaccgttgtttacccgttcgtttacccgttaccg

SEQ ID NO: 91172 - DNA, 787 bp, Homo sapiens
  misc_feature: GYAE6OF01CISR5.5.57.F02.1.454.CMB.1.raw
  modified_base (154)..(154): a, c, t, g, unknown or other
  misc_feature (154)..(154): n is a, c, g, or t
  modified_base (225)..(225): a, c, t, g, unknown or other
  misc_feature (225)..(225): n is a, c, g, or t
tcagatcagacacgcacgaccggtgctcgatttagctcgatatagttgggtttgggggaggaactgctcagttaggacccagacggaaccatggaacgcccagcgcagcttctcttcctcctgctactctggctccagactaccggttgggganatcgtgatggacgcagtctccagccatcctgtctgtcgtccgtcggaggggagagacgccctaccctctcngcgagggccagtccaagtaactagttgggaacactaacgttacgtaccgtacggtaaaccaaaaccgtaaaaaccgtcgggacccaaccgtaccctacccgaacgtacccttacctacttaacttttaccgttaccgtttacctaacctaccccgtaaccggtaccgggtaccctaacgttacggtacttacccgtaacccctaaacgtaagtaaccgttacgtaacgggtacggacgtaacggggtacgggttaccggtagggaaaccgtacgttaccgttacgtaacgtcctaaccaaccgtacgtacgacgaccgacggtacgttaaccgtacgttacgtacggtaaacgttcggtacgtacgttaacgttttaacgtcgtaacgtaacctaaagtaagtttggacgttacgtaacgggttccgtaccgttaacgggtaccggttccgaccggtaacggaccgtacgtaggtacgtagtaccgtacggtaacggaccggtacggtcggtccggtaacgtcccggaacctacgttaaccgttcgttccgttccttacccg

SEQ ID NO: 91173 - DNA, 678 bp, Homo sapiens
  misc_feature: GYAE6OF01DO59I.5.57.F02.1.454.CMB.1.raw
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
  modified_base (661)..(661): a, c, t, g, unknown or other
  misc_feature (661)..(661): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcacgtctcgagccatcctgtctgtcgtctcgagggganagacgccctaccgtctcgngcgacggcagtcagactagttggacgactaacgtacgccgtacggtaaaccaaaaccgaaaaccgtcggaccacgtccctacccaacgtaccttacctactttaagtttacgttccttactacctacccgaaccggtacgggaccctacgttcgacgttacccgtaacccgaactacgtactcgacggtcgacgaggtacgggtccgtagggactaagtcttacgcgtctaccgactacgtacgacgaccgacgtaccgtaacgtgtacgtagtaacgtacgttcggactttacgttaacttaccgtacgtaactaacgttagtacggttcgtacgtaggtaccgtaccgttacggtaccgttacccggaccgacggtactaagtacggtagtacgtacgcgggaacgtacgtaggtcggtcgtacacggtccaacttntccgttgttacctaccg

SEQ ID NO: 91174 - DNA, 623 bp, Homo sapiens
  misc_feature: GYAE6OF01EVD4C.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (394)..(394): a, c, t, g, unknown or other
  misc_feature (394)..(394): n is a, c, g, or t
  modified_base (454)..(454): a, c, t, g, unknown or other
  misc_feature (454)..(454): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctcgaggggnagacgccacctctcctgcagggccagtcagaacagttgganccaacttagcctggtaacctaacaaaaacctggccagcctcccagactcctcatttatcgttcatccacaggtccatgatcgtacccaaccagacttcagtgctagagggtctgggacagtactcagtctcaccataccagccagcgtaacngttacctgaaacgtacttgggacctaggttttacttacgtgttacaaaccgtagtttagngggtttacagggtttacggacccgttacgggtaacggttttccgggaccccgaaggggtacccaacgacgggttggaaacttacgttacggaaccgggtaccgtaaacgttcgggttacggtacgtaccggtacctaaccccaagtttcccttcgggtccttttacccg

SEQ ID NO: 91175 - DNA, 536 bp, Homo sapiens
  misc_feature: GYAE6OF01DYZOR.5.57.F02.1.454.CMB.1.raw
  modified_base (321)..(321): a, c, t, g, unknown or other
  misc_feature (321)..(321): n is a, c, g, or t
  modified_base (516)..(536): a, c, t, g, unknown or other
  misc_feature (516)..(536): n is a, c, g, or t
tcagatcagacacgcacgaccggtgctcgatttagctcgatatagttgggtttggggggaagaggaagactgacggtcccccaggagtccaggagtgcgtcgcaagtattggcagtgtgaaattttgacaccttatatgcagactctgtgaggggccgcttcaccgtgtccagagacaactccaagaacgccgtctatttgcagatggacagccctgagatcgacgacgacgggcatctattagttggtacgggcggccgagcaatactctcttactttcgtgagtcacgggtacgtcccggtcacctcgtcctcctcacnccctccaccgaacggccactccggtccttccccgcggcctaccctccgtaccgaacgacgcctaccgtcgtcggggcacgacggcccggcccggtcgggtccgtcggccgtcgggtaccgaacggtacttaccgttccgtcgttctcgattcgtggaggtccggggacgtgggacgaacggtcggactagacgtnnnnnnnnnnnnnnnnnnnnn

SEQ ID NO: 91176 - DNA, 775 bp, Homo sapiens
  misc_feature: GYAE6OF01BLSDN.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtcgtctccgaggggagagacgcccaccctctcctgcgacgggccagtaccaagaactagtttggacactaaacttcgaccgtacggtaaaccaaaacaaaaaccgtcggaccaaccgaccctacccaagtaccttcctactaacttttactcgttaccactcccaccgtacggacctactagactaccgaccccaaaccagtacttcgaggtcggacgagggtagggtcacgggacagtacttcgacgtcctaccgaaccagtaccgagtacgacgtaccgtaacgtacgtcgtaagaaccggttacgttacggtactttaacgttttaaacgttaccgtaacgtttaaaccaaaggttacgtttagggtaccggttacgtaacgggttaccggtaccccgttaaacggggttaaccggttaccccgggaacccggtaaccgggtaaaccccgtaacgggtaacgtacgggtaaacgtaaccggtaaccggtaaccgggtaacccggtaacgttacggggtccgtaacccggttaaccgtcccgtaaaccttaaccgggtttcctttaccggtttccctttaacccgg

SEQ ID NO: 91177 - DNA, 814 bp, Homo sapiens
  misc_feature: GYAE6OF01AY4AC.5.57.F02.1.454.CMB.1.raw
  modified_base (754)..(754): a, c, t, g, unknown or other
  misc_feature (754)..(754): n is a, c, g, or t
  modified_base (760)..(760): a, c, t, g, unknown or other
  misc_feature (760)..(760): n is a, c, g, or t
  modified_base (789)..(789): a, c, t, g, unknown or other
  misc_feature (789)..(789): n is a, c, g, or t
  modified_base (799)..(799): a, c, t, g, unknown or other
  misc_feature (799)..(799): n is a, c, g, or t
  modified_base (804)..(804): a, c, t, g, unknown or other
  misc_feature (804)..(804): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgccctaccctctccgtgccgacgggcccagtacgaacgaactagttgggtacgacctaaacgttacggccctacggtaaacccaaaaccgtaaaaacccgtcgggaccccaccggtcccctaccccgtaacgacccttacccctacgttaacttttacgttaccgtttacccaaccgttacccccgaaacccggtaaccggggtaccccctaaccggtttacgtaaccgtttaccccggtaaaccccctaaaacccgttaaacggttaaccttttaaccggacggggtttaccgggacggtaaacgggggttacgggggttaacccggtagggggtaaaccctaacgggttaacccgtttccggtaaaccggtttcctaaccccgaacccgtacgttacccgaacgtcccgtaacgggtacccgtaacgtaacggttaccggtaaggtaaaccgttacggttacggtactttaacggttttaacttaccgtacgtaacctaagtagttcgtagtacgtgacgtccgtacgtacgtccggaccgagacncgtagngtactcgacgtacggactacggtgtcgcncgactacctnttcgngttcctaccg

SEQ ID NO: 91178 - DNA, 903 bp, Homo sapiens
  misc_feature: GYAE6OF01DY1EH.5.57.F02.1.454.CMB.1.raw
  modified_base (868)..(868): a, c, t, g, unknown or other
  misc_feature (868)..(868): n is a, c, g, or t
tcagatcagacacgcacgaccggtgctcgatttagctcgatataggttgggtttgggggaggaactgctcagttacggacccagacggaaccagtggaacgccccagcgcagcttctcttcctcctgctactcgtcggcctcccagtacgttaccgggttaggggatagtcggtgacgtcgacgctacgttccaccgacgcctactccgtgttcgttgttcgtccgtacggaaggggcaacggacccgtcccctaccgttccgtccggcggaccggtacgggaccaacgttaaccgaaggttaaccgttagggtttacggaaacgtaaccgttaacggttaccggtacccgttaaaccggtaaaacccaaaaccgtaaaccgtccggaccctaccgacccgtacccgtaacgtacccttaccgttatttaacgttttccgtccgttaaccctaaccgtaccccgaacccggtacggtacccttacggacgttaaccgtccccgtaaaccccgaacgttagtaccgtacgggtacggtaccggacggtaacgggttacgggtaccggttaaacggaccgtaaccgtttaccgttaacggtacccgttccgtaaaccgtacgtaaccgaccggtacgtaacggtaccgggttaacctaacggttacgggttaaccggtaaacgtaccgtttaacgggtttcgtaaacgtttaacggtttaaccttcggaaacttaaccggtaaatttgggttacgggttacgtacggtaccggttaaccgtccggtaaccggttacccgggccgacgggtaaaccgtacgtaacgggtagtaacgtccggtaacggacggttcggtacgtacggttccgngtaaccgcctacgtacgtactcgttacgtccctag

SEQ ID NO: 91179 - DNA, 696 bp, Homo sapiens
  misc_feature: GYAE6OF01BT2QK.5.57.F02.1.454.CMB.1.raw
  modified_base (203)..(203): a, c, t, g, unknown or other
  misc_feature (203)..(203): n is a, c, g, or t
  modified_base (248)..(248): a, c, t, g, unknown or other
  misc_feature (248)..(248): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtcgtctcgagggganagacgcccaccgtctcctgcgagggccagtcaggaactgttgganctaacttacgcctaggaaccaaacaaaacctcggaccacgcctacccacgacctcctactactttactccgttacactaccaccgacggacctacgtcgactacgtaccccaaccgtagtacttaccgacggtacggcgaacgggtacggggttacgttaggggactaacggtaccgttcgtacgtacccgttcaaccgtagtaccgacggcaacggtccggtaactacgttccgtaaggaaacgttacggttcggtacgtttaagttttaacttacgtacgtacgtaacgtaacgttgggttacgtacgtaggtccgtaccgttaccgggtaaccgttccgggacccgtaacgggaccctacgagggttaccgaagttaccgacggtacggtaccgtaacggtcggttacggcttacgactaccctagttcctaggttcccttaccg

SEQ ID NO: 91180 - DNA, 735 bp, Homo sapiens
  misc_feature: GYAE6OF01AUJ6H.5.57.F02.1.454.CMB.1.raw
  modified_base (154)..(154): a, c, t, g, unknown or other
  misc_feature (154)..(154): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctggctccagataccggttgggganatcgtgatgacgcagtctccagccatcctgtctgtcgtctaccgagggggagagacgcccaccctctcctgcgacgggccagtacagaactagttggacactaacttagccgtacggtaaccaaaacaaaaccgtcggaccacgccctacccgacgtacctcctactactttacgtcgtacactccacgacgggaccacgtgtactcgtacccaacgtagtacttcgaggtcggacgaggtacgggtcgtacggacgacgtacttacgagtacctaccgaacctagtaccgacgaccgaacgtaccgttaacgacgtttacgtaacggtaacgttaccggttacggttaacgtttaacgttttacttaacctacgtaaacctaaacgttacggtttcgtaccgggttacgtacggttaccgggtacccgttaacccgggttaccggttacccgggaaccccggtaacggggaaccctaacgggtacggttacggtaacttaccgtaacggtaccggtacggtacggtcggtacggtaccgtacgtacccgtacgttacttcggttcgtttccgtttacccg

SEQ ID NO: 91181 - DNA, 721 bp, Homo sapiens
  misc_feature: GYAE6OF01B3CW2.5.57.F02.1.454.CMB.1.raw
  modified_base (216)..(216): a, c, t, g, unknown or other
  misc_feature (216)..(216): n is a, c, g, or t
tcagatcagacacgcacgaccggtgctcgatttagctcgatataggttgggtttgggggaggaactgctcagttaggacccagacggaaccatggaagccccagcgcagcttctcttccctcctgctactctcggctcccagacttaccggttggggagatcgtagatcgacgcagtcctccacgccattcctgtctggtctccgtcgaggggtanacgacgccctacctctaccgtgcgacgggtcctaagtcaacggtaactggttcgaacgtacctaacgttacgtccgtacggtaaacccaaaacgtaaaaccgtcggaccctacgtacccgtaccctaacgtaccttccttactacttttacgtacccggtttacaccgtaccccaccgggaacggtaccctacgtacgtacgtaccgtaaacccctaacgaagttaccgtagaccggtaggaaccaggggtaccgggtttacggacgggtaacctacgttacggctacggttacaccgtactagtacgacgtacgacggtactaccgagtacgtaacgtaacgtattacggtaccttagtttaccgtaacgtacttaactaaccgtttgtacggttcgtacgtaggttccgtaccgttaccgacggttcccgtacggacgacgttagacgtacggagtacgtcgacgtatacggtgacgtcgacactacgattaccgtgtctacg

SEQ ID NO: 91182 - DNA, 670 bp, Homo sapiens
  misc_feature: GYAE6OF01ECIPK.5.57.F02.1.454.CMB.1.raw
  modified_base (402)..(402): a, c, t, g, unknown or other
  misc_feature (402)..(402): n is a, c, g, or t
  modified_base (654)..(654): a, c, t, g, unknown or other
  misc_feature (654)..(654): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtcgtctccgaggggagagacgcccaccctctcctggcgacgggccagtacaaggtaactagttggtacgacctaacgttcgaccgttacggtaaacccaaaacctaaaaaccgtcggacccaacgccctacccgaagtaccttcctacttaatttactccgttacactacccgacgaccggcacgtgactcgacccaacgatactcgaggtcgngtaggtagggtcgaggacgtagactttacgacgtcctacacctataccgagtaccgaacgtccgtacgtagtcgtaagaacggttacgttaggtaccttaggttttaactacgtcgtaactaaccggttagttcggtaccggttagaccggttaccgtaccgtaccgggttaacggtcccggacccgaaggtacccaggtagtacgtacaagtcccgaggtaccgtaggtcggctccggtacgacttaaccngttctcgtccgttacg

SEQ ID NO: 91183 - DNA, 819 bp, Homo sapiens
  misc_feature: GYAE6OF01C3YPM.5.57.F02.1.454.CMB.1.raw
  modified_base (153)..(153): a, c, t, g, unknown or other
  misc_feature (153)..(153): n is a, c, g, or t
  modified_base (800)..(800): a, c, t, g, unknown or other
  misc_feature (800)..(800): n is a, c, g, or t
  modified_base (808)..(808): a, c, t, g, unknown or other
  misc_feature (808)..(808): n is a, c, g, or t
tcagatcagacacgcacgaccggtgctcgatttagctcgatatagttgggttgggggaggaactgctcagttaggacccagacggaaccatggaacgccccagcgcagcttctcttcctctgctactctgctccagtactaccggttgggganagtcgtgatgacgcagtctccagccattcctgtctggtcgtaccgtccgggaaggggagaacggccgtccctacccttcgtccgcggaccggacgggcctaacggtacgaacgtaaccgttggttacggtaaccgtaaccgtaacgtttaccgacccgttaaaccggaaaaccctaaaaaccgaaaaaccgtcggaacccgtaccgacccctacccgtaacgtaccccttaccttacttaacgttttacgtccgttaaccacctacccgaccggtacggcctaacgtgtaccttacccgaacccgaacgtaggttacctaggaccgtacggtaacggtagggtaacgggtacggtacggaacgtaacggttaccgttacgtacggttaacccaccaaacgtacgtaccgagaccgaccgtagtaaccgtagtacgtaggtaacgtaccggttagttaacgttacgtttaactacggttataaacgtacgtaaggttcgggttacggtaacgttcggggtacccttacccgggttaacggggttacccggtaaccccgggaagttaaccccgggagtaaccgtacgggtacgtcctaacgggacgacgggtacgttaaggtcggggctaacccggctaccgtaacttntaccgttntcggttaaccc

SEQ ID NO: 91184 - DNA, 765 bp, Homo sapiens
  misc_feature: GYAE6OF01EAWSY.5.57.F02.1.454.CMB.1.raw
  modified_base (726)..(726): a, c, t, g, unknown or other
  misc_feature (726)..(726): n is a, c, g, or t
tcagatcagacacgcacgaccggtgctcgatttagctcgatatagttgggtttgggggagaactgctcagttaggacccagacggaaccatggaacgccccagcgcagcttctcttcctcctgtctactctcggcctcccagtacgttaccgggttgggggagtagtcggtagaagtcgaccgtcgacgttcctaccgacgcccttactcccgttgttcgttggttcgttacccgtacgggagggggacgtacggaccgtcccctacccttctccgtgaccggacggcctaggtcaagtaactcgttaggtacactaacgttacgtaccgtaacgtaacccaaaaccgtaaaccgtccggaccgaccgtcctaccgaccgttaccttacctactttacgtttactccgtaccgtactccccgaacggtccgacctacgtacggtacctaccgtaaccccatacggtctacggaggtacgacgtagggtacgtcggtacggactacgtctcgtacgtcctagacctcgtacacgtacgagtaccgtacgtacgtacgtacgtaacggtacgttacgtacgtttaagttttactaacggttactaacgtaacttaggtcggttacgtacggtcggtaccgttacggtacccggtaacggttcccggaccgtaacggacgtacggtcggtagtacgagtacggaacggttcgtacggttcgaccgggtnacccggttactacgttacttccgttcgttccgttacccg

SEQ ID NO: 91185 - DNA, 766 bp, Homo sapiens
  misc_feature: GYAE6OF01B49BU.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (249)..(249): a, c, t, g, unknown or other
  misc_feature (249)..(249): n is a, c, g, or t
  modified_base (752)..(752): a, c, t, g, unknown or other
  misc_feature (752)..(752): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgccaccctctcctgcgacgggccagtcaagaacagttgggacnctaacttgccgtacggtaaccaaactaaaaccgtcggacccacggccctaccccgagtaccttaccctactacttttacttccggtttacaccgtccccgaaccgtagggccctaacgtcgactaccgtaccccaacgtaaggtacttacgaggtcggaccgaagggacggggttcacggggacacggtacgttcgacggttcctacaccgtataccaggaccgtacgtaccgttaacgaggttaccgtaaggtaaacgttacggttggtaaccgtttaacgttttaacgtttacctacggttaaccctaaacgtttaggttagggttacgggtacctaagggttcccggtacccgttaaccggggtaacccggtttaccccggggacccgaaccggggtaccctaacggtacggggttactaacgttaacgtaccgggtacgggtaaccttacggttcgggtaccggtcttaccgggacccttaaccctgtttcccggtttntcccgttttacccg

SEQ ID NO: 91186 - DNA, 679 bp, Homo sapiens
  misc_feature: GYAE6OF01AHLQF.5.57.F02.1.454.CMB.1.raw
  modified_base (158)..(158): a, c, t, g, unknown or other
  misc_feature (158)..(158): n is a, c, g, or t
  modified_base (178)..(178): a, c, t, g, unknown or other
  misc_feature (178)..(178): n is a, c, g, or t
  modified_base (212)..(212): a, c, t, g, unknown or other
  misc_feature (212)..(212): n is a, c, g, or t
  modified_base (235)..(235): a, c, t, g, unknown or other
  misc_feature (235)..(235): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (563)..(563): a, c, t, g, unknown or other
  misc_feature (563)..(563): n is a, c, g, or t
  modified_base (658)..(658): a, c, t, g, unknown or other
  misc_feature (658)..(658): n is a, c, g, or t
tcagatcagacacgcacgaccggtgctcgatttagctcgatatagttggggtttgggggaggaactgctcagttaggacccagacggaaccatggaacgccccagcgcagcttctcttcctcctgctactctcggctcccagactaccggttgggganatcgtgatggacgcagtccnccagccatcctgtctgtcgtcctccggagggganacgaccgccctaccctcgtccgnggccgacgggccagtcaagactgttggacactaactcgctacgtaacaaaccgtaaccgngaccncgtcctacccgacgcccttacctacttaactttacgtccgttaacacccgtacccgacgaccgggtcctaacgtgaccgttccgaacccctaacgagttacgtcgtacggtaccggagtaacgggtcggtacggtacggaaccgttacgtacgttaccgtaaccgtccaaccgtaactacgtaccgacggtcgtaaccgtccgtaacgtacgtacgtaacgtagttcgtacgttattacgttactactacgtaagacttcggngttcgacgtcgtaccgacctaggtacggccctaacggcgtacgtagtcggtacagtccgagggtaccacggtctagggtccgtaacgcgtaaccncgtatcggttactcctacccg

SEQ ID NO: 91187 - DNA, 770 bp, Homo sapiens
  misc_feature: GYAE6OF01DJ4JI.5.57.F02.1.454.CMB.1.raw
  modified_base (153)..(153): a, c, t, g, unknown or other
  misc_feature (153)..(153): n is a, c, g, or t
  modified_base (205)..(205): a, c, t, g, unknown or other
  misc_feature (205)..(205): n is a, c, g, or t
  modified_base (220)..(220): a, c, t, g, unknown or other
  misc_feature (220)..(220): n is a, c, g, or t
tcagatcagacacgcacgaccggtgctcgatttagctcgatatagttgggttgggggaggaactgctcagttaggacccagacggaaccatggaagccccagcgcagcttctcttcctcctgctactctggcctccagactaccggtgggganatcgtgatgacgcagtcctcagccatcctgtctgtcgtccgacggagggganagcgcccacccgtcncgtgacgacggccagtaccaagtaactggttaggacgactaagtcgaccgtacgaaaccaaaccaaaaccggtcgaccacgtccctacccacgtacctcctacgtactttacgtccgtacaccgtacccaacgcggacctacgtacgtccgttaccgaccctaacgtcgtaacgttacgacggtcggacgtacgggtacgggtacgtacggactaacggtaccttaccgactccgtaacgtaaccctacgtaccgacgtacgtacggtaccgttaacgacgttacggtaacgtaacgttacggttacgtacgttaagtttaccgttaacgtacgtactaaagtcgttaggggtactacgggtacgtacggtacccgttacgggtaaccggttaccggacccgtaacggggtacccaaagggttaccgggttacggtaaccgttaacgtaaccgggggtaacggttcccgggtaaagggttccccggtacgggttacccgacccgttaccggtaccgttaacccggtttcggttaccgttccccttaccgg

SEQ ID NO: 91188 - DNA, 699 bp, Homo sapiens
  misc_feature: GYAE6OF01BEOSI.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccacctctcctgccagggccagtcaagaactgttggagctaacttagcctaggtaaccaaacaaaaacctggaccacgcctaccagtactcctactactttactcgttacactccaccgacggccactgactcgtacccaacagtattcgagtcggacgaggtacgggtcgtacgggacgtaacgtacgttacgacgtacctaccaaccgtattaccgaagtaccgaacgtaccgttaacgacgttacgtaaggtaaacgttacgttacgggactttaagggttttaacttaacgtacgtaacctaaactaaggtttcggtaacgggttacgtaacgggtcggtacccgttacgggtaaacccgggttcccggaacccggtaacgggaaccctaacggtaacggttaggtaacgtacgtacggtacggtaacgtaacgttcgggtacggtactacggtactacccgttagttcctcggtttaccgttaccg

SEQ ID NO: 91189 - DNA, 723 bp, Homo sapiens
  misc_feature: GYAE6OF01DG5Y4.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagactaccggttggggagatcgtgatgacgcagtctccagccatcctgtctgtcgtcgtccgaggggagagacgccctaccctctccgtgcgacgggccagtcagtaactgttaggacactaacgttacgacctacggtaaaccaaaaccgtaaaaccgtcggaccaacgtaccctaccaacgtacctcctacttatttacgtccttacactacccgaccgacggacctatcgtactccgtacccaactagtacttacgaggtcggagacgggtacgggtcgtacgggaactagtaccttcacgttcctactacactacgacgacgtacggtacctaacgtagtacgtagtaagttacgttaacggtacttaaggtttttaactaccggtagtaactaaacgtttaggttaggttcgggtactaacgggttccggtaaccccggttagggttacccggttaccggggaacccccgtaagggtccccgtaaggtaacgggtaggaacttaggaccggttacgggaacgttacggtcgggtacgaccgttacgccctaacgggttcttaccgttggttacccttaccg

SEQ ID NO: 91190 - DNA, 870 bp, Homo sapiens
  misc_feature: GYAE6OF01DTGO9.5.57.F02.1.454.CMB.1.raw
  modified_base (155)..(155): a, c, t, g, unknown or other
  misc_feature (155)..(155): n is a, c, g, or t
  modified_base (205)..(205): a, c, t, g, unknown or other
  misc_feature (205)..(205): n is a, c, g, or t
  modified_base (255)..(255): a, c, t, g, unknown or other
  misc_feature (255)..(255): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttgggganatcgtgatgacgcagtctccagccatcctgtctgtcgtctccgagggganagacgccctaccctctcctcgcgacgggccaggtcagaactagttggganctaacttagtcctacggtaaccaaacgaaaaaccgtcggtaccaacgaccctacccgacgtaccttacctacttaactttacgttaccgtttacacttacccgaacccggtacgggaccctaacgttcggtaactcgttaaccccaaaccgtacgtacgttttacgacggttacgggcgtaacgggtacggggtacgtaggggaaccgtaggttaccgttacgaacgggtttcctaccaaccgtaacgtaccgtacgaccgtaaccgtacggtaacctaacgttaccgggttaacgtaaaccggttacggtttaacggttaccgttttaaacggttttttaacgtttaaccgtttacggtaaacgttaaacccgttaaggttacgggtttaccggttaacgtacggggttaaccgggtttacccccggtaaaccggggtttacccgggttaacccgggtaccccggtaaacgggtacccgtaaccggttaaacgggtccggggtaaattaccggtaccgggtaaacggggtaccgttaacgggttcgggtaaccgggtccttaacgggtacccgtaaaccccgttagtttacccgtccgtttacccttacccggg

SEQ ID NO: 91191 - DNA, 813 bp, Homo sapiens
  misc_feature: GYAE6OF01CAMTH.5.57.F02.1.454.CMB.1.raw
  modified_base (207)..(207): a, c, t, g, unknown or other
  misc_feature (207)..(207): n is a, c, g, or t
tcagatcagacacgcacgaccggtgctcgatttagctcgatataggttggggtttgggggaggaactgctcagttaggacccagacggaaccatggaagccccagcgcagcttctcttcctcctgctactctggctcccagataccggttggggagatcgtgatgacgcagtctccagccatcctgtctggtgtcgtccgagggganagcgcctaccctcgtcctggcgaggggcctaggtaccaaggaacctagtttcggggaatacctaaacgtttacgacccgttacgggaaacccaaaacgtaaaaaaccgtcggacctaccggaccctacccgagtaaccctccttacgtaacttttaccgtcgttacctaaccgtacccaacccggtacggaccctacgtcgaccgtcgtaaccccctaacatacgttcgaaggtcggacgtagggtaccgggtcgtaacggggactaacgggtacttaccgtacgtactaccaccgtagtcgaacgtacctaggtaccgttaaccgaggttaccgtaaggtaaacggtttacggtttagggtaactttaacgggttttacttaacggtacgttaactaaacgttagtacgggtacgttaacggttaccgggtaccggtaccccgttaaggggtaacccggtttcccgggaacccggtaacgggtacccaacggggttaagtccggaaaggttacccgtaacgggtaccgggaggtaacccggtttagggcccgggtaacttcccggaaccgttaactaccgttcggttacggtccttttaacccgg

SEQ ID NO: 91192 - DNA, 891 bp, Homo sapiens
  misc_feature: GYAE6OF01CO3QN.5.57.F02.1.454.CMB.1.raw
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggcctcccagataccggttggggagatcgtgatgacgcagtcctccagccatcctgtctgtgtctcgagggganagacgccctacctcctccgtgcgacggccagtacaagaactagttaggacactaacttcgacctaacggtaaccaaaaccgtaaaaccgtcggacccacgtccctacccgacgtaccttcctacttaacgttttacgttaccgttacctacgtaccccgaaccggaccgggtaccctacgttacggaacgttccccgtaacccccaagtaacgttacttaccggaagggttaccggacggtaacggggtacgggttaccggtaacggggtaaccgtaaccggtccgtttaaccgtacgttccctaaaccccgacctaacgtaccgaaccgtaccgtacgggtacccgtaacgtaaccgggttcgtaacgtaaacggttacgttacgggtaacttttaacggttttaacttacgtaccgtaactaacgtaacggtttggtaacggtacggttaccggttaccggtaccccggttaaccggggttaaacccgggttaccccgggaacccgggaaccggggtaaccccttaaacgggggtaccggttaacgggtaaaccgttacgggttaaacggggtaaccgggtttaccgggtttaaaccgggttcggggttaacccgttaacggttacccgggtaccaaacccccggttttacgttacccgtttcggtttcccccggttttaaaccc

SEQ ID NO: 91193 - DNA, 828 bp, Homo sapiens
  misc_feature: GYAE6OF01CTV3E.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
  modified_base (260)..(260): a, c, t, g, unknown or other
  misc_feature (260)..(260): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagactaccgttgggganatcgtgatgacgcagtcctccagccatcctgtctgtgtcctcgagggganagacgcccacccttctccctggcgtaacggggccagtacaagtaactagttggganacctaacgttacggccgtacggttaaacccaaaccgaaaaaccgtcggaccctaaccgccctcccaacgtaacctccctactacttttacgtcctttacacctaccccgaaccgacgggtccctacgtacgtactacccgtaaccccctaaccgtaggtaaccttcgtaaccgggtcggaccggtaaggggtacggggttaccgtcgggggaaaacctacggtacctttacccgtaacgttacctaaccgaaccctagttaccagggtaacccacggttaacccgttaacgacgttcggttaaagaaccgggttaacgttacgggacttttaacgttttaacgtaccggtttacgtaacgtaaacctttaaggtttcgggtaacggttaccgtaagggtttccccggtaccgttacccgggggttaaccgttccccgggaacccgggtaaccggacctaacgggtaacggtacgggttaaacttacggtaccggtaaggggtaccttaacggttgggaaccgtcggacctacccggtaacttaccggttcgttccgttacgttacccc

SEQ ID NO: 91194 - DNA, 637 bp, Homo sapiens
  misc_feature: GYAE6OF01AZZS0.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (250)..(250): a, c, t, g, unknown or other
  misc_feature (250)..(250): n is a, c, g, or t
  modified_base (395)..(395): a, c, t, g, unknown or other
  misc_feature (395)..(395): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctccgtgcgacgggccagtcagaactagttggtanactaaacttgcccttacggtaaccaaaaccaaaaaccgtcggacccacgccctcccgaagacctccctactatttactcgttcactccaccgagggccacgtgactcgtaccccaacagtatcgagtggactagggagggtccgngggaactacggtacttcgagtcacacctatcagtcagtacctaacgagtctaggaacgtacgtggacttagttttactacttagtaccaaacgttagtcggttagtacgtaggtaccggtacccgttacgggtaacccggtttccgaccccggtaacgggacctaacgaggtaggtactacgtaccgagggtaccgaaggttcgtacggcttaggacctacctagtccgttcgttcttaccg

SEQ ID NO: 91195 - DNA, 613 bp, Homo sapiens
  misc_feature: GYAE6OF01A1M87.5.57.F02.1.454.CMB.1.raw
  modified_base (155)..(155): a, c, t, g, unknown or other
  misc_feature (155)..(155): n is a, c, g, or t
  modified_base (207)..(207): a, c, t, g, unknown or other
  misc_feature (207)..(207): n is a, c, g, or t
  modified_base (463)..(463): a, c, t, g, unknown or other
  misc_feature (463)..(463): n is a, c, g, or t
  modified_base (588)..(588): a, c, t, g, unknown or other
  misc_feature (588)..(588): n is a, c, g, or t
  modified_base (594)..(594): a, c, t, g, unknown or other
  misc_feature (594)..(594): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttgggganatcgtgatggacgcagtcctccagccatcctgtactgtgtctccgagggganacgacgcccacctctccgtgcgagggccagtcaagaactgttcggtagactaacgttagcctacggtaaccaaaacgaaaaaccgtggacccaacgccctaccgaacgtaccttcctacttacgtttactccgttaccaccgttcccaaccggtacggcctaacgtcgtactccgtaacccaactagtacttcgaggtacgacgaagggtcggttcgagggactacgtactcgacgtcacacatcagctagctacngtacgtagagtcgtagtacttagttatacgtactaactagtagtggtactacgtacgtcacggttacggaccggtcgacccgtaggacccaggtgtagtaactcgaacggagtccggtagtcganccgtanactctattcgtcttcgtac

SEQ ID NO: 91196 - DNA, 806 bp, Homo sapiens
  misc_feature: GYAE6OF01C4MAS.5.57.F02.1.454.CMB.1.raw
  modified_base (154)..(154): a, c, t, g, unknown or other
  misc_feature (154)..(154): n is a, c, g, or t
  modified_base (181)..(181): a, c, t, g, unknown or other
  misc_feature (181)..(181): n is a, c, g, or t
  modified_base (197)..(197): a, c, t, g, unknown or other
  misc_feature (197)..(197): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggcctcccagactaccggtggganagtcgtgatcgacgcagtctccagccntcctgtctgtcgtccncgaggggagacgacgcccaccctctcctcggacgacgggtaccaggtaccaagaactagttggaacgacttaaccgttacggtacccttacggaaaacccaaaaccgtaaaaacccgtcggacccaacgtcccctaccccaagtcccttacccttacgttaacttttacgttccgttaaccaccgttaccccgaacccggtaacgggtacccctaacgttcgaaccgtttacccgtaacccccaacgtaacgttctacgacggtcggaacgtaagggtacggggtcgtacgggaactacggttacgttcgacgttccaccgtacctaacgacgacggtacctaacggtaccgtaacgtacgtacgtaaggtaacgttacgtttacggtaactttagttttaaccgtacgttacgtacctaaacgttacggttcggttacggtaccgttaggtacccggttaccgtacccggggtaacccggttccggaaccccggtaagggtacccgtaacggttaacgtacggtaaccgttacgtacggaacggtaacggtaacgtcgggtacgggtctacggtaccctaaacttgttaaccctgtttacccgttccg

SEQ ID NO: 91197 - DNA, 649 bp, Homo sapiens
  misc_feature: GYAE6OF01DFKWW.5.57.F02.1.454.CMB.1.raw
  modified_base (153)..(153): a, c, t, g, unknown or other
  misc_feature (153)..(153): n is a, c, g, or t
  modified_base (204)..(204): a, c, t, g, unknown or other
  misc_feature (204)..(204): n is a, c, g, or t
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (289)..(289): a, c, t, g, unknown or other
  misc_feature (289)..(289): n is a, c, g, or t
  modified_base (307)..(307): a, c, t, g, unknown or other
  misc_feature (307)..(307): n is a, c, g, or t
  modified_base (329)..(329): a, c, t, g, unknown or other
  misc_feature (329)..(329): n is a, c, g, or t
tcagatcagacacgcacgaccggtgctcgatttagctcgatatagttgggttgggggaggaactgctcagttaggacccagacggaaccatggaagccccagcgcagcttctcttcctcctgctactctggctcccagataccggttgggganatcgtggatgacgcagtctccagccatcctgtctgtcgtctccgagggganagacgcccacctctccngcagggccaggtcagaactnttgganctactgcctaggtaaccaacaaaactcggccacgcctccaancctctctattactcgttnactaccacgtaggcactgactnaccctaacagtacttcaggtcgacgaggaacgggtcgtaggactaagtaccgtcaggtacctccgtaaaccagtacacgtacgaacgtaccggtaactacgtacgtagaaacggttaacttagggctttaaagggtttacttaccgtagtaaccaacggtttaacgtgggttaccggtagtaacgtccggggaccttaaccgggtaaccgtcggaccccggaaggtacccgacgtaaggtcgtacggtactacggtacgggtaacaacggttggtaaccgggtcaacgccgtaaactccggttaaatcggttacttaccg

SEQ ID NO: 91198 - DNA, 754 bp, Homo sapiens
  misc_feature: GYAE6OF01EFIUA.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (244)..(244): a, c, t, g, unknown or other
  misc_feature (244)..(244): n is a, c, g, or t
  modified_base (703)..(703): a, c, t, g, unknown or other
  misc_feature (703)..(703): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagataccggttgggganatcgtgatgacgcagtctccagccatcctgtctgtgtctcgagggganagacgccaccctctccgtgcacgggccagtcagaacattgganactaacgttagcctaggtaacccaaaactaaaaaccgtcgacctacgacccgtacccagaccctccttactaacttttaacgtccgttaccaactcccaaccggacgggtaccctacgtacgtaactccgttaccccaaaaccgtggtaaccttacgacggttacggaccgtaaggggtaacggggttccggttacgggggaaacctaacggtaacccgtttacgtaaccggttacctttacccgaaaccgtaacttaccgaacggtacgtaaaccgtcccggttaaacgtaggttacctaaagggtaaccggttacgttcgggtaaccttaacgttttacgttaacctaggtacctaaacgtgttaggttcgtacgtacgggtacggtcccttaacgggtaaccgttacccggaacccggtacgggtaccgaaccgtagggtaccgtagacgtacggnggtaccggtaactcgggtagccgttcgaactacgtatccgtgttaccgtcc

SEQ ID NO: 91199 - DNA, 836 bp, Homo sapiens
  misc_feature: GYAE6OF01D8NQ9.5.57.F02.1.454.CMB.1.raw
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagataccggttgggagatcgtgatgacgcagtctccagccatcctgtctgtgtctcgaggggagngacnccacctctctgcgaggccagtcaagaactagttcggacactaacgtttagaccgttaacggtaacccaaaaacctaaaacccgtcggacctaccgtccctacccgaacgtaccttcccttactttaacgtttacgtccgttacctaccgtacccgaaccggaccggtaccctacgttacgtaaccgttacccggtaaacccctaaaccgtaaggttacctttacggacgggttaacggaccgtaacggggtacgggtacgtacggggtaaacgtaacgttaccgttacgtacgttacctaccgacctataccggaacggtccgtaaacggtaccgttaacggtaaccgttacggtaaacgggtaaccgtttaacggttacggtaacgtttttaaacggttttaccgtttaacgtttaacgtaacctaaaggtttacggtttacgggttacggtaaccgtaccgggttaccggttaccggttaaccgggttacccggttaccggacccggttaacgggaccgttacggtagggtacttacgtaacgtaccgggtaaccggtaacggttcggttcgggtcggtaccgaccgtaccctaacgttacctttccggttcgtttaaccgtaccccgg

SEQ ID NO: 91200 - DNA, 785 bp, Homo sapiens
  misc_feature: GYAE6OF01CVG8A.5.57.F02.1.454.CMB.1.raw
tcagatcagacacgcacgaccggtgctcgatttagctcgatatagttgggttgggggaggaactgctcagttaggacccagacggaaccatggaagccccagcgcagcttctcttcctcctgctactctggctcccagataccgttggggagatcgtgatgacgcagtctccagccatcctgtctgtcgtcctccgaaggggagacgacgccctaccctctcctggcgagggcctagtcaagaactgttggagactacgttacgccttacggtaaaccaaaactaaaaccgtcggacctacgaccctaccgaacgtaccttccccttattacttttactaccgttaccactcccgaaccggtaacgggccctaattcgacttcccggtaaccccaaagtacgtacttcgaaggtcggaacgacggggtacgggtacgtagggaacctacggtaaccgtttcgacgtttccaaccccgtaaacaaccttccggaaggacccgtaaccggtccgggtttaaactcggttacgttaaacgggaacgttaaccgtttaggtaccttttagttttaacgtacctacggtaaccttaaagtcgtttcggaggtttaccgacggtttacccggacctttaccgggtaccgggtttcccggaacccgtaacgggacgtacgttaaagggcggtacctaggttacccggaagggtacccgtaagttcggggtaaccggtccctaacgggtaccccttaaccgtgttttaacccgccggttttccctttaacccg

SEQ ID NO: 91201 - DNA, 618 bp, Homo sapiens
  misc_feature: GYAE6OF01AKGJQ.5.57.F02.1.454.CMB.1.raw
  modified_base (156)..(156): a, c, t, g, unknown or other
  misc_feature (156)..(156): n is a, c, g, or t
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (303)..(303): a, c, t, g, unknown or other
  misc_feature (303)..(303): n is a, c, g, or t
  modified_base (351)..(351): a, c, t, g, unknown or other
  misc_feature (351)..(351): n is a, c, g, or t
  modified_base (528)..(528): a, c, t, g, unknown or other
  misc_feature (528)..(528): n is a, c, g, or t
  modified_base (598)..(598): a, c, t, g, unknown or other
  misc_feature (598)..(598): n is a, c, g, or t
tcagatcagacacgcacgaccggtgctcgatttagctcgatatagttgggtttcgggggaggaactgctcagttaggacccagacggaaccagtggaagccccagcgcagcttctcttcctcctgctactctcggctcccagataccgttgggganatcgtgatgacgcagtctccagccatcctgtctgtcgtctccgagggganagacgcccaccctctcctgccgagggccagtcagaactnttggancaacttcgcctggtaccaacgaaaacctggaccaggcctaccagaccctctntattactcgtacactaccacggacggcctacgtgactccgaccaacgnttactcgtaggtcgacgaggtcggtcgagggacagtacctagacgtccacacctatacacgcaacgtactacgtgtcgtaaggacgttcggtcggacttagtttactgtaccgtaacaactgtacggtcgtacggtagtccgtacctacggtaccgtcccggtagaccgacgtacgngggtcgataccggtagccggtaacggttacgtcgggtaccggtcaccggtacccgtagttacccggtttnttcccggttcttaaccccgg

SEQ ID NO: 91202 - DNA, 693 bp, Homo sapiens
  misc_feature: GYAE6OF01C572K.5.57.F02.1.454.CMB.1.raw
  modified_base (152)..(152): a, c, t, g, unknown or other
  misc_feature (152)..(152): n is a, c, g, or t
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggganatcgtgatgacgcagtctccagccatcctgtctgtgtccgtaccgagggganacgacgccctaccctctcctgcgacgggccagtcaagaactagttggagactaacttcgaccgtacggtaaaccaaaccgaaaaaccgtcggacccacgaccctaccaacgtaccttcctacttaatttacttccgttcacctaccgaccgacggtcctactcgactaccgaccccaaacgtcgtactcgaggtcggacgaacgggtcgggtacgtacggtaacgtaacgtacttcgacgtcctaccgacctagtacgcgtaccgtaacggtccgttaacgtacggtacgttaaggaaccggttacgttacggtacttttaagtttaacgttacgttcgttaaacaactaggttaccggtagttacgacggttccggacccgttcggtaaccggtcccggaccggtacggaccgacgtaggttacggaaacttcggacgagggtactacggtgcgggacctgacccaacgtcgttcttggttctacccg

SEQ ID NO: 91203 - DNA, 711 bp, Homo sapiens
  misc_feature: GYAE6OF01D2BF9.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (313)..(313): a, c, t, g, unknown or other
  misc_feature (313)..(313): n is a, c, g, or t
  modified_base (683)..(683): a, c, t, g, unknown or other
  misc_feature (683)..(683): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccgttgggganatcgtgatgacgcagtctccagccatcctgtctgtcgtctcgagggganagacgccaccctctcctgccgagggccagtcaagaactgttaggacgctaacgttagcctacggtaaccaaacgtaaaaccgtcggaccacgcctacccagtacctcctntatttactcgtacactccaccgacggaccacgtgactccgtacccaaccagtacttacgaaggtcggaccgaagggtacgggtacgtacggggaactaacgttacgttacgacgttccttaacccgaaacctacgtaccgtaacgaccgaacggtaccgttaaccgtaagttacccgtaaaggtaaaccgttaacggttcgggtaacctttagtttttaaccgttcgttaacgttaaccgtaaacgttaagttcggtacggtttacgacgggttaccggtacccgttaaccggtacgggttacccggacccgtaacgggacctacggacggtcgtactacgtacggacggtacgtacggttggacggtcnccgtactactaggttcctgttcttaccg

SEQ ID NO: 91204 - DNA, 846 bp, Homo sapiens
  misc_feature: GYAE6OF01CVM8A.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtcctccgagggganagacgccctaccctctccgtgcgagggtaccagtcaagtaactagtttcgggaagccttaaacgttacgacccgttaacggtaaaccccgaaaaaccgtaaaaacccgtcgggaccccaacggaccccttaccccaacggttaacccttccccttaccttaaacgtttttaaccgtttcccggttttaaccaaccgttacccccgaaacccggacgggggttaccccaacggtttaccggtaaccgtttcccgtaaacccccaaacccgtagttaactttaccggagggttacgggaccgtaagggtacggggttcgacggggtaacctaacggtaccttacgacggtttccctaaccgaacctagtaccagtacgaccgtacgtaccgtacggtactagaaacggttcgttacggtactttacgtttaacttaccgttagtaccgtaaagttaggttagttacgggtacttaacggtccggtaccgttacggtaccgggtttacccggacccgtaacgggacctaacggtacgggtaacggtatacggttaaccgacgggtacccggtaaacgttcggggtacggtaccgtaccggtaccgttaacttacccggtttctaacccggtttccctttaacccg

SEQ ID NO: 91205 - DNA, 692 bp, Homo sapiens
  misc_feature: GYAE6OF01BCUHU.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (650)..(650): a, c, t, g, unknown or other
  misc_feature (650)..(650): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggangacgccaccctctcctgcagggccagtcaagaacnttgganctaacttagcctacggtaaccaaaccaaaaaccgtcggaccacgaccctacccaacgtacctcctacgtactttaactccgttactactcccaccgtacgggccacgtgactacgtaccccaacagtacttcgaggtgacgtacgggtagggtacgtagggaactaacgacttacgacgtcctacaacctactacacgacgtacgccgttaacgacgtacgtaaggtaaacgtacggttacgtacgtttaaggttttacttaaccgtagttaacctaaacgtaagtttcgggtacggtacgtaacgggtccggttacccgtaccggggttaaccggttcccgggacccgtaccgggaacctaccggtaggtacgtactaacggtcgaacggtaccggtaggtacggnggtccacgtacctacccgtagttccttacggttcttaacccg

SEQ ID NO: 91206 - DNA, 613 bp, Homo sapiens
  misc_feature: GYAE6OF01CE4GR.5.57.F02.1.454.CMB.1.raw
  modified_base (156)..(156): a, c, t, g, unknown or other
  misc_feature (156)..(156): n is a, c, g, or t
  modified_base (174)..(174): a, c, t, g, unknown or other
  misc_feature (174)..(174): n is a, c, g, or t
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (249)..(249): a, c, t, g, unknown or other
  misc_feature (249)..(249): n is a, c, g, or t
  modified_base (520)..(520): a, c, t, g, unknown or other
  misc_feature (520)..(520): n is a, c, g, or t
  modified_base (576)..(576): a, c, t, g, unknown or other
  misc_feature (576)..(576): n is a, c, g, or t
  modified_base (582)..(582): a, c, t, g, unknown or other
  misc_feature (582)..(582): n is a, c, g, or t
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
tcagatcagacacgcacgaccggtgctcgatttagctcgatataggttgggtttgggggaggaactgctcagttaggaccagacggaaccatggaagccccagcgcagcttctcttcctcctgctactctcggctcccagactaccggttgggganatcgtgatgacgcagtcncagccatcctgtctgtgtctacgagggganagcgccaccttcnctgcgacgggcagtacaagaactacgttgganactaacgttacgaccgtacggtaaaccaaacgtaaaaaccgtcgaaccacgccctaccacgtacctcctactagtttactcttacactaccaccgacggtaccacgtgtactccgtacccaactacggacttacgaggtgacgagggtacgggtcgagggacagtaacgttcgacgtacacgtaacacgtacaacgcgtacgtactacgagtacaagtaagtacgtaggtacgttagtttaacgttacgtagttacaattagtggtacgtntacggtacggtccttaacgggaccgttcgaccgtagggaccacgagtagactacgngacganacggtcgagcgactacactntntcgtctacg

SEQ ID NO: 91207 - DNA, 785 bp, Homo sapiens
  misc_feature: GYAE6OF01B7OGK.5.57.F02.1.454.CMB.1.raw
  modified_base (151)..(151): a, c, t, g, unknown or other
  misc_feature (151)..(151): n is a, c, g, or t
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
tcagatcagacacgcacgaccggtgctcgatttagctcgatatagttgggtttggggagaactgctcagttaggacccagacggaaccatggaagccccagcgcagcttctcttcctcctgctactctggctcccagataccgttgggganatcgtgatgacgcagtctccagccatcctgtctgtcgtcctccgagggganagacgccctaccctctcctggccgagggcccagtcaacggtaactagtttgggaacnctaaacgtttacgaccgttacggtaacccaaaccgtaaaaaacccgtcgggtacccaacggtaccctacccgaacggtacccttaccccttactacgttttaacttccgtttaccaccgttacccaaccggtaccgggtaccctaacgttacgacttaccggttaccccaaaccgtacgttaactttaccgaacggttcggaccggtaacggtacggggttaccgtaggggaaccgtaacgtccgttacgtacgttaccttaccgacctacgtacacgtacgtacgtaccgtacgtacgtagttacggaacgttcgttacggtactttagtttaacgtacttagaaccgtaactacgttagtacgggttacacgggttaccgtaccggtacccggtaaccggtttaccggcccgtaacgggtacccacggtacggtacggtacgtacgttacgaccggttagtaacgttccggtcggtacccacggtccctaacggtacctttacctcgggttccctttaacccgg

SEQ ID NO: 91208 - DNA, 730 bp, Homo sapiens
  misc_feature: GYAE6OF01BDDYE.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagataccggttgggganatcgtgatgacgcagtctccagccatcctgtctgtgtctccggagggganacgacgcccaccctctcctgcgacgggccagtcaacgtaactagttggacactaacgttacgccgttaaggtaaacccaaaacaaaaaccgtcggacccacgccctacccgagtaccttccttacttaacttttactccgttacctaccgtacccgaaccggtaccgggtaccctaacgttacgtaccttaccgtaaccccaaaccgtacgttacttaccgagggtacggacggtaagggtacggggtccgtagggacgtaacggtacctacgtacgtacctaccaaccgtatacgagacgacgtccgtaactacgtacgtaacgaacggtacgttaggtaactttagtttacgttacgtacgtaacgtagtaagttcggtacgttacgtacggtacggtaccgttacgggtaacccggtcccggaaccggtacggacctaacggtaggtacgtacgttagtaccggacgggtactaccggtgggtaccgccggtactccggtactagttaccttcgttccttaccg

SEQ ID NO: 91209 - DNA, 635 bp, Homo sapiens
  misc_feature: GYAE6OF01A5VE9.5.57.F02.1.454.CMB.1.raw
  modified_base (235)..(235): a, c, t, g, unknown or other
  misc_feature (235)..(235): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagccaccctctcctgcaggccagtcagaacngttggagcaacttagccgtaggtaaccaaacaaaaccgtggaccagccctcccagaccttcctactatttatccgttacactaccaccgacggccacgtgactcgtacccaacgagacttcgagtcggacaggtacgggtcgtagggacagtactacgtacgtccgtacaccatacgtacgcacggaccgtactacgtctagaacgtcgttacgtcgtaagttttactacgtacgtacaacctagttgtacggtacgtacggtacggtaccgtacgggtacccggttccggacccgaacgggtacccgacgtaacggttaggaacttaggtacccggaggtaccgtaacggtcggttacggccctaagtcccgactacttccggttgttccgttaacccg

SEQ ID NO: 91210 - DNA, 788 bp, Homo sapiens
  misc_feature: GYAE6OF01ETXJ7.5.57.F02.1.454.CMB.1.raw
  modified_base (161)..(161): a, c, t, g, unknown or other
  misc_feature (161)..(161): n is a, c, g, or t
  modified_base (298)..(298): a, c, t, g, unknown or other
  misc_feature (298)..(298): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctggcctcccagtacgttaccggttggggganattcgtagatgaccgctacgtcctccagcctacttccctgtccttgtcgttccgtaccggaggggacgacggacctcccacccttcttccgacgccggaaccgggtcctaacggtcaacgtaactagttcgggaacncctaactaccgtaccgtaacggtaaccaaaacctaaacccgcggaccctaacgtcccgtaccgaccgtcctaccttactactttactttaccgttactacctacccgaccgtaccgggtaccacggtactaccgttagcccccctaaaacccgaggtactttccgaaggttacgggcctaaggggaacgggttcgtacgggggtaatacggtacctttcgaacggttctccaaccgtaatccgaacgtccaagggccgttaccaagggttccttggaaacgtaccttttagggaccctagggtttttaatttaccttagttacctaaaccgtaaattcggtagggttaccaaggttcgggcccttaccgggtaaacgtttccgggacccgtaggggtacccgacgtaacgtcgggaaatacggttacaagggtccgaacggtcgggttacggaccttacgggtaccaccgagttcccttgtcgtttaccg

SEQ ID NO: 91211 - DNA, 662 bp, Homo sapiens
  misc_feature: GYAE6OF01D8RIM.5.57.F02.1.454.CMB.1.raw
  modified_base (154)..(154): a, c, t, g, unknown or other
  misc_feature (154)..(154): n is a, c, g, or t
  modified_base (216)..(216): a, c, t, g, unknown or other
  misc_feature (216)..(216): n is a, c, g, or t
  modified_base (241)..(241): a, c, t, g, unknown or other
  misc_feature (241)..(241): n is a, c, g, or t
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
  modified_base (348)..(348): a, c, t, g, unknown or other
  misc_feature (348)..(348): n is a, c, g, or t
  modified_base (441)..(441): a, c, t, g, unknown or other
  misc_feature (441)..(441): n is a, c, g, or t
tcagatcagacacgcacgaccggtgctcgatttagctcgatatagttgggtttgggggagaactgctcagttaggacccagacggaaccatggaagccccagccgcagcttctcttcctcctgctactctggcctcccagataccgttgggganatcgtgatgacgcagtctccagccatcctgtctgtgtctccgaggggacagtacgccacctncctgcaggccagtcagactatggancaacttgctaggtaacctaacaaaacctggaccagcctaccagtaccttcctactattttanccgttacaactccaaccncgggaccacgtgactcgaccccaaacngtacttcgaggtacggcgacggaacgggtcgtagggaacacggtacttacgtaacggtccttacaccgtactacgagtacgacgtacgtaacnggtactaggtaaacgcgttgggacttaacgtttaacttacgtacgttaccaaagttagttacggtacgtacgtaggtacggtcccctaagttaacccggttcccggaacccgttagggaacccgtaacgtagtacgggttactaacggtcgtaacggaccgttaacgtccgggttagaccgttacccgaactaccgtaactttcggtcgttccttaacccg

SEQ ID NO: 91212 - DNA, 498 bp, Homo sapiens
  misc_feature: GYAE6OF01BF7R2.5.57.F02.1.454.CMB.1.raw
  modified_base (480)..(498): a, c, t, g, unknown or other
  misc_feature (480)..(498): n is a, c, g, or t
tcagatcagacacgcacgaccggtgctcgatttagctcgatatagttgggtttggggggaagaggaagactgacggtccccccaggagtccagagtgcgtcgcaagtattggcagtgtgaaatttgacaccttatatgcagactctgtgaggggccgcttcaccgtgtccagagacaactccaagaacgccgtctatttgcagatggacagcctgagagtcgacgacacgggcatctattattgtacggcggccgagcaatactctcttactttctggagtcgagggacgtcccggtcactgtctcctcacgcctccaccaacgggcccagtccggtccttccccctggcccacccctcctaccaacgacgccacctcgtcggggcacgacggccggcccgtggcctcgccgtggcaacggtacctccgttcccgtgtctgtactcgtggacgcgggcgtggacgaacggcgacagtcgnnnnnnnnnnnnnnnnnnn

SEQ ID NO: 91213 - DNA, 533 bp, Homo sapiens
  misc_feature: GYAE6OF01A8O4K.5.57.F02.1.454.CMB.1.raw
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (329)..(329): a, c, t, g, unknown or other
  misc_feature (329)..(329): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (510)..(533): a, c, t, g, unknown or other
  misc_feature (510)..(533): n is a, c, g, or t
tcagatcagacacgcacgaccggtgctcgatttagctcgatatagttgggtttggggggaagaggaagactgacggtccccccaggagtccagagtgcgtcgcaagtatggcagtgtgaaatttgacaccttatatgcagactctgtggagggccgcttcaccgtgtccagagacaactcaagaacgccgtctatttgcagatggacagcctgagagtcgacgacacgggcatctattatggtacggcggccgagactaatactctcttacttctggagtcgagggcgtcccgtctcgtgtctccncncnccctccaccgaacggcccnctccggtcccttccccgcggccctaccctccctaccgaacgacgccaccgtcggtcggggaccacgacgggcccggcccgtcggggcctcggtcccgtgggtaccgaacggtaccttacccgttcccgtgtcgtgtctcgtggacgggcggcgtcggacgaacggcacgtagtgncntgannnnnnnnnnnnnnnnnnnnnnnn

SEQ ID NO: 91214 - DNA, 738 bp, Homo sapiens
  misc_feature: GYAE6OF01CYQPG.5.57.F02.1.454.CMB.1.raw
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagacgtaccgttggggagatcgtgattgacgcagtctccagccatcctgtctgttcgtctccgagggganganccctacctctctgcgagggccaggtcagaactnttcgggtanctactagccgtacggtaaccaaacgaaaaccgtggaccacgtcctaccacgactcctactactttatccgttacactacccgtaccgacgggcctacgtcgtaacgtacgtaccccaaaccgacgtacgttacgacgtggacgaagggtcggggtacgtacgggtactaacggtacgttacacggttacctacctaccgtacttaccgacgtaccgacggtacgttaaccgtaacgttaccggtaaggtaaaccggttaacgtttacgggtaaccgtttaggttttaaacctttacgttaacgttaaccgaaacgttaactttgggtacccgttaaggtacggtccggttaccgttacggtaacccgggtttccggaccggtaacgggtacccgaacgtagtcgggtaaactgttcggaacgggtacgtaacggttcgtgggtacccgtacgtaccgaacccgtattttcgcggtttacccttacg

SEQ ID NO: 91215 - DNA, 743 bp, Homo sapiens
  misc_feature: GYAE6OF01CUNS9.5.57.F02.1.454.CMB.1.raw
  modified_base (200)..(200): a, c, t, g, unknown or other
  misc_feature (200)..(200): n is a, c, g, or t
  modified_base (614)..(614): a, c, t, g, unknown or other
  misc_feature (614)..(614): n is a, c, g, or t
  modified_base (707)..(707): a, c, t, g, unknown or other
  misc_feature (707)..(707): n is a, c, g, or t
tcagatcagacacgcacgaccggtgctcgatttagctcgatatagttgggttgggggaggaactgctcagttaggacccagacggaaccatggaagccccagcgcagcttctcttcctcctgcctactctggctccagactacggtgggagatcgtgatgacgcagtctcagccatcctgtctgtctcgtccgagggganagacgccctacctctctggccgaggccagtacgaagtactagttcggtaacaccgtaacgttacggtacccgttaacgggtaaaacccaaaacctaaaaccggtcggaccctaccggtaccccaccgtatacccttacctacttaactttactcccgttacctaactcccgaacccggtcggtacctaccgtagtacccttaccgaaccccaaccgttaggtaccttacgtaggtccggtaagtacggtacgggtacggtagggactaacggttcctaacgtacttacctacgaacttgaccgtacgacgtaccgtaacgttaacgacggtttacgaagggtttaacccggtgtttaaccggaagttttattttaccggtaattcgtaaaccgaaggttgtaacgtgttaacgnggttacgcccgttaccggtaacggtcccggaacgtaccggtacgagttagggtacgtactacggtaccggacggttactaacggtcgtacggngttaacccgactcccgttagtccttcgtcttacccg

SEQ ID NO: 91216 - DNA, 664 bp, Homo sapiens
  misc_feature: GYAE6OF01BHM5N.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (631)..(631): a, c, t, g, unknown or other
  misc_feature (631)..(631): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtcgtctcgagggganagcgcccaccctctcctgcgaggccagtcagaactgttggtacactaacttcgccgtacggtaaccaaaacctaaaaccgcggaccaccgccctacccgaacgtccttcctacttacttttactccgttactactacccgaccggacggccacgtgactcccgtaacccaacgtatacttcgacggtggacgtacggtagggttcgagggactacggtacttacgacggtctaccactctacgacgtacgacgtacgtaacgcgtacgtaacgtacgttaccggtgtacgtttaacgtttacttcgtacgacttaagagtttcggtacggttacgtggtacccggtacctacgggtaccggttaccccggacgacggtaacctacgggagttaggtacttacgacggaacggtagtacggtggtccgngtacctacggtacctcgttacgtccgttacgtc

SEQ ID NO: 91217 - DNA, 744 bp, Homo sapiens
  misc_feature: GYAE6OF01CZ1CZ.5.57.F02.1.454.CMB.1.raw
  modified_base (202)..(202): a, c, t, g, unknown or other
  misc_feature (202)..(202): n is a, c, g, or t
  modified_base (434)..(434): a, c, t, g, unknown or other
  misc_feature (434)..(434): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagactaccggttgggagatcgtgatgacgcagtctccagccatcctgtctgtgtctcgagggganagacgcccacctctcctgcgacgggccagtcaacgactagttggtaagactaacttagacctacggtaaaccaaacgaaaaccgtcggaccacgccctaccacgtacctacctactatttacgtctcactccacgacggctactcgactccgaccaacgtagtacttcgaagtcggacgtagggtacggtcgtacgggaactacggtaccttcacgttacctaccaacctanaccgagtacgtacggtactaacgtagtaccgtaagtaacggttacgttacgggtaactttaacgggttttaacttaacccgttaacggtaacttaaaccgttaggttttacggggttacgttacggttaacgggttccgggttaaccccggtttaaacggggtacccgggttacccgggacccgtaaaccggggtactaacccggaaagggttcggaaactttacgaccgggaacgggttaccggtaaggtcgggtacggtaccgttacgaccccgtaacgttacgtttcttcgggtttcccttaacccg

SEQ ID NO: 91218 - DNA, 670 bp, Homo sapiens
  misc_feature: GYAE6OF01ADRUO.5.57.F02.1.454.CMB.1.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccaccctctcctgcagggccagtcagacattggancaactgcctggtaccaaacaaaacctggccacgcctcccagacctcctctatttatcgttacactcccaccgacgggcccacttgactccgtacccaaaccagtacttcgaggtggacaggacgggtctaggggacacggtacttcgacgtcctaccaccctatcgacgtcaggaccgtacgtacgtctaggaacgtacgttggaacttagtttaactttcgtacgttaccaattaacgtggttacggtacgtaggttccggtacccggtaccggttaaccgggttccccgggacccgtaacggggaccctaacggtagggttaggtaaccttagtacccggtaacggggtaccgttaaacggtcgggttacgggaccttacgggaccctaccgttaacggttcctttccggtttcctttaaccccg

SEQ ID NO: 91219 - DNA, 802 bp, Homo sapiens
  misc_feature: GYAE6OF01AJ52R.5.57.F02.1.454.CMB.1.raw
  modified_base (154)..(154): a, c, t, g, unknown or other
  misc_feature (154)..(154): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagtataccgttgggganatcgtgatgacgcagtctcagccatcctgtctgtgtctccgagggganagacgcccaccctctccgtgccgacgggtcccagtccaagaactagttcggtaacactaaacgtttacggcccgttacggtaacccaaaacgtaaaaacccgtggtacccaaccgtacccttaccccgaaggtacccttacccgtacttaacttttacgtaccggtttaccaacgttaccccaaccggtaccggggtaccctacggtagtactaccggtacccctaaacgtacgtacgttaccgaggttacggacgtaaacggtaggggtacccgtaggggaaccgtaacgtacgtttacgaacgtccgttaacccacctaagtacctaacggacccgaacggtcctaacgtacggtaccgttaagggaaaccgttcgttagggtaccttaaggttttaacttaacgtcgtaaaccaaacgttaacgttcggtacgtacgtacgttaccggacccgttaacgggtaacccggtttccggaacccggtaccggtaaccgtacgtaacggtacgggtaactaccgtacgggtaacggacccggttagttccgggtacggtacacggtaccctaacggttagtccgtttcggtcttaaacccg

SEQ ID NO: 91220 - DNA, 763 bp, Homo sapiens
  misc_feature: GYAE6OF01CN5V9.5.57.F02.1.454.CMB.1.raw
  modified_base (152)..(152): a, c, t, g, unknown or other
  misc_feature (152)..(152): n is a, c, g, or t
  modified_base (181)..(181): a, c, t, g, unknown or other
  misc_feature (181)..(181): n is a, c, g, or t
  modified_base (191)..(191): a, c, t, g, unknown or other
  misc_feature (191)..(191): n is a, c, g, or t
  modified_base (201)..(201): a, c, t, g, unknown or other
  misc_feature (201)..(201): n is a, c, g, or t
  modified_base (519)..(519): a, c, t, g, unknown or other
  misc_feature (519)..(519): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgtgggganatcgtgatgacgcagtctccagccatccngtctgtgtcncgaagggganacgacgccacctctctggcgacgggccaggtccaagtaactagttagggaactactaaaacgttacggacccgttaacgggtaaaacccaaaaacgtaaaaaaacccggtcgggaacccaaccgtacccctaccccaaggtaccccttacccttaactttaacgttttaccgtaccgtttaccaaccgttacccccgaaccggtaacgggtaccctaacgtcggtaactaccggtaaccccaaacgtagtaacttacgaagtggaccgagggtaacgggtcgtagggaactagtaccgtgaacgtcctacgaacgtanaccgagactaacggtacgtaaactgtacgtagaacgttacgttaggactttaagttaacgttataacgtaacctaaagtaagttcgtacgggtactaacggtccggtaaccgttaacggtaacgggttcccggacgaaacgggttaaccacggtaaagttacggacgttaataccggaaacggtaccggaacgttttggacgtacggtactacggtaactaccgtcggttactccggtttaacc

SEQ ID NO: 91221 - DNA, 782 bp, Homo sapiens
  misc_feature: GYAE6OF01BA7NS.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtcctccagccatcctgtctgtgtctccgaggggagagacgcccaccctctcctgccgacgggccagtacagaactagttaggtacgactaacgttacgaccgtacggtaacccaaaactaaaaacccgtcggacccacgccctacccgacgtacctaccctacttactttaacttccgtttaccacctacccacccgacgggaccctactacgactaccgtaccccaaccgtacgtacttcgacggtacggacgtagggtacgggtcgtacgggacctaacgtaccgttacgtactacctaccaacctacgtacgaacgaccgtacggtacccggtacgtacgttcgtaaacggtaacgttacggttaggtaacgtttaacgttttagttaaccgtaccgttacaaacgttagtttacggtacggttacgtaacggggtccgtaacccggttccgggttaacccgggttccccggaaccccgggtaaacgggacccgtaaacggtcgggtaacggtacgtaaaccggtaccggaccgggtaacgtaaccgttcggggtaccggtacgtaccgtaaccgtacctaggtttacccgttacggttcccttaacccg

SEQ ID NO: 91222 - DNA, 715 bp, Homo sapiens
  misc_feature: GYAE6OF01BM1HG.5.57.F02.1.454.CMB.1.raw
  modified_base (157)..(157): a, c, t, g, unknown or other
  misc_feature (157)..(157): n is a, c, g, or t
tcagatcagacacgcacgaccggtgctcgatttagctcgatatagttgggtttgggggaggaactgctcagttaggacccagacggaaccatggaacgccccagcgcagcttctcttccctcctgctactctggctcccagactaccggttgggganatcgtgatgacgcagtctccagccatcctgtctgtcgtctcgaggggagagacgcccaccctctccgtagccgacgggcctaagtcaaggactaggttggacgacctaacgttacgcctaacggtaaacccaaaacgaaaaacccgtcggacccaaccgtccctacccgacgtacccttcctacttactttacgtccttacacctacccgaccggtacggacccagttcgaccgtaccgtaccccgaacgtacgtacttacgaggtcgtacgaggggtacgggtcggtaaggcctaagtaccgttcgtacgtacctaccgaacctataccgacgtaacgacggtaccggttaactaacgtacgttaacggtaaacgtcggttacgttaaccgttagtttaaccttagtacgtaactaacgtaggtgtacggtacgcggttaccggtaccgtaccgtaaccggtccggaccgaacgggtaccaggtacggtagaccttaggcgaacggtcgtacgtggtagtaccgtcaccgtacctacgttcgttccgtgttaccccg

SEQ ID NO: 91223 - DNA, 806 bp, Homo sapiens
  misc_feature: GYAE6OF01DKVHS.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (249)..(249): a, c, t, g, unknown or other
  misc_feature (249)..(249): n is a, c, g, or t
tcagatcagacacgcacgaccggtgctcgatttagctcgatatagttgggtttgggggaggaactgctcagttaggacccagacggaaccatggaagcccagcgcagcttctcttcctcctgctactctggctcccagactaccggttggggagatcgtgatgacgcagtctccagccatctgtctgtgtctccgaggggnagacgccctaccctctccgtgcgacgggccagtcagaacngttggacnctaacttgccgtaggtaaccaaacaaaaccgtggaccacgtccctccagtacctcctactattttacgtccgttacacgtacccaccgacgggcctacgtcgactttccggaaccccaaccgtagtacgttccgaaggtcggacgagggttacgggtcgtacgggaactaaggtaccttacgacgttcctacgaacctacgtacacggtacaacggtaccgtaacgtacggttacccgtaaggaaccggttaacggtttaggacccgttttaacgttttaacgttaccgtttaacgttaacctaaaaccgtttaagggtttacggttaccgggtttaccgtaacggggtttacccgggtacccggtttaaaccggggtaacccggggttttaccccgggaaccccgggttaaccgggggaacccttaaccggggtaaggttaccgggtaaactttaacggacccggtaacgggtacccgggtaaaggttcggggtaacggttccgtaaccgggtaccccttaaacgcggttttaccttccggttacctttaacccgg

SEQ ID NO: 91224 - DNA, 721 bp, Homo sapiens
  misc_feature: GYAE6OF01D7TDC.5.57.F02.1.454.CMB.1.raw
  modified_base (191)..(191): a, c, t, g, unknown or other
  misc_feature (191)..(191): n is a, c, g, or t
  modified_base (475)..(475): a, c, t, g, unknown or other
  misc_feature (475)..(475): n is a, c, g, or t
  modified_base (690)..(690): a, c, t, g, unknown or other
  misc_feature (690)..(690): n is a, c, g, or t
  modified_base (713)..(713): a, c, t, g, unknown or other
  misc_feature (713)..(713): n is a, c, g, or t
tcagatcagacacgcacgaccggtgctcgatttagctcgatataggttggggtttgggggaggaactgctcagttaggacccagacggaaccatggaacgccccagcgcagcttctcttcctcctgctactctcggcctcccagtacgttaccgggttggggatagtcggtgactcggacgcgacgttccnccacgcctacttcccgtgttcctggtacgtccgtcgggaaggggacgacgtaccgcccctacccttcgtccgtcggaccgacgggcctagacgaagtaacgtgttaggtacgaccttaacgttaccgtaccgtaacggtaaacccaaaaaccgtaaacccggtcggaaccctaaccgtccctaccgtaacgtacccttaccttacctttaacgtttcgttaccgtacctaccgtacccgaccgtacggcctacgtcgacgtcccaacccgatagtactcggcgnggacgcgggacggtgacgactacgtacttcgacgtcacacgctacgcgtacgacgtacgtactcgtacgtaagtcgttacgttacggacttttagttactcgttacgactaacgtgttaggtcgtcgtacggcgttacgccgtaacggtcccgaacgggaccgtacgcgtacggacgtacgttacgacggtcggtactacggtcgtacgtcccgngtacccgacgttacctcgttccncgtttccg

SEQ ID NO: 91225 - DNA, 765 bp, Homo sapiens
  misc_feature: GYAE6OF01D6YPI.5.57.F02.1.454.CMB.1.raw
  modified_base (71)..(71): a, c, t, g, unknown or other
  misc_feature (71)..(71): n is a, c, g, or t
tcagatcagacacgcacgaccggtgctcgatttagctcgatataggttggggtttgggggaggaactgctnagttaggacccagacggaaccatggaagccccagcgcagcttctcttcctcctgctactctggcctcccagacttaccgggttggggatatcggtagatcggacgctagtcctcagcctattcctgtcgtgtagtccgtacggaggggacgagaccgccctacctctccgtcggaccgaggggtacccagtacaagtaatcgttaggaacactaacgttagtccgtaacggtaaaccaaaacctaaaaccgtcggaccacgtaccctaccgataccttacctacttactttacgtacgtacctactacccgaacggacggacctagtacgtactacctaccgaactagtatacgtaggtacgacgtagggtacggtcgtacggtaacgagtacttacgacgtactacgaacgtactaccgagtccgagtaccgttaagtcgtacgtaagtaacgtacgtttagtacgtttaagtttactaaccgttcgtaaaccgtaatacgggttagttaccggtaggtaccgggtaaccgttaccggttaaccgggttaccggtaccgggaacccgtaacgggtaaccgtacgggttaacgtacggtaaacgtaaccggtagggttaacggaccggtaaacgggttgacccgggttactaccggtactaacccggtatttacccgggtccttcgttaacccg

SEQ ID NO: 91226 - DNA, 845 bp, Homo sapiens
  misc_feature: GYAE6OF01CWMI1.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccactcgtgtctgtgtcgtccgaggggagagacgcccacctctcctgcgagggccagtcgacgaactagttcggtagacctaacgttacgaccgttacggtaaacccaaaaccgaaaaaccgttcggaccctaaccgccctacccaacgtaacccttccttacgttaacttttacgtccgttaccaaccgttaccccgaaccggacgggtacccaacgttacgaaccgtttacccggtaacccccaaacgtaacgttaccgttacggacggttcggtaacgtaggggttacggggttaccggtaacgggtaccgtaacggtaccgtttacgaccggtttaccaccgtaaacctacgtaccgtacggacccgtaaggtaccgttaaccgtacgttaccgttaagggtaaccgttaaccggtttaacgggtaccttttaacgtttaacgttaaccgttaacgttaaccccgtaaagttacgggttaacggtttacgggttactaaggggttccgtaacccgttaccgggtaaccggttcccgggaaccccgggtaaggtaccccgtaacgtacggggttcgaaacttacggaccggaacgggtaccttaacggtggttaaccgggtcgttacgcccgttaacgtagtttcccggttagttcccgttaaccg

SEQ ID NO: 91227 - DNA, 1077 bp, Homo sapiens
  misc_feature: GYAE6OF01EI9E7.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagataccggttggggagatcgtgatgacgcagtctcagccatcctgtctgtcgtctccgagggganagacgcccacctcgtccgtgccgtacgggacctagtaccgaacgaacgtagtttacggtagtacctaaacgttacggtaccgttaacggtaaaccccaaaaaccggtaaaaacccgtcggggtaacccctaacggtaccccttaacccgaacggtaccctttcctaactttaacgttttacttaccggttacctaaccgttaccccgaacccggacgggtccctaacgtagtaaccgttacccgttaaccccgaaaccgtaacgggtaactttacccggtaagggttaccggaccggtaaacggggtaacggggtacccgggttaacggggaaaccgtaacgggttaacccgttaaccggttacgggttacccccttaaccgtaaacccgttaaccgttaccggtaaaccggtaccgtaaacccgggtacccggttaaacgttaacgggtttaacccgtttaaacggggtaaaaccgttacccggttttaacgggggtaacccgttttaaaacgtttttttaacccggtttaaccggtttaaccggtaaacccttaaacgggttaaacggtttcgggggttaacccgggtttaacccggtaacgggttttacccggggtaacccgtttaaacccgggggtttaaaccccggggttttaccccgggaaccccccggtaaaccgggggttaccccgtaaaccggggtttacggttaaacccgggggttaagtttaaacccgggtaaccggtaacccgggggtaaccccgggttaacgttaccggggtttaaccgggggtcctttaaaccccgggtaaccgttacccccgtttaaagtttccccgggtttaacccggtttaccccgtttaaacccggg

SEQ ID NO: 91228 - DNA, 784 bp, Homo sapiens
  misc_feature: GYAE6OF01CLAQH.5.57.F02.1.454.CMB.1.raw
  modified_base (152)..(152): a, c, t, g, unknown or other
  misc_feature (152)..(152): n is a, c, g, or t
  modified_base (199)..(199): a, c, t, g, unknown or other
  misc_feature (199)..(199): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggganatcgtgatgacgcagtctccagccatcctgtctgtgtctcgaggggngacgagccacctctccgtgccgacgggccagtaccagaactagttggaagcctaaacgttcgccgttacggtaaacccaaaaccgaaaaaacccgttggacccctaacggtccctacccaacgtacccttacccttacgtaactttttacgtccgtttaccaccttacccgaacccgacgggtcccaacttcgtaacgttccgtaaccccaaaccgagtacttcgaacggttcggaacgagggtacgggtccgttaggggaactaacggtacttacgacgttctaccgaaccctagtaccgaacgtccgaaacgtccgtaaccgtacgttaaccggtagtaaacggttacgtttacgggactttaaggttttaacctttacgttacgtaacgtaaacctaggtttggtaccgggttatacggggtccgtccggttaaccgtacgggtttacccgggacccgtaacgggtaccctaacgtcggtaacggtacttaggtaccggacgggtaacgtaaaccggtttggggtacccgtaccgttacggtaaccccttaacgttatttcccgttcgtttccgttaacccg

SEQ ID NO: 91229 - DNA, 706 bp, Homo sapiens
  misc_feature: GYAE6OF01DU17R.5.57.F02.1.454.CMB.1.raw
  modified_base (156)..(156): a, c, t, g, unknown or other
  misc_feature (156)..(156): n is a, c, g, or t
  modified_base (206)..(206): a, c, t, g, unknown or other
  misc_feature (206)..(206): n is a, c, g, or t
  modified_base (686)..(686): a, c, t, g, unknown or other
  misc_feature (686)..(686): n is a, c, g, or t
tcagatcagacacgcacgaccggtgctcgatttagctcgatatagttgggtttgggggaggaactgctcagttaggacccagacggaaccatgggaacgccccagcgcagcttctcttcctcctgctactctggctcccagataccggttgggganatcgtgatgacgcagtctcagccactcctgtctgtcgtcctcgagggganacgacgcccaccctctcctgaccgacgggtccagtacaacgtaactaaggttcggtaacgacctaaaccgttacgtcccttaacggtaaacccaaaaccgtaaaaaccgtcggacccaacgacccgttacccaacgtaccttaccgtctttaatttacctaccgtttacaacgttaccccacggaaccgggtcccacgttacgtacttaccggtaacccaaaccgtagtacttacgtaggtggacgtaagggtacgggtaccgcgggaaactaccgtacctttacggtacgttccctaaccaaccgttacgtccacggaacgtaacgcggttaaactcggttaacctaggtaacgtacggttacggtactttaacgtttagtaccttaagacctaactaggtcgtagtcgacggtcgtaccgtacggtccggtaccgaccgtaccggacagtacgtgactagcgagacgtcgtgtaccgncgtcactgttctgttcgacc

SEQ ID NO: 91230 - DNA, 806 bp, Homo sapiens
  misc_feature: GYAE6OF01C9LB5.5.57.F02.1.454.CMB.1.raw
  modified_base (212)..(212): a, c, t, g, unknown or other
  misc_feature (212)..(212): n is a, c, g, or t
  modified_base (745)..(745): a, c, t, g, unknown or other
  misc_feature (745)..(745): n is a, c, g, or t
  modified_base (792)..(792): a, c, t, g, unknown or other
  misc_feature (792)..(792): n is a, c, g, or t
tcagatcagacacgcacgaccggtgctcgatttagctcgatatagttggggtttgggggaggaactgctcagttaggacccagacggaccatggaacgccccagcgcagcttctcttcctctgctactctggctcccagacttaccggttggggagagtcgtgatgacgcagtcctcacgtcctactcctgtctgtcgtctccggagggganaacggccgccctaccctctccgtcggaccgacgggcccagtacgaacgtaactagttggtacactaaccggttacgaccgttaaccggtaaacccaaaccgtaaaaaccgtccggaccgtacccgaccctacccgaagtaccccttacctacgtttaactttacgtccgttacctaccgtacccaaccggacggtaccctacgtacgtaaccgttacccgtaaccccaacgtaacgttacttacgacgggtacggtaacgtacggggtaacgggtccgtaacggggtactaacggttacccgtttacggtaccgttacccgtaacccgtaaccttaaccgaccggaacccgtacgtaacccgtaccggttaaacctggttaacccgaaggttaacggttaaaccggttgggttaactttaacgggttttacttaacgttacgtaaacctaagttaacgggtggttaaccgtagtacgggtaccggttacccgtaccgttaccggccggtaaccggagaccgaagttccggtanccgttaaacgcgggacgtagtaacgtcggtacgcgtactctaacgtntcggtcttccgtac

SEQ ID NO: 91231 - DNA, 710 bp, Homo sapiens
  misc_feature: GYAE6OF01BCJYC.5.57.F02.1.454.CMB.1.raw
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgcccaccctctcctgcgagggccagtcagaacattggagcaacttgcctaggtaacccaaacaaaaccgtcggccacgcctcccagacctcctcgtactttaacgtccgttcctactacccgaccgacggggccctaacgtcggaatccgtaaccccaaaccgtaagtaacttccgaggtacggacgtaagggtacgggtccgtacggggaacacgtacttcgacggttactaccgtaaccagtaccgacggctaacggtacccgtaacgaagttccgtaacggaaacgttcctttagggaccttaagttttaccgttactacggttacccaaagttaaccgttgggttacggttacgacggttcgggaccccttacgggtaaccggttcccggacccgtaacggggaacccacggtaaggtacggtaataccgacggtacgggaccgtaacgtgggttacggccgtacggccctaacgtacgtccgttaacgtccttacccg

SEQ ID NO: 91232 - DNA, 639 bp, Homo sapiens
  misc_feature: GYAE6OF01BZPW8.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtcctccgagggganagacgcccaccctctcctggcacgggcccagtaccaagaactgttaggaacgctaaccgttagcctaggtaaccctaaacgaaaaaccctggaccacgccctacccgagtacctcctctaatttactccgttacactacccgacgtacgggaccacgtgacttccgtaccccaacgatactacgaggtcgacgaggtacggtcgaggacacgtactacgtacgtcaccactactacacgacgacgcgtacgtacgtactagtaacgtcttaggacttaagtttactactagtacctaatagtagtgtactcggtacggtaccgtaccgtacgttaccggacccgaggaccaggtacgtaggtagtacgtacggacggtacgtaacgtcggtacggtaccaccgtactacccgttagtcgttccgttccgttaccg

SEQ ID NO: 91233 - DNA, 676 bp, Homo sapiens
  misc_feature: GYAE6OF01EYP3Y.5.57.F02.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggganagacgcccaccctctcctgcagggccagtcagaacattggancaattcgccgtagtaccaaacaaaaccgtggccagccctccagacctcctactatttactccgttcactcccaacgacgggccacgtgtactcgtaccccaaacgtagtacttcgaggtcggacgacgggtagggtaccgtagggaacgagtaccttcgaacgttcctacctacgtacttacgaacgtctaacggcgttaaccgagttcgtaggtaaacggtacgttggaacttaagttttaacgttacgtacgttaacgaactaaggttcggttacggacgtacggttaccgggtcccgttacgggtaaccggttccgggaaccccgtacgggaccctaagagggtaccgtaacgtacgtacgggtaacgtccggtaacgttcgggtacgacgtacgaccccgtataccgtttccgtagttcccgttaacg

SEQ ID NO: 91234 - DNA, 895 bp, Homo sapiens
  misc_feature: GYAE6OF01EVDLV.5.57.F02.1.454.CMB.1.raw
  modified_base (152)..(152): a, c, t, g, unknown or other
  misc_feature (152)..(152): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggagaactgctcagttaggacccagacggaaccatggaagccccagcgcagcttctcttcctcctgctactctggctccagataccggttgggganatcgtgatgacgcagtctccagccatcctgtctgtcgtctccgagggganagcgcccaccctctccgtgcgacgggccagtacagtaactagttcggtacgactaacgttcgcccgtaggtaacccaaactaaaaacccgtggacccacggaccccttacccgaacgtacccttccgtaccttaaccttttacgtaccgttcctaacgtcccccgtaaccgacggggtaccccaacggttacgaccgttccggtaaccccctaaccgtacgtaccgtttaccgagggttaccggaccgaacggggtacgggggtccgtacggggtaacccgtaccggtacccgtttaccggaccgttacccgtacccgtaaacccacgttaccgaaccgtaccgtacgggttacccggtaacgtaaccgtttacgggaaaccggttaaccgggtaacggtttcggttaacccggtttaaccggtttttaacggttttaacccgacggggttttaaaccctaaaccgtttaacgggtttaccggtacgggtttaaccttaccggggtaacccgggtttcccgtaaaccggggttaacccccggttcccgggtaacccccggggaacgggtaaacccgggtcgtaacgggttaccgtaaccggtaccgttaacgggtaccggtacccgggaacgtttcgggtacgtacccggtatcccggaaaccctacggtttcctaaccggttcgtaacccgg

SEQ ID NO: 91235 - DNA, 699 bp, Homo sapiens
  misc_feature: GYAE6OF01DKXGD.5.57.F02.1.454.CMB.1.raw
  modified_base (209)..(209): a, c, t, g, unknown or other
  misc_feature (209)..(209): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggatatcgtgatgacgcagtcctccgagcctatcctgtctgtcgtccgtacggagggganacggaccgccccacccgttctacccgtggaccgacgggacctagtacaagtaactagtttggaacgaccttaacgttacggccgttaacggtaaaccaaaaccgttaaaccgcggacccgacgtccctaccgaaccttacctccttacttaatttccgtccgttacaccgttaccccacggacggtaccacgtactactacccgtacccaacggatcgttaccgagttcggacaggggttcggtcgagggtaacacgttacgtacgtaccgtacaaccctagtactacggaccgtcgtaacgtacgacgtacgtacggtaggtacgtacgtagttacgttaagtttatacgtagtactaacgtagtgtacgtagcggtacgtacgtacggtacccggtacgaccggtagacccgtagtacgtagacgtcgtacggacgttaccgaggttcgacgcgtacgtccgtaacgtattccttacgtccgttaccg

SEQ ID NO: 91236 - DNA, 758 bp, Homo sapiens
  misc_feature: GYAE6OF01D3Z7R.5.57.F02.1.454.CMB.1.raw
  modified_base (203)..(203): a, c, t, g, unknown or other
  misc_feature (203)..(203): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtcgtctccgagggganagacgcccaccctctcctgcgagggccagtccaagaacngttagggaacgactaaacgttacgcccttacggtaaacccaaaacaaaaacccgtcggacccaacgccctcccgaagtaccttacctactatttactccgttaccactccaccgacggcctactgaactcgtaccccaactagtacttcgaggtcggacgaaggtacggggtcgtacggggaactacggtaccttcgacggttacctacccgaacctactaccgacgtccgaacggtcccgtaacgtcggttaaccgtaggtaaacgttaccgttagggtacctttaaggttttactaacgttcgtaaactaacgtagtttggtacgggtacgtacggttaccggtaccgttaccgggtaccggttccgggaaccccgtaacggggaccctaacggtaggttaaggtaccgtaacgtacccgggtaaagggtcccgtaaacggttcgggtaccgggtccgttaaccggaccctaacccgttacgttttacccgggttcgtttcccgtttaaccccg

SEQ ID NO: 91237 - DNA, 717 bp, Homo sapiens
  misc_feature: GYAE6OF01DKF4V.5.57.F02.1.454.CMB.1.raw
  modified_base (152)..(152): a, c, t, g, unknown or other
  misc_feature (152)..(152): n is a, c, g, or t
  modified_base (200)..(200): a, c, t, g, unknown or other
  misc_feature (200)..(200): n is a, c, g, or t
  modified_base (581)..(581): a, c, t, g, unknown or other
  misc_feature (581)..(581): n is a, c, g, or t
tcagatcagacacgcacgaccggtgctcgatttagctcgatatagttgggtttgggggagaactgctcagttaggacccagacggaaccatggaagccccagcgcagcttctcttcctcctgctactctggctcccagataccggttggganatcgtgatgacgcagtctccagccatcctgtctgtgtctcgagggganagacgccctacctctccgtgcgacgggccagtcaagaactagttggaacgacctaacgttacgcccgttacggtaaaacccaaaacctaaaaacccgtcggaccctaacgtccctacccaagtacccttccctacttaagttttactccgtttaccacgttaccccgaccggtaccgggtccctaacgttggaacctttcccggaaccccaaacgtacggtattccgaaggtcggaacgtaacggggtaggttccggacggggaactaacggtttaccgttacgacgttcctaacccgaacgtacttacgacgtacgtaacgtcctaagcggtacgtaagaacgtacttgtactttagtttacttacgtacgaactaacgngttacggtacgtcgtaacgggtcgtacccgtaccggtaacggtccgacccggtaaggacctaggtacggtctacgtaacgtcggaacggtacaggttcggcgtccgtacgactaaccttgtcttccgtccttaacg

SEQ ID NO: 91238 - DNA, 734 bp, Homo sapiens
  misc_feature: GYAE6OF01BRO5M.5.57.F02.1.454.CMB.1.raw
  modified_base (153)..(153): a, c, t, g, unknown or other
  misc_feature (153)..(153): n is a, c, g, or t
  modified_base (204)..(204): a, c, t, g, unknown or other
  misc_feature (204)..(204): n is a, c, g, or t
  modified_base (225)..(225): a, c, t, g, unknown or other
  misc_feature (225)..(225): n is a, c, g, or t
  modified_base (258)..(258): a, c, t, g, unknown or other
  misc_feature (258)..(258): n is a, c, g, or t
  modified_base (410)..(410): a, c, t, g, unknown or other
  misc_feature (410)..(410): n is a, c, g, or t
  modified_base (719)..(719): a, c, t, g, unknown or other
  misc_feature (719)..(719): n is a, c, g, or t
tcagatcagacacgcacgaccggtgctcgatttagctcgatataggttgggtttgggggaggaactgctcagttaggacccagacggaaccatggaagccccagcgcagcttctcttcctcctgctactctggctccagactccggttggganatcgtgatgacgcagtcctccagccatcctgtctgtcgtctcggagggganacgacgccctaccgtctccgngacgacggcctaggacaacgtactagttcgganactacgttacgccgtaacggtaacccaaaacgtaaaccgtcggacctaccgtccctaccgacgtaccttcctacgttaactttacgttccgttaccaccgtacccgaacggaccggtacctaacgtgtaacctaccgtaccccaagtacgtnttaccgagggtcgacgaggtcggtagacggactacgtctcgtacgtctaccactactacgacgtacgtacggtaaccgtacgtacgttaccggtaacgtaaaccggttaggttaaccggttaccgtttaagttttaacgttaacttaacggttaactaacggttagtttacggtaccggttacgtcggttaccggtaccgtaaccggggtaccgtaccggtaccggaaccgggtacgacggtagggtacgttaactacggtacgggtcgacggtacggttcggacgtacgacgtaaccgtctaccgttnttccgtcttacccgg

SEQ ID NO: 91239 - DNA, 664 bp, Homo sapiens
  misc_feature: GYAE6OF01CPRDP.5.57.F02.1.454.CMB.1.raw
  modified_base (97)..(97): a, c, t, g, unknown or other
  misc_feature (97)..(97): n is a, c, g, or t
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
  modified_base (220)..(220): a, c, t, g, unknown or other
  misc_feature (220)..(220): n is a, c, g, or t
  modified_base (223)..(223): a, c, t, g, unknown or other
  misc_feature (223)..(223): n is a, c, g, or t
  modified_base (251)..(251): a, c, t, g, unknown or other
  misc_feature (251)..(251): n is a, c, g, or t
  modified_base (507)..(507): a, c, t, g, unknown or other
  misc_feature (507)..(507): n is a, c, g, or t
tcagatcagacacgcacgaccggtgctcgatttagctcgatatagttgggtttgggggaggaactgctcagttaggacccagacggaaccatggaanccccagcgcagcttctcttcctcctgctactatggctcccagataccggttgggganatcgtgatgacgcagtctccagccatcctgtctgtcgtcctcgagggganaggacgcccaccctcnccnggcacgggccagtcaagactagttgganctaacgttacgcctacggaaccaaacgaaaaccgtcggaccacgccctaccagacctcctactactttactccgttacactacccaccgacggtccactgactccgtacccaacgagtctacgaggtcggacagggtacggtcgacggacacgtactcgtacgtcctaccaccatcacgacacggtcctaacgtagtacctagaaccgtagttagctttaagtttactacgtcgtaactaactaggtgtaccggtntaacgggtcgtaccgtaccggtcggttccgaccgtacgggactacgggtagtacggtactaccgttacgggacgggtaccttaaacgggttcgggtaaccggtacctaccggtacccgtaacccgttcgtttccggtactttcccgttaaaccccgg

SEQ ID NO: 91240 - DNA, 711 bp, Homo sapiens
  misc_feature: GYAE6OF01B1WRU.5.57.F02.1.454.CMB.1.raw
  modified_base (156)..(156): a, c, t, g, unknown or other
  misc_feature (156)..(156): n is a, c, g, or t
  modified_base (161)..(161): a, c, t, g, unknown or other
  misc_feature (161)..(161): n is a, c, g, or t
  modified_base (209)..(209): a, c, t, g, unknown or other
  misc_feature (209)..(209): n is a, c, g, or t
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
  modified_base (258)..(258): a, c, t, g, unknown or other
  misc_feature (258)..(258): n is a, c, g, or t
tcagatcagacacgcacgaccggtgctcgatttagctcgatatagttgggtttgggggaggaactgctcagttaggacccagacggaaccatggaagccccagccgcagccttctcttcctcctgctactctcggctcccagactaccgttggganatcgngatcgacgcagtctccagccatccgtgtctgtcgtcctccgagggganacgacgcccaccttcnccgngccgagggccagtcaagaactgttggacnctaaacgttcgcgtacgtaaccaaaccgtaaaccgtcgaccacgacctaccgacgtacctcctactactttacgtcgttactactaccgaccgtacggacctacgtcgtactccgtacccaacgtacgtacgttcgaggtcgacgacggtacggtcgtaggactacgtacgttacgacgttctaccaccgtactacgacgcgtacggtaccgtacgtacgtacgtaggtaacgtacggttacggtacgtttacgttttaacgttacgtacgttaactaacgttagtggtacgtgtacggtccgtaccggtacgggtaccggttcccggacccggtaacgggtaccgaaccggttaggtcggttaacgtacggtacggtaccgggtaaccgttacggttccggtacggtccgtaaccgtacctaacgttaccgttaccgtttcgttccttaccg

SEQ ID NO: 91241 - DNA, 712 bp, Homo sapiens
  misc_feature: GYAE6OF01EZ902.5.57.F02.1.454.CMB.1.raw
  modified_base (227)..(227): a, c, t, g, unknown or other
  misc_feature (227)..(227): n is a, c, g, or t
  modified_base (604)..(604): a, c, t, g, unknown or other
  misc_feature (604)..(604): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgcctactcgtggcctcccgagtacgttaccggttggggatagtcgtgatgacgcgtacgttctccagccctattccgtgtcttgtcgtccgtaccggagggganacgaccgcccctaccctcgtccgtggaccgaggacccagtaccgaaggtaactagttggacgtactaacgttcgtaccgtaaccggtaaacccaaaacgaaaaccgtcggacccacgtccctaccgacaccttcctacgttactttacgtccgttacctacctacccgaccggtaccggcctacgtcgtaccgtaccgtacccaaacgtagtacgttcgaggttacgcgtaagggtcggttacggacggacgtaacgtctacgtactccgaccacgtacgtacgcgacgtaccgtacgtacgtacgttagacgttaacgtacgttcgttactttacgtttaacctacgtccgtaactacgtagttcggtgttaccgngtttcccgtccgtacggttacccgccgaccggtaccgaacgtggtacggtatccgtaacgtcgcggtactaggtcgtcgacctcgactagtacctcggtgtccgtccg

SEQ ID NO: 91242 - DNA, 688 bp, Homo sapiens
  misc_feature: GYAE6OF01BYFJA.5.57.F02.1.454.CMB.1.raw
  modified_base (156)..(156): a, c, t, g, unknown or other
  misc_feature (156)..(156): n is a, c, g, or t
  modified_base (208)..(208): a, c, t, g, unknown or other
  misc_feature (208)..(208): n is a, c, g, or t
  modified_base (229)..(229): a, c, t, g, unknown or other
  misc_feature (229)..(229): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctcggctcccagataccggttgggganatcgtgatgacgcagtcctccagccatcctgtctgtcgtcgtcggagggganacgaccgccctacctctccgngcgtacgggccagtaccagtaactgttggagacctaaacggttcgccgttaacggtaaccaaaaccgaaaaccgtcggacctacggaccctaccgacgtaccttcctacttaatttaccgtcttacctactacccacggtaccggcctacgtacgaccgttacccgaaccctaacgtagtaccttacgacggtacgaccggtaagggtacggtacggtacgggaactacgtacttacgacgttctaccgaactagtacgacgacgacgtacgacgtacgtacgagtaaacgtcgttacgactttagttacttagactaactaacgtagtcggtacgtacgcgttccggaccgttacggtacccggtacgtaccgaaggaccctgtacgtaggacttacggacggagtaccgtaacgtgggacccgtcaacgtccacgttaagttccgtcttcgtacccg

SEQ ID NO: 91243 - DNA, 599 bp, Homo sapiens
  misc_feature: GYAE6OF01D2BRD.5.57.F02.1.454.CMB.1.raw
  modified_base (418)..(418): a, c, t, g, unknown or other
  misc_feature (418)..(418): n is a, c, g, or t
  modified_base (579)..(579): a, c, t, g, unknown or other
  misc_feature (579)..(579): n is a, c, g, or t
tcagatcagacacgcacgaccggtgctcgatttagctcgatatagttggggtttggggggaggaactgctcagttaggacccagacggaaccatggaagccccagcgcagcttctcttcctcctgctactctggctcccagataccggttggggagatcgtgatgacgcagtctccagccatcctgtctgtgtctccgaggggagagagcccaccctctcctgcgagggccagtcagaacattggtagctaacttagcctacggtaaccaaacaaaaacctggaccacgcctcccagactcctctatttatcgttcactccaccgacgggccactgactcgtaccccaaccagtattcgaggtcggcaaggagggtcgtgggacagtacttcagtcctacaccatcagcagccgtacncgtctagaagtcgttggacttagttttacttacgtgtacaactagttcggtagtcgaggtcggtcccttacgggtaaccggttccgacccgacgggaccagtaggtaggactagtccggacggtacggtaacgttcgggtacggtctacggcctaaccgtnttaccgttgttaccttaccg

SEQ ID NO: 91244 - DNA, 638 bp, Homo sapiens
  misc_feature: GYAE6OF01BK13X.5.57.F02.1.454.CMB.1.raw
  modified_base (154)..(154): a, c, t, g, unknown or other
  misc_feature (154)..(154): n is a, c, g, or t
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (295)..(295): a, c, t, g, unknown or other
  misc_feature (295)..(295): n is a, c, g, or t
  modified_base (309)..(309): a, c, t, g, unknown or other
  misc_feature (309)..(309): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (557)..(557): a, c, t, g, unknown or other
  misc_feature (557)..(557): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtcgctcgagggganagcgcctacctctccgtgccgaggccaagtccaagtaaccngttggaacgctaacttgccgtaggaaccaacaaaaccgtgccagtccaccanactctactagttcncgttcatccgaacgtcggcctaagtcgtaactccgtaccccaatacggtacttcgaggtcgagtacggtaggtcgtcgacgagtctcgaatccanactacncgacgtcacgtaccgtagtacttaccgaggtaacctcggttacggtaaccgtatttaacccgtacggtactaaccggtaactaagttcgggttaactcggtaacgtcgtaaaccgcggttacggccctacgggaacttacccgaagnggttaccgaagtcgtaaggcccgtaattacccggttgcgttaccgaacggtcctaactccttacgggttactccgtcccgg

SEQ ID NO: 91245 - DNA, 644 bp, Homo sapiens
  misc_feature: GYAE6OF01CQ0XZ.5.57.F02.1.454.CMB.1.raw
  modified_base (152)..(152): a, c, t, g, unknown or other
  misc_feature (152)..(152): n is a, c, g, or t
  modified_base (158)..(158): a, c, t, g, unknown or other
  misc_feature (158)..(158): n is a, c, g, or t
  modified_base (165)..(165): a, c, t, g, unknown or other
  misc_feature (165)..(165): n is a, c, g, or t
  modified_base (200)..(200): a, c, t, g, unknown or other
  misc_feature (200)..(200): n is a, c, g, or t
  modified_base (247)..(247): a, c, t, g, unknown or other
  misc_feature (247)..(247): n is a, c, g, or t
  modified_base (460)..(460): a, c, t, g, unknown or other
  misc_feature (460)..(460): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggcttccagataccgttggganatcgtnatgacgnagtctccagccatcctgtctgtgtctccgaggggnagacgccactctctccgtgcgacgggccagtcaagaactgttagganaccaattgccgtaggtaaccaaacaaaacctggaccacgccctaccagtcctacctctatttactcgtcactccaccgaggacccacgtgactaccgtaacccaacgtacgtacgttacgaacggtcggaaccgtagggtacggtacggtagggaacctacgtaaccgttcgtaccggtctaccacctataccgacgacgtacgccgttaacnggttacctaggtaacgtacgttgtacgttaattttacagttacgtaactaacgtaagttcgggttacgtcgtacgggttccgtaccgtaggtacccggttccgaccgtacggaccacgtaggcgtataccgacggtaggacgtacgtcggtacgtacgtactaccgacttacttgtgtttaccc

SEQ ID NO: 91246 - DNA, 714 bp, Homo sapiens
  misc_feature: GYAE6OF01DATDG.5.57.F02.1.454.CMB.1.raw
  modified_base (161)..(161): a, c, t, g, unknown or other
  misc_feature (161)..(161): n is a, c, g, or t
  modified_base (181)..(181): a, c, t, g, unknown or other
  misc_feature (181)..(181): n is a, c, g, or t
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
  modified_base (661)..(661): a, c, t, g, unknown or other
  misc_feature (661)..(661): n is a, c, g, or t
  modified_base (685)..(685): a, c, t, g, unknown or other
  misc_feature (685)..(685): n is a, c, g, or t
tcagatcagacacgcacgaccggtgctcgatttagctcgatataggttgggtttgggggaggaactgctcagttaggacccagacggaaccatggaacgccccagccgcagcttctcttcctcctgcctactctggcctcccagacgtaccggttgggganattcgtgatgacgcagtccncagcctatcctgtctgtctcgtaccggagggganacgccgccctacccgtctccgnggccgacgggaccagtccaagtaactggttagacgactacgttacgaccgtaacggaaaccctaaaccgaaaccgtcgacccaccgccctaccgataccctacctacttacttcgttcctacactaccacggacggacctacgtagacctaaccgtaccccaagtacgtacgttacgacggttcggacggtaaggggtacggtacggtaggaactacggtacttacggtacgtcctaccgactacgtacgacgacgtaccgtagtaccgtacgttacgtaacggtacgtttacgtacggttacgtttaactttacgtaattcggtaaactagttacggttacgtggtacgttcgtaccggtaccgtacgggttacgaccccggtaacgcgggtaaccgcgtaaggtcgtacgtaggtaaccggngtacgaccgggttgcgtacccgtnaccgtactaccgttctacgtcctaacccg

SEQ ID NO: 91247 - DNA, 567 bp, Homo sapiens
  misc_feature: GYAE6OF01BWZ4P.5.57.F02.1.454.CMB.1.raw
  modified_base (547)..(567): a, c, t, g, unknown or other
  misc_feature (547)..(567): n is a, c, g, or t
tcagatcagacacgcacgaccggtgctcgatttagctcgatatagttgggtttggggggaagaggaagactgacggtccccccaggagtccagagtgcgtcgcaagtattggcagtgtgaaattttgacaccttatatgcagactctgtgaggggccgcttcaccgtgtccagagacaactccaagaacgcccgtctatttgcagatggacagcctgagagtcgacgacacgggcatctatttattgtacggcgccgagcaatactctcttactttccgtggagtcgagggtacggtccccggtcactgtcctccctcacgccctccaaccgtaaacgggccccagttcccggttacccttcccccgtcggccctacccctccctacccgaacgcgaccctaccctaccggttcgggggaccaacgcggaccccgggtccgtcgggccctcggcccgttcgggtacgaacgggtacctaccgttaccccgtggttacctaacgttcgtgacgggccgggtcgcggacgaacgggccgactagtagcnnnnnnnnnnnnnnnnnnnnn

SEQ ID NO: 91248 - DNA, 814 bp, Homo sapiens
  misc_feature: GYAE6OF01DEAWE.5.57.F02.1.454.CMB.1.raw
  modified_base (256)..(256): a, c, t, g, unknown or other
  misc_feature (256)..(256): n is a, c, g, or t
  modified_base (785)..(785): a, c, t, g, unknown or other
  misc_feature (785)..(785): n is a, c, g, or t
tcagatcagacacgcacgaccggtgctcgatttagctcgatatagttgggtttggggaggaactgctcagttaggacccagacggaaccatgggaagccccagcgcagcttctcttcctcctgctactctggctcccagactaccggttgggacattcgtagatgacgcagtcctccagccctattcctgtctgtcgtctcgaggggcagacgccctaccctctccgtgcgaggtccagtcaagaactgttcgganacctaacgttagcccgttaacggaaacccaaaaccgtaaaaccgtccggacctacgtaccctaaccccgagtacctttacctagtttaacttttacgtccggttacctaaccgttcccgaaccggtacggtaccctaaaccgttacgttaccctaaccccgaaacgtagttccgttaccggacgggtcgtaaccgtagggggttaacggtaccggtacggggtaaacctaacggttaccgttaccgaccgttacccaccggtaacctagtacccggacggtaaccgtggtaccccgtaaaccgtaaggttccaaacggtacggtttaaccgtacgggttaactttaaacgttttacgttacgtacgttaaacgtaacgtggttcggtaacggtcgtacggtacccggtaccgttaaccggtaccgtaccccgggacggtaaccggtaacctacgggtacggttacgtaacgtccgttaacggcgggtaacccgttaagttcgggtccgaacttcccggaacttaccgtntttacccgggtattccgttaccgtcccgg

SEQ ID NO: 91249 - DNA, 625 bp, Homo sapiens
  misc_feature: GYAE6OF01ETZE0.5.57.F02.1.454.CMB.1.raw
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgcccaccctctcctgccgagggccagtcaagaacattggtagacaacttacgcctaggtaaccaaacaaaaacctggcccagcctaccagacctcctctatttactcgttacactccaccgacgggccactgatcgtacccaacagacttcgagtggacaggacgggtctagggacacgcttacacgtctacacctatcgacgcgacgacgtacagttcctagtaaacgtacgttaggccttaagtttacttaactcgtaactaactaagttcggtaggtcaggtcggacctacggtaaccggttccgggacccgaacggggtacccacgtagggtacggtaatacgttaccggacgggtaccgtaacgtgggtcggtccgtacggtaccctactagttccttcgttccgtttacccg

SEQ ID NO: 91250 - DNA, 764 bp, Homo sapiens
  misc_feature: GYAE6OF01DSB82.5.57.F02.1.454.CMB.1.raw
  modified_base (156)..(156): a, c, t, g, unknown or other
  misc_feature (156)..(156): n is a, c, g, or t
  modified_base (175)..(175): a, c, t, g, unknown or other
  misc_feature (175)..(175): n is a, c, g, or t
  modified_base (211)..(211): a, c, t, g, unknown or other
  misc_feature (211)..(211): n is a, c, g, or t
  modified_base (216)..(216): a, c, t, g, unknown or other
  misc_feature (216)..(216): n is a, c, g, or t
  modified_base (757)..(757): a, c, t, g, unknown or other
  misc_feature (757)..(757): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagactaccggttgggganatcgtgatgacgcacgtcnccagccattcctgttctgtcgtcctcggaggggganagacnccctacctctccgtgacgaggccagtcaagtaacagtttggacacctaacgttacgaccgtacggtaaaccaaacctaaaaccgtcggacccacgccctaccgacgtactccctacgttaacttacgttccgtacacgtacccgaccggtaacgggaccctacgtacgtaacttacccgaaaccctaaccgtaacgtacgtttcgaacgggttacggaccggtaacgggggttaacgggttaccgggttacggggaaaaccttacggtaccgttttaacccgacgggtttaccctaacccgaaccctacggtaaccgacggtacgtaaccggtaccgtacgtaagttaccggtaaggtaaacggtcgttacgtaaccgtttaaggtttacttacgacgttaaccaagtaacgttggtacgtcgtacggttcggaccgtaccgggtacgtacccggccgtaacggacacggtaagtcgaatcgtacggacggtaacggtggtcgtacggtcgaacgtcccaacgttccgttacttccggttntaacccg

SEQ ID NO: 91251 - DNA, 726 bp, Homo sapiens
  misc_feature: GYAE6OF01CK2D1.5.57.F02.1.454.CMB.1.raw
  modified_base (153)..(153): a, c, t, g, unknown or other
  misc_feature (153)..(153): n is a, c, g, or t
  modified_base (192)..(192): a, c, t, g, unknown or other
  misc_feature (192)..(192): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtcnccgaggggagagacgcccaccctctcctggccacgggccagtccaagaactagttgggaacgcctaaacgttcgaccgtaggtaacccaaaacaaaaacctcgggacccacgccctacccagtacctccttactatttagtccgttcactcccgaaccgcgggacctacgtacgacgttccgtaccccaaaccgtacgtactttacgacggttcggacgtaacggggtacggggtccgtaggggaaccgtaacggtaccgtttccgaacgggttcctacccgaaccctactaccgacggcctaacggtaccgtaaccgtacggtctaacgggaaacgtacggttacgactttacggtttaacttacgtaacgtacaacgttagtggtacggttacgtgggtacgtcccgtaacgggttaccgttccgggaacccacggggaacctacggacggtaggtacctagtacgggtaccggacgtaacggtcgggttagcccgttacgacctaccgtacgtcctttggtccctttaccg

SEQ ID NO: 91252 - DNA, 781 bp, Homo sapiens
  misc_feature: GYAE6OF01ARFBT.5.57.F02.1.454.CMB.1.raw
tcagatcagacacgcacgaccggtgctcgatttagctcgatatagttgggtttgggggaggaactgctcagttaggacccagacggaaccatggaacgcccagcgcagcttctcttcctcctgctactctggcctcccagtagtaccggttggggagatcgtgatgacgcacgtctccagcctatcctgtctgttcgtccgtccgaggggagacacgccctaccctctcgtcgcgacgggtccaagtcaagtaactaggtggaacgactaacgttacgccgtaacggtaaacccaaaaccaaaacccgttcggaccctaacgccctaccgacgtacccttccttacttaatttaccgttccgttacctaacctaccccgaccggtaccgggccctaacgtgtacccgtacccgtaacccaacgtactaactcggtaacggtcggacgggtaacgggacgggttcgaacggactaacggttacttacgtacgttaccgtaccacctagtacgacgtaccgtcgttaccgtacgtacgttagtaaacgtaacgttacgtaacgggtacttttaacgtttacgtaacgttcgtaaaccgttaagtggtttacggacgttacggtacgttacccggaaccggttacccgggtaacggttccccgggaaaccgtaccgggtaaccctaacgggtgtaccgtaaacgtcgttacgggtaaccggtaccttaacgggtcgaacggtccacgtaccggtacttccgttacgttcgttaacccgttccgg

SEQ ID NO: 91253 - DNA, 856 bp, Homo sapiens
  misc_feature: GYAE6OF01CZAG3.5.57.F02.1.454.CMB.1.raw
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctggctcccagactaccgttggggagatcgtgatgacgcagtctcagccatcctgtctgtcgtcctcgagggganagacgccctaccctctcctcgcgacgggccagtacaagaactagttcggagactaacgttacgcccgttacggtaaaccaaaaccgaaaaaccgttcgggaccctaacgtccctacccgtacgtaaccttccccgtacttaacgttttactcccgttacaaccgttcccgaaccggtacgggaccctaacttcggtacttcccggtaccccaaaccgtacgtaactttcgaaggttcggactaggggtacgggtacgtacggggtacaacggttacccgttcggacgtttacccgactaccgtacgtacgaacgggtaccgtaccggtaaccggtaacgtacggttacgtaaacggtaaccgttacggtttacgggtaaccttttaagggttttaacttaccgttaccggttaaacaaacgttaacgtttggggttaaccgttacggttaagggttcccgggtaacccgtttaccgggtaacccgggtttacccgggaaccccggtaacggggttacccaaacgggtacgggttaacgacggtttaacggtccggtaaacccgggtgttaaaccggggtttgtacccgggttaccgtaccgtaaccccgttaaccgttaccggttttaccgttcggtttacccgttaccccg

SEQ ID NO: 91254 - DNA, 772 bp, Homo sapiens
  misc_feature: GYAE6OF01AM94F.5.57.F02.1.454.CMB.1.raw
  modified_base (210)..(210): a, c, t, g, unknown or other
  misc_feature (210)..(210): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactcgtggctcccagacgtaccggttggggagatcgtgactgaccgcagtctccagccagtcctgtctgtcgtctcgagggganacgtacgcccaccctctacctgcgacgggccagtcaagaactagttcggtagacctaaacgtcgccgtacggtaaccaaaccgaaaaccgttcgacctaccgacctacccgaacgaccttcctcttactttactcgttaccacgtaccccacgtaccggcctacgtacgacttacccgtaccccaaaccgagttacgtacgtaggtacggtacgtaacggggtcgggtacgtacgggtaactaacggtttaccttacggtacgttaccgtaccgtaaccgtacgtaccgtacgaccggtaacgttacccgttacgtaacggtcgttaacggtaacgttaacggttaccgttagttaacgttttacgtaacgttcggtaaactaaccgtaggttacggtcggttacgtgtaacccgggttacctaacgggttccggtaccccggtaaccgtaacgggtaccctaaggtacgggtaacgttacgttacgtacgggaacggttaccggaccggttggaccggtacgttacgaccctaccgttagtcgtttaccggctttaacccg

SEQ ID NO: 91255 - DNA, 671 bp, Homo sapiens
  misc_feature: GYAE6OF01BTWS9.5.57.F02.1.454.CMB.1.raw
  modified_base (657)..(657): a, c, t, g, unknown or other
  misc_feature (657)..(657): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgaggggagagacgcccaccctctcctgcgagggccagtcagaacagttggtagactaacgttacgacctacggtaacccaaaaccgaaaaaacctcggacccacgccctacccacgacctcctctactttactcgttcactcccacgacgggaccactagactcgtaccccaaaccgagtacttcgaggtcgacgaggtacgggtcgtagggacacgtacttcgacgttctccaacctactacgacgactacggaccgttaacgacgttaccgttaggaaagttaccgtttaggtacttaacggttttacttacgttacgtaaccaaacgtagttagttcggtagtacggttcggtacccgttacgggtaaccgggttcccggacccggtacgggtaacccacggtacgtacggtacgtacgtacgacggtacgttacgtgggtacgtcgtacgcctaactnttcctgtccttacg

SEQ ID NO: 91256 - DNA, 737 bp, Homo sapiens
  misc_feature: GYAE6OF01DPUNE.5.57.F02.1.454.CMB.1.raw
  modified_base (159)..(159): a, c, t, g, unknown or other
  misc_feature (159)..(159): n is a, c, g, or t
  modified_base (528)..(528): a, c, t, g, unknown or other
  misc_feature (528)..(528): n is a, c, g, or t
  modified_base (707)..(707): a, c, t, g, unknown or other
  misc_feature (707)..(707): n is a, c, g, or t
tcagatcagacacgcacgaccggtgctcgatttagctcgatataggttggggttgggggaggaactgctcagttaggaccagacggaaccatggaagccccagcgcagcttctcttcctcctgctactctggctcccgagtacgtaccggttggggganatcggtgattggacgcagtctccagccagtcctgtcgtggttcgtccgtccggagggggacacgaccggtccccaccgttcctaccgtggcggacgggaccctaggtacaagaaccgttagtttacgggaacgtactaaaccggttaacggccttaaccggtaaaccaaaaccgtaaaacgtcggaccaccgtccctaccgagtacctccgtattactttacgtccgttacaccgttccaccggaggacctacgtacgaccgtttaccgacccgtaaacgtcgttacgttacgaacggggtttagacggtaacgggttacggtccgggtaggaacctaacggtaccttaggacgtcgtaaccaccgtanacgacgtcaacggtcctagtaggtctaaggtactaacggttgtaacctttagtttactaacgttcaaaccgtagttacgtcggtcggtatccgggtcgtaccgtacggtaccggtccgaccgtacgtaccaaggtggtagtctacggtacgacggggtatacggtggtacgacccgtanacccggtaccttttaccggatcttacccgg

SEQ ID NO: 91257 - DNA, 841 bp, Homo sapiens
  misc_feature: GYAE6OF01CKBJD.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctggctcccagactaccggtggganatcgtgatgacgcacgtctccagccatcctgtctgtcgtctcgagggganacgacgcccaccctctccgtgacgacggcagtacaagactagtttggactacgtaacttagccgtacggtaaccaaaccgaaaaccgtgacccacgccctaccgacgtacctcctctaactttcgtaccgttacacgtacccgaccgacggtaccctacgtacgacttacccgtaacccgtaaaccgtacgtaccttacgtaacggttacggaccgtaaggggtaccgggtcggtaacggggtaacctaaccgttaccgttacgtaccgttacctaccgtaaaccgtacggtaccgtaacgggacccgtaaacggtaccggttaaaccgtaggttaccgtaaacgggttaaacgttaccggtttacggtaaccttttaacggttttaagtttacccggttaagttaacccgtaaacggtttgtaccggtttaagggtaccggttaacggtacccggtttaccggtaaaccggggttaacccgttcccgggaaccggtaccgggttaaccgtacggtaacccgggttaagtaaaccccgttaaggaccccggtaaaccggggttacgtaaacggttcgggtacccggtaactccggtaaacctacccgtagtttcccgttaaggttcccctttaaccg

SEQ ID NO: 91258 - DNA, 900 bp, Homo sapiens
  misc_feature: GYAE6OF01EN06L.5.57.F02.1.454.CMB.1.raw
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtcctcgagggganagacgcccaccctctccgtgcgagggcctagtacaggaactgttggtacgacctaaacgtttcgcccgttaaggtaaacccaaaaccgtaaaaacccgtgggacccaacggtccctacccgaagtacccttcccgtacttaacttttactccgttaccaacctaccccgaaccggtacgggaccctacgtacgtacgtacccgttaaccccaacgtaacgttacgttaccgacgggttacggacgtaacggggtaggggttacccggtaggggaaaccctaacggttaacctttcgtaaccgttaccctaccgaacctacgtaccgtacggaccgtaaccggttaccggttaaacgtcggttaacgtaaccggttaaaggttacccggtttacgggtaacctttaaaggtttttaacgttaccgttaacgttaaacgtaaaccgttagggtttacgggttacgttaaccgggtacggtttacccggggtacccctttaaaccggggttaaacccgggtttcccggggaaaccccggttaacggggtaaaccctacggtaacccgggtttagggaaacccgtttaaaccgggtaccggtaacccggggtaacccgttaacggtttacggggacccgggttaacttcccggaacccgttaaacggtcttttaccggtttacccgttcttttaaccccgg

SEQ ID NO: 91259 - DNA, 737 bp, Homo sapiens
  misc_feature: GYAE6OF01EQA0C.5.57.F02.1.454.CMB.1.raw
  modified_base (205)..(205): a, c, t, g, unknown or other
  misc_feature (205)..(205): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagcctatcctgtctgtgtcctccgagggganagacgcccaccctctcctgcgagggccagtcaagaacagttggtacactaacttacgccgtacggtaaccaaacgtaaaaaccgtggaccacgcctacccagacctcctctatttactcgttacactcccgacgacgggtccacgtacgtactaccgtaccccaaacgtacgtacttacgaggtacggacgtaagggtacggggttcgtacggggaaccaggtaccttacgtaacgtcctaacccaccgtactaccaacggtccaacggtaccgtaacgtacggtttacgtaaggaaaccggttacgtttacggggaaccttttaagggtttttaacctttacggttacggtaaacctaaacgttaggtttcgggtacgttacgtaacggtccggttacccgtaggttaacccgggttccggacccggtaagggaaccctaggtaggtacggtaagtaccgacggtacggtaccggtaacggttggtacggtacgtacgacctaaccttagttcccgttgttccttaacccg

SEQ ID NO: 91260 - DNA, 802 bp, Homo sapiens
  misc_feature: GYAE6OF01AITYA.5.57.F02.1.454.CMB.1.raw
  modified_base (154)..(154): a, c, t, g, unknown or other
  misc_feature (154)..(154): n is a, c, g, or t
  modified_base (772)..(772): a, c, t, g, unknown or other
  misc_feature (772)..(772): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatcgacgcagtctccagccatcctgtctgtcgtccgtccgaggggagacgacgccctacccgttctcccgtagccggtacgggaccctaggtaccaacggaaccttagtttacgggtaacgaccttaaaacggtttaccggtacccgtaacggtaacccctaaaaacgaaaacccggttcgggaccctaccggacccttaccccgaagtaccctcccttaacgttaactttaccgttaccggtttaccacccgtacccgtaacccggtaccgggtaccctaacttacggtaccgttacccggtaaccccaaaccgtacgttacgttacgtacggtacggacgtaacggtcgggtaccggtacgggtactacgtaaccgtttcgtacgtaccacctactaccgttacgacgtacacgtaccgtacgtacgttacgtaaggtaaccgttacgttacgggtactttaacgtttacgtaacgtacgtacaacggttaacgttggtaccgtacggtacgtacccggtaccgtacggtacccggttacgaccgggtaaccggacgtaccgtagggtagtacggtacttacgggacggtaccgtaggtcgtaggtaccnctaccgtacttagtccgttatcggttaacc

SEQ ID NO: 91261 - DNA, 879 bp, Homo sapiens
  misc_feature: GYAE6OF01ACKRK.5.57.F02.1.454.CMB.1.raw
  modified_base (155)..(155): a, c, t, g, unknown or other
  misc_feature (155)..(155): n is a, c, g, or t
  modified_base (838)..(838): a, c, t, g, unknown or other
  misc_feature (838)..(838): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagactaccggttgggganatcgtgatgacgcagtcctccagcctatcctgtcgtgtcgtcctaccgaggggagagacggcccacctctccgagccgacgggtacctaggtccaaagtaaccgtagtttggaacgacctaaacgtttacggacccgttagggtaaaacccaaaaaccgtaaaaacccgttggggaacccccaacgggttacccccttacccggaaacggttaccccgttaccccgtttaaccttaactttttaacggtttccccggtttaacgaacccttaaccccgaaacccgggtaaccggggaccctttaaaccgtcgggtaaaacgtttccccgaaaccccgtaaaacccgtggttaaaccctcggtaaacggtcggaaccgaacgggtcggtaacccggtaggaaaccgtacggttaaccgtaacgtaacccgggtttccctaaaccgaaccctacggttaccggtaacgaccggttaacggtaacccggttacgtaacggttcccggtaaaagtaacccgtacggttaacggtaccgtttaagtttcgttaaacctcgggtaactaaacggttcgttaggcgtaacggtcgtacggttacgaccggttacgttaccgggcgaacggtacctagccggtagtccgtaaagttccgaaggggtaccttaccggaaggtccggttaacnccgtaccgtaacttccggtttaactcggttaacttcccggg

SEQ ID NO: 91262 - DNA, 730 bp, Homo sapiens
  misc_feature: GYAE6OF01A70C6.5.57.F02.1.454.CMB.1.raw
  modified_base (155)..(155): a, c, t, g, unknown or other
  misc_feature (155)..(155): n is a, c, g, or t
  modified_base (161)..(161): a, c, t, g, unknown or other
  misc_feature (161)..(161): n is a, c, g, or t
  modified_base (170)..(170): a, c, t, g, unknown or other
  misc_feature (170)..(170): n is a, c, g, or t
  modified_base (206)..(206): a, c, t, g, unknown or other
  misc_feature (206)..(206): n is a, c, g, or t
  modified_base (262)..(262): a, c, t, g, unknown or other
  misc_feature (262)..(262): n is a, c, g, or t
  modified_base (680)..(680): a, c, t, g, unknown or other
  misc_feature (680)..(680): n is a, c, g, or t
  modified_base (707)..(707): a, c, t, g, unknown or other
  misc_feature (707)..(707): n is a, c, g, or t
  modified_base (724)..(724): a, c, t, g, unknown or other
  misc_feature (724)..(724): n is a, c, g, or t
tcagatcagacacgcacgaccggtgctcgatttagctcgatatagttgggtttggggaggaactgctcagttaggacccagacggaaccagtggaagccccagcgcagcttctcttcctcctgctactctgctcccagtactaccggttgggganatcgtnatgacgacngtctccagccatcctgtctgtcgtctacgagggganacgtacgcccacctctccgtgaccgacgggaccagtacaagaactgttacggaacnctaaacgttcgaccgtacggtaaccaaaacgtaaaccgtggacctacgtcctaccaagtacctacctacttaatttacctcgtaccacgtacccgaacggacggacctacgtgacttacccggaccaaaccgtagtacttaccggaggtacgaccgaagggtacggtcgtaacgggaacctacggtacgttaccgaccggtttacaccgaacgttacgtaccgacggtacccgtaaggtacccgttaagtcggtaaccttaaggtaaacgttacccggttagtaaaccgtttaagttttacgtaacccgtaggttaaaccaaccggttaagtttcgggtaaccgttcgaaacgggtcgttaaccggtaacccggttaacgggtccgaacgtaaccgacgtaccgtagggctaacggtnaacccggtgtacgacgttgacggtacngtacgactgtacctgtntacccg

SEQ ID NO: 91263 - DNA, 853 bp, Homo sapiens
  misc_feature: GYAE6OF01BP97O.5.57.F02.1.454.CMB.1.raw
  modified_base (155)..(155): a, c, t, g, unknown or other
  misc_feature (155)..(155): n is a, c, g, or t
  modified_base (847)..(847): a, c, t, g, unknown or other
  misc_feature (847)..(847): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttgggganatcgtgatgacgcagtcctccagccatcctgtctgtgtctccggaggggagacgacgcccctaccctctccgtgcgacgggacctagtcgaacgaacgtagtttggacactaacgttacgaccgtaacggtaaacccaaaaacaaaaacccgtggaccctacggaccctacccgaacgtaccttccctacttaacgttttacgtaccgttacaaccgttaccccaaccggtaaccgggaccctaacgtacggtaacctcccggtaaaccccgaaaccgtaacgtacgttaccgaacggttacggaaccggtaacgggttacggggtccggtaacgggaaccgtaacgttaaccgttaccgaaggtttaccctaacccgaaaccgtacgtacccgaagtacccgtaacggtaacccgttacgtaacgggttaccggtaaacgtaacgggttaaccgttacgggttaactttaacgtttttaacgttaacgtaaccgtaaaccttaaagttaacggttcgggttaccgggttagtaaccggtttaaccgggaccccggttaaaccggttaaacccgggtccggggtaaccccgggtaaacggtaccaacggttacggtaaggtaaccttaacggtcgaaacgggtacgttaacgtggggtcccgtacacggtacctaactacgttctacggttntacccg

SEQ ID NO: 91264 - DNA, 704 bp, Homo sapiens
  misc_feature: GYAE6OF01DDDU3.5.57.F02.1.454.CMB.1.raw
  modified_base (205)..(205): a, c, t, g, unknown or other
  misc_feature (205)..(205): n is a, c, g, or t
  modified_base (255)..(255): a, c, t, g, unknown or other
  misc_feature (255)..(255): n is a, c, g, or t
tcagatcagacacgcacgaccggtgctcgatttagctcgatatagttgggtttggggggaggaactgctcagttaggacccagacggaaccatggaagccccagcgcagcttctcttcctcctgctactctggctcccagataccggttggggagatcgtgatgacgcagtctccagccatcctgtctgtgtcctcgaggggganagacgcccaccctctcctgcgacgggccaggtcaaggaactagttggganctaaacgttacgaccttacggtaaccaaacgaaaaccgtggaccacgcctacccgagtacctcctactatttactcgttacactcccaacgacgggcctagtcgatccgaccccaacaagtacttacgaggtcgacgtagggtagggtcgtagggaacctacgtacttacgtacggttacctccgaacctactacgacggtaccgacgtaccggttaacgacgttacgtaaggtaaacggttaccgtttaggggtacctttaattttaacgttacgtacgtaactaaacgtagttcggtcggttaacgcggttcggtacccgtacggttaccggtccgggtacccgacggaccctaaggtaccgtaggtactaacggtacgaacgggtacccgtaaggtccgggttacgggctacgtaccctaaccgttagttctccgtttccgtaccc

SEQ ID NO: 91265 - DNA, 729 bp, Homo sapiens
  misc_feature: GYAE6OF01A4YTT.5.57.F02.1.454.CMB.1.raw
  modified_base (156)..(156): a, c, t, g, unknown or other
  misc_feature (156)..(156): n is a, c, g, or t
tcagatcagacacgcacgaccggtgctcgatttagctcgatatagttggggtttggggggaggaactgctcagttaggacccagacggaaccatggaagccccagcgcagcttctcttcctcctgctactctggctcccagataccggttgggganatcgtgatgacgcagtctccagccatcctgtctgttcgtctccgaaggggagagagcccaccctctcctgcagggccagtcaagaacattggtaacgacaaacttaggcctacggtaaccaaaactaaaaaccgtggtacaacgtccctacccaagtacctcctacttaacttttaactacgttaccaacttacccaaccgtaccgggacctacgtagtactccgttacccaacctaagtcgttacacggtggacgaaggtacgggtctaggggaccagtactctacgtctacactatcgagcagacgtactagtactaggtaagtaccgtttaggaccttaagttttaacttacctaagtaccgtaaaactaggtttcggtagggttacaacggttcggtacccggtttaacgggaacccgggtttaccggaacccggtaacgggtaacccaacgggtaggttacgggtaaacttacgtttaccggaacggggtaacggtaaaccggttcgggtacgggtaaccgtccgtacccgaaccgttaaccttcgtttaacggttcgtttaaacccg

SEQ ID NO: 91266 - DNA, 654 bp, Homo sapiens
  misc_feature: GYAE6OF01BMNDL.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgccaccctctcctgcagggccagtcagaacnttggagcaactgccgtaggtaaccaaacaaaacctggaccagcctccagacctcctctatttactcgttacactccaccgacgggccacgtcgactccgtaccccaacctagtaacttccaggtcggcgaaggtacggggtcctaggggaaccaggtaccgttacagtcctacaccctatccgagaccacggtccgtaactacgttcgtaggaacgttaccgttagggtaccttaagttttacttacgtacggttaacaaacctttaggtcgttacgggtcaacggttcggacccttacgggtaacccggttccgggaccccggtaaggggacccctaaggtacggttacggacttacgtacggacggtacgtacttcgggcgtccgtacgcctacgtactcgttcgttccttaccg

SEQ ID NO: 91267 - DNA, 811 bp, Homo sapiens
  misc_feature: GYAE6OF01AC40I.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccggagggganagacgcctaccctctccgtgccgacggaccctagtcgaacgaacctaggttttagggtacgacctaaaccgttttacggacccgttacgggttaaaccccaaaaactaaaaacccggttcgggacccaacggtccccttaccccggaacgtacccctttaccccttacttaacttttaaccgtttccggtttaccaaccttaccccgaacccgtaccggggtccctaacgtacgtaaccgtcccgtaacccccaaacgtacgtacgttacgacggttacggacgtaaggggtacgggtacggtagggaaccctaggtaccttcggtacgtaccgtacaacctcgtaccgagtccgaacggttaccgtaacgtcggttacgtaacggaaacttacgggttacggtaacgttaacggtttttaacttaacgtccgttaaactaacggtaagtttcggttaaccgggtacgtacggttccggtaacccgtacgggttaaccggttcccggacggtaacccgggtacgtacgtacgggtcgtattacgaccggtacgggacttaaggtcgggtagcgtaccgtaccgttacttacgtcgttgttccttacg

SEQ ID NO: 91268 - DNA, 726 bp, Homo sapiens
  misc_feature: GYAE6OF01DOFWU.5.57.F02.1.454.CMB.1.raw
  modified_base (155)..(155): a, c, t, g, unknown or other
  misc_feature (155)..(155): n is a, c, g, or t
  modified_base (179)..(179): a, c, t, g, unknown or other
  misc_feature (179)..(179): n is a, c, g, or t
  modified_base (217)..(217): a, c, t, g, unknown or other
  misc_feature (217)..(217): n is a, c, g, or t
  modified_base (238)..(238): a, c, t, g, unknown or other
  misc_feature (238)..(238): n is a, c, g, or t
  modified_base (361)..(361): a, c, t, g, unknown or other
  misc_feature (361)..(361): n is a, c, g, or t
  modified_base (645)..(645): a, c, t, g, unknown or other
  misc_feature (645)..(645): n is a, c, g, or t
tcagatcagacacgcacgaccggtgctcgatttagctcgatataggttgggttgggggaggaactgctcagttaggacccagacggaaccatggaagccccagcgcagcttctcttcctcctgctactctggctcccagactaccggttgggganacttcggtgatgacgctacgtccncacgccactcctgtcgtgtcgtccgtccggaagggganacgcctccctaccctctccgnggaccgtacggcctacgtacagtaacgtagttaggacgactaacgtcgtactaaccgaaacaaaaccgaaacggtcgaacctccgacctacccgactaccctcgtacttactttactcctacnccgtaccgacgtaccggacctagtctaaccgtaccgaaccctaagacgtacgtagaccggtgacgtagggtcgtacggagaacctagtacagtacctcctaccgaatactaaccggcacgacgtagtaaccgtaagtacgttaagacccggttattaaggtccgtttaaagtttacttactacggtaaattacgtagggtccgtttagggaccgttgggttacccggacccggttaggttaccccgacgggtaacccgttaacgacggtacccggtaggttaanacggttaacccgtaggaccgttaagttccggggtacgcgtacccgtcgtaaccggcttaacgttcttaacccgttcttacg

SEQ ID NO: 91269 - DNA, 673 bp, Homo sapiens
  misc_feature: GYAE6OF01CV0BK.5.57.F02.1.454.CMB.1.raw
  modified_base (155)..(155): a, c, t, g, unknown or other
  misc_feature (155)..(155): n is a, c, g, or t
  modified_base (203)..(203): a, c, t, g, unknown or other
  misc_feature (203)..(203): n is a, c, g, or t
  modified_base (474)..(474): a, c, t, g, unknown or other
  misc_feature (474)..(474): n is a, c, g, or t
tcagatcagacacgcacgaccggtgctcgatttagctcgatatagttgggttgggggagaactgctcagttaggacccagacggaaccatggaacgccccagcgcagtcttctcttcctcctgctactctggcctcccagactaccggtgggganatcgtgatgacgcagtctccagccatcctgtctgtgtctcgagggganagaccgtcccacctctccgtgcgacgggtccagtacaagtaactgttcgggactactaacgttcgaccgttacggtaaaccaaaaccgtaaaaccgtcggaccacgtaccctaccaacgtacctcctactactttactccgttacactacccacggacggtccctagtcgtaactccgtaaccccaactacgtatacgagtcggacgtagggtacgggtacgtgaactagtaccttagcgttacctacactacacgcacgagtaccgtaanacgtactaggtacttagtcgtattacgttatacctacgataacgtgtcggtacgtacggtcggtaccgtaccgtacgggttacgtcccggaccgtaacgggactacgggtaagtcggtactgtacggtaccggtaacgtggttcggaaccggtccgttaacgtaccctaactcgttttccccggtgttttaccctaacg

SEQ ID NO: 91270 - DNA, 859 bp, Homo sapiens
  misc_feature: GYAE6OF01BDOEI.5.57.F02.1.454.CMB.1.raw
tcagatcagacacgcacgaccggtgctcgatttagctcgatatagttgggtttgggggaggaactgctcagttaggacccagacggaaccatggaacgccccagcgcagcttctcttcctcctgctactctggctcccagactaccggttggggagatcgtgatcgacgcgagtctccagccactcctgtctgtcgtcctccggaggggagacgacgccctacccgttcgtccgtggcgacgggccagtcaaggaactagttggtacgacctaacgttacgccgtaacggtaaaccaaaaccgtaaaaccgtcggacccacgtaccctacccgtacgtacccttcctacttaacttttacgtccgttacctaccgtacccgaaccggtacgggtaccctacgtacgtaccgtacccgtaacccctaaaccgtaagttaccgttaccggacgggtacggaccgtaacggggtacggggttaccgtacggggaactaacggttaaccttcgtacgtacctaaccgacctacgtcgacgtacgtacgtccttaacgtacggttaccgtaacggtaaccggtttacggttaacggtaccgttttaacggttttaacgttaaccgtaaccggttaactaacggtttaacgttacgggtaaccggttacggtaccgggttaccggtacccggttacgggttaacccggttacccgggacccgggtaaccggaacgttacgggtacggttaacgttaaccgttaaccgtaacgggtaaacccggtacggttaaccggttcgggttcggtacccttaccgggaaacctttacccggttacgttcccctttggtttcccgttaacccg

SEQ ID NO: 91271 - DNA, 665 bp, Homo sapiens
  misc_feature: GYAE6OF01DXUTW.5.57.F02.1.454.CMB.1.raw
  modified_base (203)..(203): a, c, t, g, unknown or other
  misc_feature (203)..(203): n is a, c, g, or t
  modified_base (220)..(220): a, c, t, g, unknown or other
  misc_feature (220)..(220): n is a, c, g, or t
  modified_base (249)..(249): a, c, t, g, unknown or other
  misc_feature (249)..(249): n is a, c, g, or t
  modified_base (655)..(655): a, c, t, g, unknown or other
  misc_feature (655)..(655): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtcctcgaggggangacgcccaccctctccnggccagggccagtcaagaactgttggacncaacttagcctaggtaaaccaaacaaaaccgtggaccctagccctacccaagtacctccgtctaatttactccgttacactacccgaccggacgggccctagtcgtatccgtaaccccaacctagtacttcgaggtcggacagggtacggtcgtagggactaacggtacttcgagttcctacacctatacgagtaccgagtaccgtactagttcggagtaacgtacgtttcggaccgttaggtttttaactaccgtagtaacaaacgtaagtcgggtagttacgaggttccggaccgttacggtacgttcccggacccgaggtaccaggtacgtaggtacgtacgtacggaacggtaccgtaagttgggaccgtccttacgcgtaaaccctgttcgttaccggttnttaaaccccg

SEQ ID NO: 91272 - DNA, 733 bp, Homo sapiens
  misc_feature: GYAE6OF01BPG5N.5.57.F02.1.454.CMB.1.raw
  modified_base (155)..(155): a, c, t, g, unknown or other
  misc_feature (155)..(155): n is a, c, g, or t
tcagatcagacacgcacgaccggtgctcgatttagctcgatatagttggggtttggggggaggaactgctcagttaggacccagacggaaccatggaagccccagcgcagcttctcttcctcctgctactctggctccagataccggttgggganatcgtgatgacgcagtcctccagccatccgtgtctgtgtcgtaccgaggggagagacgccctacctctaccgtcggaccgagggacctagtacgaaagaacgtagttagggacaacctaaacgttacgtaccgtaacggtaaacccaaaaccgaaaaaccgtcggaccctaccgaccctacccgaacgtacctaccttactaacgtttactccgttacaccgtacccaaccggtacgggacctactacgacttaccgtacccaaactacgtattaccggaggtcggacggaggtacgggtcggtacggacgtagtactacgacgtctacctacacgtacgagtaccgacgtacgacctaggtcaacggagttacgttacggtaactttaaggtttaaccttaagttacgaactaaaggttaagtcgggtaccggtaagttaccggtccgggacctaaacggggttacccgtccgggacccgaacggtaccgaaccggttagtacggaaacgttaacgtacggaccgggtaaccacggtcggtacggacgtacgactaccgtactctcgtttccgaccc

SEQ ID NO: 91273 - DNA, 871 bp, Homo sapiens
  misc_feature: GYAE6OF01D7R2H.5.57.F02.1.454.CMB.1.raw
tcagatcagacacgcacgaccggtgctcgatttagctcgatatagttggggtttgggggaggaactgctcagttaggacccagacggaaccatggaagccccagcgcagcttctcttcctcctgctactctggctcccagactaccggttgggagatcgtgatgacgcagtctccagccatcctgtcttgtgtccgtcgaggggagacgacgcccaccctctccgtgcgacgggccagtcaagactagttaggacgacctaacgttacggaccgttacggtaaacccaaaaccgtaaaaacccgtcggaccccaacggacccctacccgtaacgtaccttaccctacgtttaactttaccgtttccgttaccctacgttaccccgaacccggtaacggtacccgtaacgttacgtaaccgttccgtaaacccccgtaacgtaacgtacttaccgaacggtcgggacgtaacggggtacgggtcggtacggggaactaacggttaccgttacgtacgttacctaccgtaacctagtaccgagtaccggtaacggtcccttaagtaacgttacgtaaaggtacgttacgttacggtaccgtttaatttaccgttaaacgttactaaacggtaaccttagggttcgtacgtaaccggttacggttccggtaaccccggttaaggggttaaccccggtacccgggaaccccgggtaacgggtaaccccgttaagggtacgggtttaaccgaaaccggtttacggtaacccggggtaaggggttacccggtaaacgggtttcccgggtaggacccggttaaccgtacccggtaacctttccggttttaccggttccgttaaaacccgggtttcccc

SEQ ID NO: 91274 - DNA, 829 bp, Homo sapiens
  misc_feature: GYAE6OF01AJ246.5.57.F02.1.454.CMB.1.raw
  modified_base (157)..(157): a, c, t, g, unknown or other
  misc_feature (157)..(157): n is a, c, g, or t
  modified_base (163)..(163): a, c, t, g, unknown or other
  misc_feature (163)..(163): n is a, c, g, or t
  modified_base (169)..(169): a, c, t, g, unknown or other
  misc_feature (169)..(169): n is a, c, g, or t
  modified_base (176)..(176): a, c, t, g, unknown or other
  misc_feature (176)..(176): n is a, c, g, or t
  modified_base (209)..(209): a, c, t, g, unknown or other
  misc_feature (209)..(209): n is a, c, g, or t
  modified_base (783)..(783): a, c, t, g, unknown or other
  misc_feature (783)..(783): n is a, c, g, or t
tcagatcagacacgcacgaccggtgctcgatttagctcgatatagttgggtttgggggagaactgctcagttaggacccagacggaaccatggaagccccagcgcagcttctcttccctcctgctactctggcctcccagtactaccggttgggganatcgtnatgacncagtccncagccatcctgtctgtcgtctaccggagggganagcgacccctacccttctccgtggcgtacgggcctaggtcaacggaactagtttggacgactaaacgttacgccgtaacgtaaccaaaccaaaaccgtcggaccaccgtccctaccacgtaccttctactactttactccgttacaccgttaccaccggacggtaccctacgtcgtaccgttaccgtaccccaaacgtacgtaacttcggtacggtacggtacgtacgggtacggtacggtacgggaactaacggtacttaccgtacggttaccctaccgtaaccgcgttaaccgacggtaacctacggttaaccgtaaccggtacgttacccggtttaacgaaaccggttacgtttaaccggtaacgttttaacgtttaacccgttttaacggaaccttaacgtaaacccggttaggtttcggttaaccgggttacgtaaccgggttaacccggtacccggttaaccggtaaacccggttcccgggaaacgtaacccgggtaaccgtaccgttaacgggtacgttaactaccgggtacggtacggtaacccggttaacggtccgggtttaccngggtcccctaaaccgttcctaaccgttcgtttctacccgttacccg

SEQ ID NO: 91275 - DNA, 790 bp, Homo sapiens
  misc_feature: GYAE6OF01BPRH1.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaacttctcagttaggacccagacggaaccatggaagccccagcgcagcttctcttcctcctgctactctggcctccagataccggttgggganatcgtgatgacgcagtctccagccatcctgtctgtgtctccgaggggagngacgcccacctctcctgcgacgggccagtacaacgaactagttaggtacgactaaacgttacgaccgttaacgggtaaacccaaaaaccgtaaaaaaccgtccgggaacccaacccggaccccttaacccgtaacggtaacccttacccgtttaaccttaaacttttaacgttaccgtttaaccgtaccttaccccgaacccggttaccggggaccccttaaccgttacggtaaccttacccgtaacccctaaaaaccgtaggttaaccttacgaacggtacggaacggaagggtacgggttacgtacgggaactacggtaaccttacgacgttacctaccaacgtacgtacctaacggactaacggttaaccgtaacgtaacggtacggttaacgaaacggttacgttcggtaacttaagtttactacgtacgtaacctaaggtacgtgtacgtacgtacgtacgtaccgtaccggtacgttccgaccgtaacggggtacccaaggtagtaggtacacgtacgaacgacggtattgggccggtataccggacgtaccgtacgttagttcgtcctttcgtaacccg

SEQ ID NO: 91276 - DNA, 772 bp, Homo sapiens
  misc_feature: GYAE6OF01ANL3R.5.57.F02.1.454.CMB.1.raw
  modified_base (206)..(206): a, c, t, g, unknown or other
  misc_feature (206)..(206): n is a, c, g, or t
  modified_base (257)..(257): a, c, t, g, unknown or other
  misc_feature (257)..(257): n is a, c, g, or t
  modified_base (499)..(499): a, c, t, g, unknown or other
  misc_feature (499)..(499): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggacgatcgtgatgacgcagtctccagccatcctgtctgtcgtcctccgagggganacgacgcccaccctctcctgcgacgggccagtcaagaactagttgggtacnctaacttacgccttacggaacccaaaccaaaaacccgtggacccaacgccctaccaagtaccttacccgtactaacttttacctccgtttaccactaccccgaaccgtacggaccctaaccgtgaacttacccgtaaccccaaaccgtagtaccttacgacgggttacggaccgagggtacggggttccgtaaggggtaacctaacggtaccgtttacgtaacgttaccctaccgtaaaccncgttacgacgacctacggtaccgtactacggtacgtaacggtaacgttacggttacgtactttaaggttttacttaccgttagtaaacgtaaccgtaaggtttcggtacgtacgtacggtaccggttaccgtacgggttacccggttaccggacccgggtaaccgggtacctaaccggtaaggttccggaaacgttaccgtacggtaacgggtacgtaaccggttgtacccgggctaccggtacctaccttagtccgtttcggttacctaccg

SEQ ID NO: 91277 - DNA, 792 bp, Homo sapiens
  misc_feature: GYAE6OF01EE3VF.5.57.F02.1.454.CMB.1.raw
  modified_base (160)..(160): a, c, t, g, unknown or other
  misc_feature (160)..(160): n is a, c, g, or t
  modified_base (229)..(229): a, c, t, g, unknown or other
  misc_feature (229)..(229): n is a, c, g, or t
  modified_base (252)..(252): a, c, t, g, unknown or other
  misc_feature (252)..(252): n is a, c, g, or t
tcagatcagacacgcacgaccggtgctcgatttagctcgatataggttggggtttgggggaggaactgctcagttacggacccagacggaaccatggaacgccccagcgcagcttctcttcctctgctactcgtcgcctccagtataccgggttggggantcgtgagtcgaccgctacgtccaccgacgccctagttcctgtcgttggtcgtccgtaccgggagggganacggaccgtccctccctctccgnggccggacggccagtacgaaagtactgttaggactacctaagttcgacgtaacgaaaccaaaaactaaccgccgaccaaccgtcctaaccgactcctaccgttattactttcaccgttaccaacttcccggacggaccggtactcgtacgttactaccccgtaacaaacgtacgtcttaccgggagtcggaaccggtagggtacggtaccgtacgggaataccgttataccgtctacctacactacgtaccagtacgtaccgtagaccgtagggtaaacctacgtaaacggttaccgtttgaaaccgttttaagttttaccctaacggtacgtaaaaccctaacgggttttggaacgtttccggtaaccggttacgggttcccgggtaaacccgttaaccggggttacccgggacccgggtaacccgggtaataaccgggtccggtaaggtcgttaaacggaaacggcgggtaaccgttagggacgttcggacgttaccgaacgtccgtaactactttcgggttaactcgtttaaacccg

SEQ ID NO: 91278 - DNA, 766 bp, Homo sapiens
  misc_feature: GYAE6OF01EJ8ID.5.57.F02.1.454.CMB.1.raw
  modified_base (156)..(156): a, c, t, g, unknown or other
  misc_feature (156)..(156): n is a, c, g, or t
  modified_base (204)..(204): a, c, t, g, unknown or other
  misc_feature (204)..(204): n is a, c, g, or t
tcagatcagacacgcacgaccggtgctcgatttagctcgatatagttggggtttgggggaggaactgctcagttaggacccagacggaaccatgggaagccccagcgcagcttctcttcctcctgctactctggctcccagataccggttgggganatcgtgatgacgcagtctccagccatcctgtctgtgtctcgagggganagacgcccacctctccgtgcgagggccagtcaagaactgttggacactaacgttacgcctaggtaaccaaaacctaaaaaccgtcggaccagtccctacccgaagacctccgtactaattttacgtccggttaccactacccgaaccgacgggaccctactagtactaccggtacccaaactaggtacttaccgaggtcggaccgtaagggtacggggttccgtaggggaactaacggttaccgttcgtaacgttcctaccaaacccgtacgttacgaaccgtacggtaaccggtacctaaccgtacggttacccgtaaggtaaacggtaccgtttgggaaccgttttaacggttttaactttaacccggtagtaaaccgtaaacgttaggtttacgggttacgttacgtacgggttccgtaccgtaaccgggttaaccggttcccggaaccgtaacgggacctacggtaacggtggtaaactacgttacggacggttaccggtaacgtcgggttacgaccgtacgtacccgaaccgttagttccgttcgtcccgtttaccg

SEQ ID NO: 91279 - DNA, 701 bp, Homo sapiens
  misc_feature: GYAE6OF01A175V.5.57.F02.1.454.CMB.1.raw
  modified_base (159)..(159): a, c, t, g, unknown or other
  misc_feature (159)..(159): n is a, c, g, or t
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
  modified_base (262)..(262): a, c, t, g, unknown or other
  misc_feature (262)..(262): n is a, c, g, or t
  modified_base (272)..(272): a, c, t, g, unknown or other
  misc_feature (272)..(272): n is a, c, g, or t
  modified_base (343)..(343): a, c, t, g, unknown or other
  misc_feature (343)..(343): n is a, c, g, or t
  modified_base (624)..(624): a, c, t, g, unknown or other
  misc_feature (624)..(624): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggcctcccagtacttaccggttggggganatcgtagatggaacgcacgtcctccagcctattcctgttctgttgtccgtcggagggganagacgccctacctctccngcgacggcagtcaagtactgtgganactaacgtcncgtacgtaaccaaactaaaccgtcgacaccgcctaccgactaccctctactatttacgtccgtactaaccnccgtaaccgtacgggccctacgtacgtaccgttacccgaaccctaacgtacgttacgtacgagggtacggtaccgtaaggggtccggttacgggacggttactaacgttaccgttactccgtaccgtaaccacgtacgtacgacgacgtaaccgttacgtaacgtcggtaacgttaaagtaccgtagttacgttaaccttagtttacctacgtacgaacctagtattcggagtcgtaacgtccggtacgtaccggtaccggtacccgaacggtcccgaacncggtagtacggtactgaaccggtcggtacgtaggtcggacgtactacccgacttacgtattccgttgttactacccg

SEQ ID NO: 91280 - DNA, 674 bp, Homo sapiens
  misc_feature: GYAE6OF01C2W9W.5.57.F02.1.454.CMB.1.raw
  modified_base (156)..(156): a, c, t, g, unknown or other
  misc_feature (156)..(156): n is a, c, g, or t
  modified_base (175)..(175): a, c, t, g, unknown or other
  misc_feature (175)..(175): n is a, c, g, or t
  modified_base (204)..(204): a, c, t, g, unknown or other
  misc_feature (204)..(204): n is a, c, g, or t
  modified_base (216)..(216): a, c, t, g, unknown or other
  misc_feature (216)..(216): n is a, c, g, or t
  modified_base (221)..(221): a, c, t, g, unknown or other
  misc_feature (221)..(221): n is a, c, g, or t
  modified_base (250)..(250): a, c, t, g, unknown or other
  misc_feature (250)..(250): n is a, c, g, or t
  modified_base (645)..(645): a, c, t, g, unknown or other
  misc_feature (645)..(645): n is a, c, g, or t
tcagatcagacacgcacgaccggtgctcgatttagctcgatataggttggggttgggggaggaactgctcagttaggaccagacggaaccatggaagccccagcgcagcttctcttcctcctgctactctggctcccagtactaccggttgggganatcgtgatggacgcagtcncagcctatctgtctgtcgctcgagggganagcgtccacctntccgngcgacggccagtcagtaactgttaggacnctaacgttcgaccgtaggtaaaccaaaacgtaaaaaccgtcggaaccgaacgtccctaaccgaacggtacccttacctactaactttttaaccgccgtttaacaccttacccgaccggaacgggtccaacgtcgaactccggtaacccaacaagtcttcgaggcgtagaggtagggtcgcggaatacgtacgtcgtacgctacgaacctagacgtaacgcgtacgtaccgtaagtcgttacgaaggtacgtacgtaggtacttaagttttaactacgttagaactaacgtagttacggttagtacggtagtaccggtaccgtaacggtaaccggttccggaaccgtacggaaccaggtacgtaggatacggacgaggattaacgggtgccggttnacggtaccaacgtgttacctggttcctac

SEQ ID NO: 91281 - DNA, 669 bp, Homo sapiens
  misc_feature: GYAE6OF01BKH9P.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcgagggccctaagtcaagaactagttggagactaaacttgaccgtaggtaacccaaaactaaaaaccgtcggaccacgccctacccgaagtacctcctactatttactccgttacactcccacgacggacctacgtgactccgtacccaaacgtagtacttcgagtggacctagggtacgggtcgtagggaactagtaccttcgacgtcctacaaccatacgagcgtaacggacttaacgacgttactaaggtaaacgtcgttaggaccttaagttttactacgtagtaaccgaataacgttggtacgtacgtacgggtaccgtccgtaaccggtaccggttcccgggaacccgtaagggacccgtaagtacgggtagtactacgtacggaacggtacgtacggttcggacggtctacgacctaacgttacgtcttccggtcttaccg

SEQ ID NO: 91282 - DNA, 569 bp, Homo sapiens
  misc_feature: GYAE6OF01EWJI5.5.57.F02.1.454.CMB.1.raw
  modified_base (159)..(159): a, c, t, g, unknown or other
  misc_feature (159)..(159): n is a, c, g, or t
  modified_base (198)..(198): a, c, t, g, unknown or other
  misc_feature (198)..(198): n is a, c, g, or t
  modified_base (536)..(536): a, c, t, g, unknown or other
  misc_feature (536)..(536): n is a, c, g, or t
  modified_base (541)..(541): a, c, t, g, unknown or other
  misc_feature (541)..(541): n is a, c, g, or t
  modified_base (544)..(544): a, c, t, g, unknown or other
  misc_feature (544)..(544): n is a, c, g, or t
  modified_base (546)..(569): a, c, t, g, unknown or other
  misc_feature (546)..(569): n is a, c, g, or t
tcagatcagacacgcacgaccggtgctcgatttagctcgatatagttgggtttgtggggaagaggaagactgaccggtccccccaggagtccagagtgcgtcgcaagtattggcagtgtgaaatttgacaccttatatgcagactctgtggaggggccncttcaccgtgtccaagagacaactccaaagaacgccgtntattgcagatggacagcctgagagtcgacgacgacgggcattctatttagttggtaccgggcggaccgagacgaattaccttctcttttactttcgtaggagtcgagggtacggtccccggtcacgtgtctccctcgctccctaccgaccgaacgggtcccacgttccgtcccttcccccgtaggcccctaccccgtaccctaccgaacgacgtccgaaccctcggtccggggacaccgtacgcccggtcccgtggccgtcgccgtcgtacgtaacgtaccttacccgtttccgtgttccgtgacttcgttagcggcgggtcctggaccgtaggcganacgtngcngnnnnnnnnnnnnnnnnnnnnnnnn

SEQ ID NO: 91283 - DNA, 776 bp, Homo sapiens
  misc_feature: GYAE6OF01CMYIA.5.57.F02.1.454.CMB.1.raw
  modified_base (159)..(159): a, c, t, g, unknown or other
  misc_feature (159)..(159): n is a, c, g, or t
  modified_base (179)..(179): a, c, t, g, unknown or other
  misc_feature (179)..(179): n is a, c, g, or t
tcagatcagacacgcacgaccggtgctcgatttagctcgatatagttggggtttgggggaggaactgctcagttaggacccagacggaacatggaagccccagcgcagcttctcttcctcctgctactcgtggctcccagacgttacggttaggggganatcgtgatcgacgcagtccnccgagccatccgtgtcgtgtcgtctcggaggggagacgacgccctaccctcgtccgcggcgacgggccacgtacaaggtaactaggtttacgggaacgtacctaacgttacggcccgttaacggaaaacccaaaacctaaaaccggtcggacccaccgaccctacccgaacgtaccctccctacttaacttttacgtccgttaccaccgtacccgaccggaccggacctacgtacgtaccgttacccgaaccctaacgtacgtaacgttaccggacgggtacggacgtaaggggtaccggggtacggtacggggtaacctaccggtaccttacggtacttaccgaaccctaccgtacgtacgacgacgtaaccggtacgtaaccgtcggttaacgtaggtaacggttcgttaaacggtcgtttaacgtttaatcgtacgttaacgaacgttaagttggtaccgggtacgttacgggtccggttaacccggttaccgggtacccgtccgggtaaccggacggactaacggtagggtacacgttacgacggacgtacgtaggccgtaggactcgtacctactgtttcctcgttctaccc

SEQ ID NO: 91284 - DNA, 636 bp, Homo sapiens
  misc_feature: GYAE6OF01AI072.5.57.F02.1.454.CMB.1.raw
  modified_base (155)..(155): a, c, t, g, unknown or other
  misc_feature (155)..(155): n is a, c, g, or t
  modified_base (161)..(161): a, c, t, g, unknown or other
  misc_feature (161)..(161): n is a, c, g, or t
  modified_base (204)..(204): a, c, t, g, unknown or other
  misc_feature (204)..(204): n is a, c, g, or t
  modified_base (216)..(216): a, c, t, g, unknown or other
  misc_feature (216)..(216): n is a, c, g, or t
  modified_base (599)..(599): a, c, t, g, unknown or other
  misc_feature (599)..(599): n is a, c, g, or t
  modified_base (613)..(613): a, c, t, g, unknown or other
  misc_feature (613)..(613): n is a, c, g, or t
tcagatcagacacgcacgaccggtgctcgatttagctcgatatagttgggtttgggggaggaactgctcagttaggacccagacggaaccagtggaagcccagcgcagcttctcttcctcctgctactctcggctccagactaccggttgggganatcgtnatgacgcagtctccagccatcctgtctgtcgtctcgagggganagacgccacctntcctgcgacgggccagtcaagtaactagttacggtacgactaacgttcgacctacggtaaaccaaaactaaaaccgtcggaccacgccctaccgagtacctcctactacgtttactccgtacacgtccgaccgcggacctacgtcgtacttccgaaccctaacgtacgtacgttcgtaacggtcggacgtacgggtacgggtcgtacgggactcgtaacttcgaactcctaacgacacgcacggacacgtacgtacgagttcgaaggtacttcggtagttacttacgttaacgttacacgtaacagttagtgtcgtactcgtccgtccgtaacgggttccgccgaacgacggactaagtggtaatccgtagcggacgtacggngttgacgtcgtacncctacgttcgtctgttactcccg

SEQ ID NO: 91285 - DNA, 824 bp, Homo sapiens
  misc_feature: GYAE6OF01DGNA5.5.57.F02.1.454.CMB.1.raw
  modified_base (94)..(94): a, c, t, g, unknown or other
  misc_feature (94)..(94): n is a, c, g, or t
  modified_base (153)..(153): a, c, t, g, unknown or other
  misc_feature (153)..(153): n is a, c, g, or t
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
tcagatcagacacgcacgaccggtgctcgatttagctcgatatagtgggttggggagaactgctcagttaggacccagacggaaccatggaacnccccagcgcagcttctcttcctcctgctactcgtggcctccagtacgtccgttgggganactcgtgatcgacgctacgtctaccagcctatcgtgtcttgtactccgtcggaggggtaanacgacnccctaaccctctccgtgacgtacgggccagtacgaagtaactagtttaggacgacctaacgttcgtacccgttaacggtaaacctaaaccgtaaaaaccgttcggaaccctaccgtacccgtacccaaacggttacctaacccgttacttaactttccgttaccgttaaccgtctaaacccggtaaccggacggggtacctaacggtctaaaccgtttccgaaacccctaccgtaaggttaaccttcgaaacggttccggaaacggtcggtaaacggggttcgacggtaacgacgttaccgttacgagttacccgtacaactacgtacgtaccgacgtaacgtccgtaacggtacacgttaaacggtacgtaaccgttaggtaaccttacgtttaagtacccgtaacgtaacgtaacggtagttccggttaacgtaccggttaaggtaacccgggttcccgttaacggggtaaacccggttcccgaaccccggtaacgggttaccaagggtactaaccggtacgtttacggaccgtaacgttaccgggttaatccgggtaactcggaacttaccggaactttcgaaccgtttcctaacgttccc

SEQ ID NO: 91286 - DNA, 733 bp, Homo sapiens
  misc_feature: GYAE6OF01ERX60.5.57.F02.1.454.CMB.1.raw
  modified_base (154)..(154): a, c, t, g, unknown or other
  misc_feature (154)..(154): n is a, c, g, or t
  modified_base (206)..(206): a, c, t, g, unknown or other
  misc_feature (206)..(206): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatccctgtctgtcgtcctccgagggganacgacgccctaccctctccgtggaccgagggtccagtccaaagaactagtttggaacgacctaaacgttcgaccgttacgggtaaaacccaaaaccgtaaaaaacccgtcggacccacggtaccctacccgaagaccttccgtactaatttactccgttacactcccgacgacggcctacgtgactaccgtacccaacagtactacgtaggtacggacaagggtacggtcgtaggggaacctacggtacctacgtacgtcctaacctaaccgagtccgaaggtaccaggtaccgtaacgtagtaccgttaaggaaacgtacgttgggtaacttaagttttaacttacgtacgtaacctaaacgtaagttcgacggttacgacggttaccggtacccgtaacggtaaccggtttccgaacccgggaacggtaaccacggtaggttacggtagtaacgaccggtaacggtacgtaaacggttcggacgtacggactaccgtacctacgttcgttacgtcccgttaaccg

SEQ ID NO: 91287 - DNA, 746 bp, Homo sapiens
  misc_feature: GYAE6OF01AVGL6.5.57.F02.1.454.CMB.1.raw
  modified_base (158)..(158): a, c, t, g, unknown or other
  misc_feature (158)..(158): n is a, c, g, or t
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
  modified_base (260)..(260): a, c, t, g, unknown or other
  misc_feature (260)..(260): n is a, c, g, or t
tcagatcagacacgcacgaccggtgctcgatttagctcgatatagttgggtttgggggaggaactgctcagttaggacccagacggaaccatgggaagccccagccgcagcttctcttcctcctgctactctggcctcccagacttaccggtgggganatcgtgactgacgcagtcctccagccatcctgtctgtntcaccgaggggangacgccctaccctntccgtgaccgagggcctagtcagtaactgttggtacncctaagttacgcctacggtaaccaacgtaaaaaccgtcggacctacggtcccttaccgacgtaccgtcctacgttacgtttaccgtccggtttaccacgtacccaccggacggtacctacgttacgagttaccgtacccctaaccgtaggttaactttaccggaggttacggactaacggggtacgggtccgttaacgggactaacgtccgttaccgagtacccttccaacgtacttacgacgtacgtccgtacgtagtacgttcgttaggaacgttactacggtacttagtttacgttacgtacgtacaacgtaacgttcggtacgttacgacgtttcggaccgttaccggtacggttcccggacctacggggtaaccctggtaaccgtcgggttaactacggttaccgaaggttacccggttacgtaggggttaccctagggtacctaccgtttacgacgtttacgtccgttaacgttaacccg

SEQ ID NO: 91288 - DNA, 784 bp, Homo sapiens
  misc_feature: GYAE6OF01CA362.5.57.F02.1.454.CMB.1.raw
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgcccaccctctctgcgacgggccagtcaagaactgttggagctaacgttagccgttacggtaaaccaaaccgtaaaaaccgtcggaccacgaccctacccaacgtacctacctctaactttactcgttaccactacccgaaccgcgggaccctacgtacgactaccgtaccccaaaccgagtacgttccgaggtcggaccgtaagggtacggggtcgtaggggaacctaacggtaccgttacgtacggttccctaaccaacccgtaacgttaccaaccgggtacaacgggttacccgtaaccgtaacgttaccggtaaacggtaaacggttacgttacgggttaaccgtttaacgttttaaccgttaaccgttacgtaaaccgttaacctaagtttcggttacggtacgtaacgggtccgggtaacccgtttacggggaacccggtttacccggaacccgggaacgggtacccgacggtacgggtagtaaaccgttgtaaccggtacgggaaccgttacggttaggtccggaccgttacggaacctaaccgtagttcccgttgttcccttaacccgg

SEQ ID NO: 91289 - DNA, 828 bp, Homo sapiens
  misc_feature: GYAE6OF01D35WT.5.57.F02.1.454.CMB.1.raw
  modified_base (160)..(160): a, c, t, g, unknown or other
  misc_feature (160)..(160): n is a, c, g, or t
  modified_base (550)..(550): a, c, t, g, unknown or other
  misc_feature (550)..(550): n is a, c, g, or t
tcagatcagacacgcacgaccggtgctcgatttagctcgatatagttggggtttggggggaggaactgctcagttaggacccagacggaaccatggaacgccccagcgcagcttctcttcctcctgctactctggctcccagtagtaccggttggggganatcgtgatgacgcagtctccagcctatcctgtctgttcgtccgtaccggaggggagagacgccctacccttctccgtggccgacgggccacggtccaaaggaaccgtagtttcgggtaacgaccttaaacgttacggtcccgttaacgggtaaaaccccaaaaaccgtaaaaacccggtcggaacccctaccggtaccccttacccaacgttaccttaccttacgttacttttacgtccgttaccaccgtaccccgaaccggaacggtccctacggttacgaacttaccccgaaccccaaacgtagtacttacggacggttcggacgtaaggggtacgggtcgtacgggaacttacggtactttacgaacgttcctaaacctaacccgtntaaccggtacgaccgtacggtacgttaaccgtaggttaccgtaaaggtaaacgttacggttacgttaccgtttaattttaacgtttaaccgtaagtaaccctaaagttaaggtttcgggtaacgtcggtaaccgggtaccggttacccgtaaaccggggttacccggttacccggggaacccgtacggggtaacccacggttacggtaggtaactacgtacggacggtagtacggttcggacggtctacggtccacttagtttcgtacgttcttaccg

SEQ ID NO: 91290 - DNA, 738 bp, Homo sapiens
  misc_feature: GYAE6OF01BSOE9.5.57.F02.1.454.CMB.1.raw
  modified_base (151)..(151): a, c, t, g, unknown or other
  misc_feature (151)..(151): n is a, c, g, or t
  modified_base (188)..(188): a, c, t, g, unknown or other
  misc_feature (188)..(188): n is a, c, g, or t
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
tcagatcagacacgcacgaccggtgctcgatttagctcgatatagttgggtttggggaggaactgctcagttaggaccagacggaaccatggaagccccagcgcagcttctcttcctcctgctactctggctccagataccggttgggganatcgtgatgacgcagtctccagccatcctgtctggtntcncgagggganagacgccacctctcgtgcagggccagtcaagaactgtttggacactaacttcgaccttacggtaaccaaacaaaaacctcggaccgacgcctaccgacgacctccgtactaacttttaactccgttacactacccgaaccgagggaccacgtgaactcgtaccccaacgacgtacttcgacgtcggacgaacggtagggtacgtaggggtaactaacggtaacgtttacaacggttaccgttacaacccgagtttaccgaaggtcccgtaaggtccggttaaacgtacgttacgtaaggtaaacgttacgttacgggtaacttaagtttttaacgttacttcggttaacaaacgttaacgttcggttacgtacgtacgttacgggtaccgtttaaccggtaacggttccggtacccgaacgggtacgaaccgtaagggtacgtaacgttacgtaccgaaggggtaacccgttaacggttcggtacggtaccgttacgttacccgaacgttaaccgttcgttaccgttcgtttaacccg

SEQ ID NO: 91291 - DNA, 750 bp, Homo sapiens
  misc_feature: GYAE6OF01AF1QH.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgcccaccctctcctgcgagggccagtcaagaactagttggagctaacttacgcctacggtaaccaaacaaaaccgtcggaccacgccctacccagtacctcctactacttttactccgttacactcccaccgacgggaccctactgactccgtaccccaacgagtacttacgaggtacggacgaacggggtacgggttccgtacggggaactacggtactttacgacgttaccctaccgaaccctacgtaccgacggtaccgaacggtacccgttaacgtaacggttaccgttaaggtaaaccgggtttacgtttacgggtacctttaacggtttttaacgttaccgttacgttaaacctaaacgttaacggtttgggttacgggttacgtaacgggttccggtacccggttacgggtaacccgggttacccggaccccggaacgggtaaccctaacgggtaggtacggtaacttacggaccggtaacggtaccgtaagtcgggtacgcgtacgacctacgtattcgttaccgttcttacccg

SEQ ID NO: 91292 - DNA, 1038 bp, Homo sapiens
  misc_feature: GYAE6OF01B053P.5.57.F02.1.454.CMB.1.raw
  modified_base (154)..(154): a, c, t, g, unknown or other
  misc_feature (154)..(154): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctggtcgtccgtacggagggggacgagacgacccctacccgtcctccgtcggacgacgggacctacgtacgaaacgaacgttagttagggtaacggaccttaaaaccggttacggtacccgttaacggtaaacccaaaaaaccgtaaaaaccggtccggaacccaaccgtccctaacccgaacgttacccctacccttacgtttaacttttaccgttacccgtttaacctaaccgtacccctaaaccgggaccgggtaccctaaccggttacgaacctttaacccccggtaaaccccaaaaccgttacggttaacgttaccgggtaacggggtcggaaccggttaacggggtaacgggggttaccggttaaggggtaaacccgtaacggtttaacccgttacgtaacgggtttaacccctaccgttaaaccgtacgtaccgtaaaggtaccccggtaacggttaaccccggtaacgtaacggttaaccgggttaaaaccgggtaacggtttaacccggtacgggttttaaacggttttaaacggttttttactttaaacccgggttacgtaaaccccgtttaaaggtaacgggtttacgggtttaacgggtaacgggttaaccgggttacccgggtttaaccccgttaacgggggttaaaccccggggttttccccggaacccggggttaacccggtaacggtaacccgggttaagggtaaaccggttcccggttaaacggacggggttaaaccggaaccgggttaaccgggtttcgggtaacggtacccggtaccctaaaccggggttaccctttaaagggtttccctttgggtttccccctttaaacccgg

SEQ ID NO: 91293 - DNA, 656 bp, Homo sapiens
  misc_feature: GYAE6OF01EGYLE.5.57.F02.1.454.CMB.1.raw
  modified_base (473)..(473): a, c, t, g, unknown or other
  misc_feature (473)..(473): n is a, c, g, or t
  modified_base (520)..(520): a, c, t, g, unknown or other
  misc_feature (520)..(520): n is a, c, g, or t
  modified_base (546)..(546): a, c, t, g, unknown or other
  misc_feature (546)..(546): n is a, c, g, or t
  modified_base (551)..(551): a, c, t, g, unknown or other
  misc_feature (551)..(551): n is a, c, g, or t
  modified_base (557)..(557): a, c, t, g, unknown or other
  misc_feature (557)..(557): n is a, c, g, or t
  modified_base (562)..(562): a, c, t, g, unknown or other
  misc_feature (562)..(562): n is a, c, g, or t
  modified_base (570)..(570): a, c, t, g, unknown or other
  misc_feature (570)..(570): n is a, c, g, or t
  modified_base (592)..(592): a, c, t, g, unknown or other
  misc_feature (592)..(592): n is a, c, g, or t
tcagatcagacacgcacgaccggtgctcgatttagctcgatatagttgggtttgggggagaactgctcagttaggacccagacggaaccatggaacgccccagcgcagcttctcttcctcctgctactctggctcccagataccggttgggatatcgtgatcgacgcagtcctcagccatcctgtctgtcgtccgtccgaggggacacgcgccctacccttctccgtgcgtacgggccagtcaagaactggttacggtacactaacgttcgaccgtacggaaaccaaaacgtaaaccgtcggaccaccgtaccctaccgaacgtaccctcctacttaacgttttctacggttaccacgtacccgacggtccggacctacgtgaacctcgaacccaacgtcggttactcggagttcggacgagggtcggttcggaggtacctagtccgttacgacgttccaacccgtaaccgtntacccggacgacgtacccgtacgtacgtcgttacgagtaaccggttntcgttacttagttactcgatacagtntgtgnccggtnaccgngttacccncggccgtaagactggacgttanactacggtcgacggtagtgttcggctcggttacaacccttccaggtttccctttgcccttaacg

SEQ ID NO: 91294 - DNA, 814 bp, Homo sapiens
  misc_feature: GYAE6OF01C2E8A.5.57.F02.1.454.CMB.1.raw
  modified_base (157)..(157): a, c, t, g, unknown or other
  misc_feature (157)..(157): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttggggaggaactgctcagttaggacccagacggaaccatggaacgccccagcgcagcttctcttcctcctgctactcgtgcctcccagtacgtacggttgggganatcggtagatgacgctagtcctcgacgtcctatcctgtctgttcgtaccgcggaggggacacgaccgcccctaccttcgtccgnggaccgacgggcctaggtacaagtaactgttacgggacacttaacgtacgccgtacgtaaaccaaacctaaacgtcggacctacgccctacgacgtaccttcctagttacgtttcgtcgttacaccgtacccgaaccggtacggtacccttacgtcgtaccgttaccccggtaaccccaaagtacgttacgttacgaagggttcggaccgtaagggttacgggtacgtacgggaacctacgttaaccgttcgtaccgtttacaaccctaacgtagtaccgtacgacgtaacgggtacctaagtacgtacgttaaggaacctttggttacgtacttttaagggttaccttacggtaacgtacttaagtacgtttacggtaccggttacgtagggttcccgtaaccggtttaccgggttacccggttacccgggaacccggttaacgggaacctaacgggttgggtaaaccgttcgtaacggaaccggggttcggaacctttaacggtagggcccggtttcaaacccggttcctaaaccccgtttgtttcccgggtacttttcccgttaaacccg

SEQ ID NO: 91295 - DNA, 661 bp, Homo sapiens
  misc_feature: GYAE6OF01AO0O0.5.57.F02.1.454.CMB.1.raw
  modified_base (152)..(152): a, c, t, g, unknown or other
  misc_feature (152)..(152): n is a, c, g, or t
  modified_base (650)..(650): a, c, t, g, unknown or other
  misc_feature (650)..(650): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagataccggttggganatcgtgatgacgcagtctccagccatcctgtctgtgtctccgaggggagagacgcccacccgtctccgtgcgtacggggccctaaggtccaaagaacctagttttagggtaacgacctaaacgtttacggacccgttacggtaacccaaaaccgtaaaaacccgtcggacccacgtaccctaccccgaacgaccttacccttactaacttttactaccgtttttacactaccccgaccgacgggacctactcgacttcgtacccctaacagtactacgagtcggacagggacggtacgtaggactagtacgttcgtagtcctaccacctactacgacgcgacgtaccgtactacgtcgtagaacgtcgttagacttagtttactacttacgtactaactacgtgttacggtcgtagtacggtccgtaccggtaccggttccggaccgtacggaccacgtaggtcgactagtcgacgggactaggtgtcgctgtccacnctctcgtctac

SEQ ID NO: 91296 - DNA, 822 bp, Homo sapiens
  misc_feature: GYAE6OF01A2TVB.5.57.F02.1.454.CMB.1.raw
  modified_base (775)..(775): a, c, t, g, unknown or other
  misc_feature (775)..(775): n is a, c, g, or t
  modified_base (819)..(819): a, c, t, g, unknown or other
  misc_feature (819)..(819): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctcggctcccagtacgtaccggttggggatagtcgtgatggaccgcagttcctccgagccctagttcctgttcgtgtgtccgtacggaggggagacgaccgtcccacccgttcgtccgtggacgtacgggacctaggtaccaaaggtaaccgttaggttacgggtaacgtacctaaaccgtttaccgggtacccgttaaaccggtaaaacccctaaaaaaccgtaaaacccggttcggaccccgtaaaccggtacccctaacccgaacgtacccttacccgttactttaactttaaccggtccttaacgaccgtaacccgaccggtaccggtacctacggtacttacgtacccgacccgaactagtctacggacggtcggataacgggtcgggtaccgtacggggtaactaacgtcgttaccgtaaccgttacctaccaaacccgtgttaaccggagcccgtaacggttaccgtagacggtttaaccgaggtaaaccgttcgttaagtacccggtttaatttaccgttagtaccgttaaacgagttacgttaggttacctacggtaacggttacggttacccgtaacgggttccggtccgaaaccgggcttaccgacgttggaacgtatacgggacgacgggttanaccggttgggacctacgtcgaaccgttctaggtcttaccgttcnccg

SEQ ID NO: 91297 - DNA, 687 bp, Homo sapiens
  misc_feature: GYAE6OF01CH5BR.5.57.F02.1.454.CMB.1.raw
  modified_base (205)..(205): a, c, t, g, unknown or other
  misc_feature (205)..(205): n is a, c, g, or t
  modified_base (250)..(250): a, c, t, g, unknown or other
  misc_feature (250)..(250): n is a, c, g, or t
  modified_base (658)..(658): a, c, t, g, unknown or other
  misc_feature (658)..(658): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccccagacttaccggttggggagatcgtgatgacgcagtctccagccatcctgtctgtgtctccgaggggngagcgccacctctcctgcgacgggccagtcaagactagttggacnctaacttcgccgttacggtaaccaaaacgaaaaccgtcggacctacgtccctaccgaacgccttacctacttactttaacgtccgtttaacaccgttacccgaacccggtacggaccctacgtcgtaacgtccgtaaccccaaccggtaggtaacttacgacggttcggacgtaagggtacgggttcgaggaacctacggttaccttacgcggtcctaacgaaccgtataccgagtcctaggtaccgttacaggttcaacgtaaacgttcgttaggtattaacgttttactcgtaacgttacaagttagttcggttagactacgggtcgaccttaacggtacgtaccggtaccgaacgtcaacgttcggagtacgtatccggagggtacctaaggtcggtacggtacncggtaccttacgctttcgtcgttcctacg

SEQ ID NO: 91298 - DNA, 1014 bp, Homo sapiens
  misc_feature: GYAE6OF01CWSPT.5.57.F02.1.454.CMB.1.raw
  modified_base (154)..(154): a, c, t, g, unknown or other
  misc_feature (154)..(154): n is a, c, g, or t
tcagatcagacacgcacgaccggtgctcgatttagctcgatatagttgggtttgggggaggaactgctcagttaggaccagacggaacatggaagccccagcgcagcttctcttcctcctgctactctggctcccagacgtaccggttgggganatcgtgaatggacgtcagtctccagccatctgtcttgtcgtcctcggaaggggagacgaccgtccctacccttctccgtggccgtaacgggccaggttacaacggaacttaggttcggaacgtactaacgttacggtccgtaaccggtaaaccaaaaccgtaaaaccgtccggaaccctaaccggccctaccgaactaccgttccttacttaacgttttacgttaccgttaccaaccttacccgaacggaccggtaccctacgttacggtacttacccgaccctaacgtacggttaacttacgggtacggtcggtaccggtaaggggttacgggtaccggtacgggtaaccctaacgttacccgttacggtacccgtaccttacccgaaccgtactccggtaaccgtacggtaccggttacccggttaacgttaccgggttacggaaacggttaacccgggttaacggttttccggggtaacttttttaaccgggttttaaacgtttaccccggtttaacggtttaaaccgtaaacgttttacgggtaccggggtttttaacgggtacgttaccgggggtttaacccggtttaaccccgggttacccccgggggggtttttaaccggtttaacccccgggggaaccccggtttaaacccggggggtaacccgttaaacgggttacccggggtttaaaccgggttaaaggttaacccgggttaaccggggtaacgggggttaaaccccgttttaacgggggttaccgggtttaacccggggttaacccgtccgggttaaccccgtttaaacccggttacccgtttacgggtttttaccccgtttcggtttaaacccccggg

SEQ ID NO: 91299 - DNA, 777 bp, Homo sapiens
  misc_feature: GYAE6OF01AOK6E.5.57.F02.1.454.CMB.1.raw
  modified_base (153)..(153): a, c, t, g, unknown or other
  misc_feature (153)..(153): n is a, c, g, or t
  modified_base (247)..(247): a, c, t, g, unknown or other
  misc_feature (247)..(247): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagacgcccaccctctcctgcgagggccagtcagaactgttggacnctaacttgccgtacggaaccaaaccaaaaccgtggacccacgccctacccagacctcctactatttacgtcgttaccactaccgaccgtacgggacctacgtcgactccgtaccccaaaccgtcgtaacttccgaggtggacgacgggtagggtcgtagggactacgtaccttcgacgtcctcaccgtactcgacgacctaggtacgtacgtagttcccgtaggtaaacgttacggttacgggtacttacgttttaacgtttaccgtaacgttacctaaacgttacgttacggttcggtaaccgtacgggttaccgggtaccccggttaaccggtttaaccccggggttacccggtaccccgggtaaccggggtaacccctaacgggttaacgggttacggtaaacggttaaccgtaccgggtacgggtaaccccgggttaacgttaccggggttaccggtacccgtttaccgggaaccccgttaccgtttaaaccctttccggtttaacccgggtttccctttaacccg

SEQ ID NO: 91300 - DNA, 698 bp, Homo sapiens
  misc_feature: GYAE6OF01BK3V6.5.57.F02.1.454.CMB.1.raw
  modified_base (216)..(216): a, c, t, g, unknown or other
  misc_feature (216)..(216): n is a, c, g, or t
  modified_base (367)..(367): a, c, t, g, unknown or other
  misc_feature (367)..(367): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
tcagatcagacacgcacgaccggtgctcgatttagctcgatatagttggggtttggggggaggaactgctcagttaggacccagacggaaccatggaagccccagcgcagcttctcttcctcctgctactctggcctacccagtacttaccgggttggggatagtcgtgatggacgcagtctccagcctatcctgtctgtcgtcgtcggagggganacgcgccctacctctcgtagcgacgggcagtacaacgactagttggacacctaactcgactacgaaccaaactaaaccgcgaccacgcctaccagtcctacctactattactctacactaccgacgtacgtcactgtactcctaccacgtntacgtacgnggacgngacggtacggtacgacggacacgttctactacgtcctacacgtactcgaacgcgtacgaccgttacgtacggttacgtaacggtagtacgtttacggttaacttttaagtttccttaacgtaagttaaccgaagttcggttaacggtcgtacgggtaaccgtccggttaaccggtaccgggttaacgacccgggtacccgtacggaacgttacgggtacgtaacgggtaactcggtaaaccgggcgtttacgggtacggttaggtccgtcggtactccccgttaaattccgttacgttcccgttttctaaccccgg

SEQ ID NO: 91301 - DNA, 621 bp, Homo sapiens
  misc_feature: GYAE6OF01D8AMM.5.57.F02.1.454.CMB.1.raw
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (250)..(250): a, c, t, g, unknown or other
  misc_feature (250)..(250): n is a, c, g, or t
  modified_base (356)..(356): a, c, t, g, unknown or other
  misc_feature (356)..(356): n is a, c, g, or t
tcagatcagacacgcacgaccggtgctcgatttagctcgatataggtcgggtttgggggaggaactgctcagttaggacccagacggaaccatggaagccccagcgcagcttctcttcctcctgctactctggctcccagataccggttgggagatcgtgatgacgcagtctccagccatcctgtctgtcgtctccgagggganagcgcccaccctntccngacctagggccagtcagaactgttggtanctaacgttcgccgtacgtaaccaaaccaaaaccgtggaccacgcctaccacgtacctcctactatttacgtcgtcactccacgcggccactgactcgtaccaacgngtacgtcaggtcggacgagtaggtcgcggacacgtcttcgagtctaccacgctacgagacagtacctagacgtcgtaacgtacgtagttcggatttacgtttaattactagtaccgtaaagttcgtggtttacgcgttaagggtcctacgtaccggtaacggttcccggaccgtacgggacctaacggtcgttaaggattaccgaacgggcgtaacgtagttcgggaccgtctacggactactcggtttacgtcgttccttaccg

SEQ ID NO: 91302 - DNA, 665 bp, Homo sapiens
  misc_feature: GYAE6OF01AS4UO.5.57.F02.1.454.CMB.1.raw
  modified_base (157)..(157): a, c, t, g, unknown or other
  misc_feature (157)..(157): n is a, c, g, or t
  modified_base (225)..(225): a, c, t, g, unknown or other
  misc_feature (225)..(225): n is a, c, g, or t
  modified_base (405)..(405): a, c, t, g, unknown or other
  misc_feature (405)..(405): n is a, c, g, or t
  modified_base (652)..(652): a, c, t, g, unknown or other
  misc_feature (652)..(652): n is a, c, g, or t
tcagatcagacacgcacgaccggtgctcgatttagctcgatataggttggggtttgggggaggaactgctcagttaggacccagacggaaccatggaacgccccagcgcagcttctcttcctcctgctactctggctcccagataccggttggggantcgtgatcgacgcagtcctccagccatcccgtgtctgtgtctccgaggggagacgcgccctaccctcnccgtgccgacggggaccaggtaccaagaaccagtttgggactactaacgttacggccttacggtaaacccaaacgaaaaacccgtcggaccacgtaccctacacgtacctcccgtattacttactaccgttaccaactcccgaaccgtacggtaccacgtgtacgtccgtaaccccaacngtacgttcgaggtcgacgagggtacggtcgtagggacacggtacttacgagtcctacgaactctacgacgcaggacctacgtagtacctagtaagttaccgttcggtattaagtttactacggtactaattaacgatttgggtacgtacgtaaggtccggacgttaccgtaaccggttcccggaaccgtacgggacctaagtgggactagtagtacggacggtagacgtgtacgcgacgtctaactntcttcgtccttcg

SEQ ID NO: 91303 - DNA, 625 bp, Homo sapiens
  misc_feature: GYAE6OF01AFR9R.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgcccaccctctcctgcagggccagtcagaacagttggtagacaacgttagcctacggtaaccaaaccaaaaacctcgggaccacgccctacccagtaccttcctactatttactccgttcactccaccgacgggccactgactcgtaccccaacagtacttcgaggtcggacaagggtacgggtcgtaggggaccagtaccgttcgacgtcctaccgaccagtccagcgacgtacgtactagtactagtaacggtcttggaccttagtttacgttactcgtactaactagttgtcggtacgtacgtacggtaccgtacggtaccggtccggtaccgacggaccacggtagtacgtagtacgtccggaggtacgaacgtgggtaccgcgtacgaccgactaccttcgttccgttctaccg

SEQ ID NO: 91304 - DNA, 786 bp, Homo sapiens
  misc_feature: GYAE6OF01BBVKO.5.57.F02.1.454.CMB.1.raw
  modified_base (165)..(165): a, c, t, g, unknown or other
  misc_feature (165)..(165): n is a, c, g, or t
  modified_base (172)..(172): a, c, t, g, unknown or other
  misc_feature (172)..(172): n is a, c, g, or t
tcagatcagacacgcacgaccggtgctcgatttagctcgatatagttgggtttgggggaggaactgctcagttaggacccagacggaaccatggaacgccccagcgcagcttctccttcctcctgctactcgtcggcctcccgagtacgttaccggttggggganattcggngagtcgacgcgtacgtcctccagccacttccgtgtcgtgtcgtacgtcggagggacgacgacgccctaccctcgtcgcgcgacggactagacgaagtactagttcggaacgactaacgttcgacctaacggtaaccaaaacgtaaccgcgacctacgacctaccacgtaccctactacttacttcgtaccgtacgacctacccgaggtacggtaccctaggtactaccgttacccaacccgtaacgtacgttacgtaccggacggtacggtacggtaacgggtacgggtaccggacggtaaccgttaacgttcccgttaacggtacttacccgtaaccgtaaccgtaaccgttcgaacggttacccgggtaacttaccgaaccgggtttaacggtccgttaaaggtaacggttaccggtttaacgtacgttttaacgtttacgtaccgtaacggtaaacttaagggttacgttgggtaccgtaggtacgtacccggtacgtaacccggggtacgaccggtaccgtacggtacgtaggtcgacgtacgtacggtacgcggttaacggtgtcggaccgtagcgttaccctaagttccgtacgttcccgtaacgttc

SEQ ID NO: 91305 - DNA, 886 bp, Homo sapiens
  misc_feature: GYAE6OF01D2QVX.5.57.F02.1.454.CMB.1.raw
  modified_base (99)..(99): a, c, t, g, unknown or other
  misc_feature (99)..(99): n is a, c, g, or t
  modified_base (131)..(131): a, c, t, g, unknown or other
  misc_feature (131)..(131): n is a, c, g, or t
  modified_base (159)..(159): a, c, t, g, unknown or other
  misc_feature (159)..(159): n is a, c, g, or t
  modified_base (595)..(595): a, c, t, g, unknown or other
  misc_feature (595)..(595): n is a, c, g, or t
  modified_base (874)..(874): a, c, t, g, unknown or other
  misc_feature (874)..(874): n is a, c, g, or t
tcagatcagacacgcacgaccggtgctcgatttagctcgatatagttggggtttgggggaggaactgctcagttaggacccagacggaaccatggaacnccccagcgcagtcttctcttcctcctgctacnctggctcccagacgtaccggttgggganattcggtgatggaacgtctacgtcctaccgacgcccattcccgtgttccgtgtcggtaccgtaccggagggggaagacggaccgtacccctacccgtcgtccgtgaccgggaacgggccctaggtaccaaaggtaacctaggtttacgggaaactaccttaaaccgttcgtacccgtaaccggtaaaaccctaaaaccgtaaaaacccgtcggaaccctaccgacccgttacccgaacgtccccttaccgttacttaacttttacgtaccttacctaacctacccgaccggtacggtacctaaccgtacggtacctaccggtaaacccaacgtagtacgttaccggaggtaccggacgtaagggtcgggtacgtacgggtaactacggtacttacaaacggttcccgtaacgtaaccagttaacgcggttaaccgnggtaaccgttacggtacggtaccggttaagtaaccggttcgttacggtaaacgtttcgttttaacgtcggttaacgttaattaaccggtacggtttagggtacccgtacgggttacgggttacccggtaaccgggttacccgggttaacccggtcccgggtaaccggtaaccggtaccggtaaacggttgtaaccggtacgttaacggaccggttaaccggaagtcccgggtggtaccgtcgtaaccgtaaccccgtactttccgtaccgttcccgttnttaaacccccgg

SEQ ID NO: 91306 - DNA, 824 bp, Homo sapiens
  misc_feature: GYAE6OF01AU3G1.5.57.F02.1.454.CMB.1.raw
  modified_base (234)..(234): a, c, t, g, unknown or other
  misc_feature (234)..(234): n is a, c, g, or t
  modified_base (701)..(701): a, c, t, g, unknown or other
  misc_feature (701)..(701): n is a, c, g, or t
  modified_base (785)..(785): a, c, t, g, unknown or other
  misc_feature (785)..(785): n is a, c, g, or t
  modified_base (811)..(811): a, c, t, g, unknown or other
  misc_feature (811)..(811): n is a, c, g, or t
tcagatcagacacgcacgaccggtgctcgatttagctcgatatagttgggtttgggggaggaactgctcagttaggacccagacggaaccatggaagccccagcgcagcttctcttcctctgctactctggcctcccagactaccggttggggacatcgtgatcgacgcagtctaccgagcctatcctgtctgtcgtcctccggaggggtacagaccgccctaccctcttccgnggaccgtacgggccaaggttaccaacgtaaacgtggttttacgggaacacctttaaaccgttacggacccgttttaaccgggaaaaccctaaaaaacccgtaaaaacccggttcgggaaccctaacccggtaccccttacccgaaaccggtacccttaccgtactttaacgtttacgtaccgttacctacgtaaccccgacccggtacgggccctacgtacgtaccgttacccgaacccaaacgtaacgtacgttcgaacggtccggaaccggtaagggtaccgggttccgtacggggtaaactcggttaaccttcggaactttcccaaccgaccgtatacccggaacaccggtacttaacggtaccgtacgtaacgttaacggtaacgttaccggttacgttaactttacggttttaacgtactaccggtaaactacgtaggtttcgttacggaaggttcccgtanacccggtacgttacccggtcgaacggtaccgaaccgtagtacgagtacgtaactacggtaccggtagtaacggtcggttacggntaccggtctaacggtcttccgggttnttaacccgggttc

SEQ ID NO: 91307 - DNA, 797 bp, Homo sapiens
  misc_feature: GYAE6OF01EUI8X.5.57.F02.1.454.CMB.1.raw
  modified_base (152)..(152): a, c, t, g, unknown or other
  misc_feature (152)..(152): n is a, c, g, or t
  modified_base (204)..(204): a, c, t, g, unknown or other
  misc_feature (204)..(204): n is a, c, g, or t
  modified_base (561)..(561): a, c, t, g, unknown or other
  misc_feature (561)..(561): n is a, c, g, or t
tcagatcagacacgcacgaccggtgctcgatttagctcgatatagttgggtttggggggaggaactgctcagttaggacccagacggaaccatggaacgccccagcgcagcttctcttcctctgctactctggctccagatccgttgggganatcgtgatgacgcagtctccagccatcctgtctgtcgtcgtccgaggggganacgacgcccaccccttctccctggccagggcccaggtaccaagaactagttggtacgactaaaccgtttacggacccgtacggtaacccgtaaaccgaaaaaacccgtaccggacccgaccgtacccgtaccccacggtaaccctcccttacttaactttacgttaccgttacctaaccgtgaaacccaaggggggtcccccaaccgtcggaacttcggttaccccccgtaaaacccgtacggaaccttttaccgaaggtttacgggaccctaagggtaacgggggttacccttacgggggggtaaccaagggtaacctttacgacggtttaccttaccgaacccgtaattacccgnttaacggccgttaaacggaccggttaaccgtaacggtacgttaacgggttactacggtaccgttacggttacgttaagttaccttaacgttacgtaacctaaacgtaacgtacggttacgtacgtacggtacgtcgtacgtaccgtaccgaccggtacggaccgacgtacgtacgtacgtacgtacggtacggtacgtacgtacggtacggtacgtacgaccgtaccgtacgtacg

SEQ ID NO: 91308 - DNA, 749 bp, Homo sapiens
  misc_feature: GYAE6OF01AZE2B.5.57.F02.1.454.CMB.1.raw
  modified_base (161)..(161): a, c, t, g, unknown or other
  misc_feature (161)..(161): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagtataccggttggggagatcgtnatgacgcagtctccagccatcctgtctgtcgtcgtaccgaggggacagacgtccctacccgtcctccgtaggccgacgggcctaaggtccaacgtaacgtagttcgggtaacactaaccgttagaccgttacggaaacccaaaaccgtaaaaaccgtcggacccacgtaccctacccacgtacctcctacttactttacttccgtacctacctcccgaccgacgggacctacgtacgtactaccgtacccaaactacgtacgtacgtacggtcggacgtacggtacggtacggttaacgggacgtaacgttaaccgtacgtacgtcgtaccgactacgtacgacgaccgtacgtaccgaacgtacgttacgtacgtaacgtacgttacgagtttaaccgttttagtaactcgtaactaagtacgttgtacggttacgtagccggttaaccgtcgggtacccgtaccgggtaccgaaccggtaccgtagtaacggtacgtactaaccggtacggaaccgtaccgggaaacttgggtacccggtagacccgtaccaacgttcccgttacgtttacgttcccggttaaccg

SEQ ID NO: 91309 - DNA, 839 bp, Homo sapiens
  misc_feature: GYAE6OF01CFKNK.5.57.F02.1.454.CMB.1.raw
  modified_base (514)..(514): a, c, t, g, unknown or other
  misc_feature (514)..(514): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgtgggagatcgtgatgacgcagtctccagccatcctgtctgtgtccgtccgaggggagagacgccctaccctccttccgcggaccgacggggccctaaggtaccaacggtaaaaccttagtttacgggggtaacaccgttaaaccgtttacgaccccggttaacgggtaaaacccaaaaacccgtaaaaaacccgtcggacccaaccggtccctacccgacgtacccttacctactacttttactcgttacactacccgaccgacgggcctagtcgtattcccgaacccaaccgtaagtacttacgaggtcggacgaacggtacgggtacgtacggactagtacctttcgacgttccgtaccaaaccgtntaccgaacgtaccgtacgggtaacccgtacgtaacgttacggtaaacggaacgtttaccgggttaacgggttaacttttaaacgttttaaccgttaccgttaacgtttaaacgaaaccggtttaagtttaccggggttagtacccggtaagggttacccgggtacccgttaaacggttaccccgggtttacccggggaacccgtaaccgggtaccgtaacgtaccggtaggtacgtaaccgtcgggtaaaccggtaccggtaacggttcgggcgttaacccacgggtaacctaccgttacttccgggttactttcccgttacccg

SEQ ID NO: 91310 - DNA, 789 bp, Homo sapiens
  misc_feature: GYAE6OF01CZAK5.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
  modified_base (254)..(254): a, c, t, g, unknown or other
  misc_feature (254)..(254): n is a, c, g, or t
  modified_base (349)..(349): a, c, t, g, unknown or other
  misc_feature (349)..(349): n is a, c, g, or t
tcagatcagacacgcacgaccggtgctcgatttagctcgatatagttgggtttgggggaggaactgcttcagttaggacccagacggaaccatggaagccccagcgcagcttctcttcctcctgctactctggctcccagataccggttggganatcgtgatgacgcagtctccagccatcctgtctgtcgtctccgagggganaggacgccctacccttctccgtgaccgagggccagtcaagacagttgganactaacgttagcctggtaaccaaacaaaaacctggacccagcctacccagactcctctattactcgtcatccacgaggccatgatcgacccaacngtactcgagtgacgaggtacgggtctagggactacggtactttacgacgttcctaaccgaacctaacgttccaaacggctaacggtcccggtttaaacgacggtttaccgttaagggtaaaccgtacggttttacgggaccctttaagggtttttaaacgtttaaccgttacggttaaccgaaacctttaaaggttcgggttaccggtacgtaaacgggtttccgggtaccccgtttaaccgggtaaacccgggttttcccgggaaacccggtaccggggtaacccctaacggttaaccgggttacggtaaaccgttacggttaccggaaccgggggtaaacccgtttaaacccggttggggttaacccggggtactttacccgggaccctttaaaccggacctttttacccggttacgggttacccttttaaccccggg

SEQ ID NO: 91311 - DNA, 859 bp, Homo sapiens
  misc_feature: GYAE6OF01CGYLQ.5.57.F02.1.454.CMB.1.raw
tcagatcagacacgcacgaccggtgctcgatttagctcgatatagttggggttgggggaggaactgctcagttaggacccagacggaaccatggaacgccccagcgcagtcttctccttcctcctgctactcgtggcctacccgagtacgttaccggttgggggacgtacgtcggtaggatcggaccgcctacggttccaccacgtccctacgttccctggttccttggtcgtccgtaccgggaagggggtacacgaccgtccctaccctccgtcgcggcgacgggactacgacgaacgtaactgttaggacacctaacgttaccgacgtaacggtaaacccaaaacgtaaaccgtcggaccaaccgtacccgaaccgtacgtacccttaccgtactttaactttaccgtaccttacgaccctaccgtaacccggacggtccctacggttaactacccgttacccggtaacccctaaatacgggttaacctacgacggggacgtacgggtaacgggtacggggtccgaacgggtaacctaacgttaccgttacgtacgttccaaaccgtacgtaacgacgaacggtaccgtaacggtctaaccgtacggttacgaacgttaggtaaccgttgttaactttaacgttacctttaacaaccggtataaacggttgttaccggttagggtaccgtaccggtaccgttaaccgggtaaccggggtccccggtaaccgggtacctaacgggccggtaacggtagttaccggaattaacggccgggtaaacggggtccttacggggtcggtacccgtacgaacccgttctaaaccggttagtttcccgtagtttaaccccgttcc

SEQ ID NO: 91312 - DNA, 854 bp, Homo sapiens
  misc_feature: GYAE6OF01C0EN7.5.57.F02.1.454.CMB.1.raw
  modified_base (204)..(204): a, c, t, g, unknown or other
  misc_feature (204)..(204): n is a, c, g, or t
  modified_base (256)..(256): a, c, t, g, unknown or other
  misc_feature (256)..(256): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagagtaccggttggggagatcgtgatgacgcagtcctcagccatcctgtctgtgtctccgagggganagacgcccaccctctcctgcgacgggccagtacaagtaactagttgggaacnctaaacgtttagaccgttacggtaaacccaaaaccgaaaaaccgtcggacccaacgtaccctacccaacgtaccttacctacttaattttacgttaccgtttacaaccgttacccgaaccgtacgggtaccctaacgtacgtaacgttacccggtaacccctaaacgtaacgtacgttaccgtacggtacggaccgtaacgggtacggggtccgttaggggaacctaacggtaacctttacgaacgttccctaccgaaccctaacgtacgacggacgtaacggtaccggttaaacgacggttacgtaaggtaaacggttaacgtttacgggtacttttaacgtttttaacttaaccgttaacgtaaccgtaaaccgtttaagtttacgggttacgggttacgtaacgggtttccggtaacccggtttaccgggtaacccggtttcccgggaaccccggttaaccggggaccctaacggttacggtaacggtaacttaacgggtcccgggtaaagggtacccggtaaccggtttgggtaccggttaacgtacccgggttacccaaacccgttgtttacccgttgttttaccctaacccg

SEQ ID NO: 91313 - DNA, 802 bp, Homo sapiens
  misc_feature: GYAE6OF01AYYZH.5.57.F02.1.454.CMB.1.raw
  modified_base (154)..(154): a, c, t, g, unknown or other
  misc_feature (154)..(154): n is a, c, g, or t
  modified_base (752)..(752): a, c, t, g, unknown or other
  misc_feature (752)..(752): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagacttaccggttggganatcgttagactcggaacgcgtagtcctaccagcctattcctgttcgtgtcgtcgtccgaggggtacacggacgccctaccttctccgtcggcgtacgggacccaaggttaccaacgtaaccgttagttagggaaccgtacctaaacgtttcgtaccgtaacggttaaaccaaaacgaaaaaccgttcggacccaacgccctacccggaactacccttacctaacgttatttaccgtaccgttacctaacgtacccgaaccggttacggaccctaagtaccgtaccgttaaccgtaccccgtaaacctagttaccgttacgtacggtacgtacgacgggttacgggttcgaacggtaccgacgttaccgtatacgtaccacgtaacgacgtacgaacgcgtagaccggttacctaagtacgtaggtacttacggttacgtacgtttaacgtttaagcctagtaactacgttacgttggtaaccgttacggcgttacggtaaccgttacgggttaaccggggtacccgtacgaaccgggtacctaacggtagggtccgtaaaaccgttgaaccggtttaaacgggcaacggtttaccggngttaccccgaattccgaactttaggtttaacccggtctttaccgtaccgg

SEQ ID NO: 91314 - DNA, 794 bp, Homo sapiens
  misc_feature: GYAE6OF01AOTK4.5.57.F02.1.454.CMB.1.raw
  modified_base (162)..(162): a, c, t, g, unknown or other
  misc_feature (162)..(162): n is a, c, g, or t
  modified_base (697)..(697): a, c, t, g, unknown or other
  misc_feature (697)..(697): n is a, c, g, or t
  modified_base (706)..(706): a, c, t, g, unknown or other
  misc_feature (706)..(706): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctcggctacccgaggtactaccgggttggggganattcggtagatcggacgcagtcctccagcctagtccgtggtactggtcgtcgtaccggaagggggtatacggccgtccccaaccgttcttccggcgccggaacggggtccctagtaccgaacggaactagttacgggactaactacgttacggaccgtacggtaaaccctaaaacgtaaaccgtcggaccctaacggtccctaccgtactaccttcctacgttaacttcgtcgttacctactcccgaacgtcggtacctaacgttcgaaccgttaccgacctaacgacgtacgttcgacgggttcaaccgggtaggtcgggttaccgtaggaccgtacggttacttcggtaacttcccaccggaaatcgtaacgagtcccggagttcgtaaaccgttggtacgttaacggaacgtttagttaaccggggaccttttaagttaccgtagtaactaccggttaactggttgtaaccggtcgttaacgtccgggtaaccctaccggggttactacccggacggtaactacgtaacggngggtaaccnccgttagggaaacccgtcggttaacgtggtcgggtacctatcccgggtacctttacgggaaccttttctaaaccgttcccgtaacggg

SEQ ID NO: 91315 - DNA, 820 bp, Homo sapiens
  misc_feature: GYAE6OF01EXQAI.5.57.F02.1.454.CMB.1.raw
  modified_base (155)..(155): a, c, t, g, unknown or other
  misc_feature (155)..(155): n is a, c, g, or t
  modified_base (170)..(170): a, c, t, g, unknown or other
  misc_feature (170)..(170): n is a, c, g, or t
tcagatcagacacgcacgaccggtgctcgatttagctcgatatagttgggtttgggggaggaactgctcagttaggaccagacggaccatggaagccccagcgcagtcttctcttcctcctgctactctggcctccaggactacgggttggggantcgtagtatggacgntacgtcctcgacgcctatccgttacgtctggtcgtcgtcggaggggtaagcgaccgtcctacccttctccggacggcgaccgggtactacgtacgaaaggtacttagttcgggaacttaccaagttaccgtcgtaaccggtaaaccaaaaccgaaaaccgtcggaccctaacctcccgttaccaacgtacccttcctaactttactttacgtaccgtacctaaccggtaccgtaaccggtaccgggtacctaacctaggtaccttacccgaaaccctaaacggtacttacgttacggacggtacggtacgggtaacggtacgggtaccggtaggtaccctaacggttacttcgtaccgtctaaccgcttaagaccgtacgtccgtaaccggtacgtaacgtaacggtcgttaaacggtacgtacggtacgtttacgtttacgtttaacgttaccttaacggtaactaaggtacgtcgttacgggtacggtgtttaacggcccgtaacggttaccggtaccggaacggtaaccgcgttaaagtcggtaacggtacttacgggtaacggtccggtacggtttaggacgggttacgggtaacctaccgggttaacccggtactttacgttccgtttacgggtccttaacccgg

SEQ ID NO: 91316 - DNA, 772 bp, Homo sapiens
  misc_feature: GYAE6OF01A6ISJ.5.57.F02.1.454.CMB.1.raw
  modified_base (154)..(154): a, c, t, g, unknown or other
  misc_feature (154)..(154): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgaacgcagtctccgacgcactcctgtctggttctcctccgaggggacgagacgtccctaccctccttccgtgccgacggggcctaggtacgaagaacctagttcggggtacacctaacgtttaccggtaccgtaccgggtaaaacccaaaacgtaaaaacctccgggaacctacggaccctacccgacgtaccttccccttacttaactttactccggtttaccaccgttacccaccggtaaccgggtacctacgtctacgtccgtaacccaactaacggtaactttcgaggtacgggaccgtaagggtacgggggttaccgtaaggggtacctagggttaccttaaccgacgttacccgtaccaacctacggtacacgtacgtaacgtaccggtacgtaaggttcctaggtaagttaccgggttgttaaccgtttacgtttaacggttacgtacgtaacgtactaacgttgggtacgttcgaacgttcgggtacctaccgggttaccggtccgaacccggtagaccgtacgtgggaccttagtaacgccgtaaggtactacggtcggacgtcgacgtaccgactagtttcgtaaccgtttcgtaacccg

SEQ ID NO: 91317 - DNA, 889 bp, Homo sapiens
  misc_feature: GYAE6OF01CGQ6N.5.57.F02.1.454.CMB.1.raw
  modified_base (156)..(156): a, c, t, g, unknown or other
  misc_feature (156)..(156): n is a, c, g, or t
  modified_base (209)..(209): a, c, t, g, unknown or other
  misc_feature (209)..(209): n is a, c, g, or t
  modified_base (231)..(231): a, c, t, g, unknown or other
  misc_feature (231)..(231): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctggctcccagacgtaccgttgggganatcgtagatgatgcacgtctcagcctatcctgtactgtcgtctacgagggganacgacgccctaccctctaccgngaccgagggtccctaagtaccgaagtaacgtagttacgggtaataccgtaacttaccggaccgttaacggttaaaccccaaaaacgaaaacccgtcggaccctaaccggtacccctaaccgtaacgtcccttaccccgtatttaacgttttaccgtccgttaccaaccttacccgaaccggaccgggtaccagttacgtaccttaccgtaacccaacgtagtactttaccggacggttacggacggtacgggtacgggttacgacggggtaaaacttacggttaaccgttacaaaccggtttccacccgtaacgcgttaccggaacgtcccgtaaacggtccttaaacgtcggttaactaacggttaaactaccgggttacggtttaacttaaacgttttcgttaaaccgtacgtttaacgaaaccgtaggtttaccgggtaacgttacccggtaacgggttaccgtaccccgggtttaaccgggtaacccgggtttacccccgggaaccgggttaacccgggaaccgttaacgggtacggggttacgtaaccgttaacccggttcggaaacccggggttaacctaacccggggttggttaaccgggtacccaccgttaacccgtacccgtttaggtaacccttcggggtttaacccc

SEQ ID NO: 91318 - DNA, 766 bp, Homo sapiens
  misc_feature: GYAE6OF01C766U.5.57.F02.1.454.CMB.1.raw
  modified_base (159)..(159): a, c, t, g, unknown or other
  misc_feature (159)..(159): n is a, c, g, or t
  modified_base (165)..(165): a, c, t, g, unknown or other
  misc_feature (165)..(165): n is a, c, g, or t
  modified_base (237)..(237): a, c, t, g, unknown or other
  misc_feature (237)..(237): n is a, c, g, or t
  modified_base (509)..(509): a, c, t, g, unknown or other
  misc_feature (509)..(509): n is a, c, g, or t
tcagatcagacacgcacgaccggtgctcgatttagctcgatatagttggggtttgggggagaactgctcagttaggacccagacggaaccatggaacgccccagcgcagcttctcttcctcctgctctctggcctacccagtacgttaccggtgggganagtcgngatggacgctagtcctccagccactccgtgtctgtcgtccacggaggggagacgacgcctacccgtctccgngccgacgggacctagtaccgaagtaactgttacggactacgtaaccgttacgaccgttacgtaaaccccaaaacgtaaaacccgtccggacctaacccggaccctacccgtaacgtacccttccgtactttagttttacctccgttaccacctacccgaccggtaacggtaccctagtacgtacttacccgaaccctaagtaacgtacgtacgacgggtcgaacgtaggtacgggtactacgggaactcggtacctgtacgtccacgactanaccgaagcgtaccggtacctaacgtcgttaacgtaagggttaccgttacgttaggttacctttaagttttaacctacgttacaacgttaagttacggtcggttagttaacggccgggttaccgttacccgtaacggggttcccaaccgggaacccgtacggggtactacggttaacggtcgaaaccgttagaccggggacgtacggtacggtggtaaccgtcacgttaaccgcgtttatccggttccgttctacccg

SEQ ID NO: 91319 - DNA, 612 bp, Homo sapiens
  misc_feature: GYAE6OF01BTQCJ.5.57.F02.1.454.CMB.1.raw
  modified_base (154)..(154): a, c, t, g, unknown or other
  misc_feature (154)..(154): n is a, c, g, or t
  modified_base (247)..(247): a, c, t, g, unknown or other
  misc_feature (247)..(247): n is a, c, g, or t
tcagatcagacacgcacgaccggtgctcgatttagctcgatataggttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagacgcccaccttctccgtgcagggtccagtcagacattggtancaacttacgcctggaacctaacaaaacctgaccagcctccagactcctctatttactcgttacactccaccgacgggcctacgtgatcgtaccccaacagacttcagtcgacaggtacggtctagggactacgacgttacagtcctacgaacctattccaacggcgtaacgtccgttaaccgagttactaggaaacgtacgttacgggacctttaaggttttacttaccgtcgtaactaactaagttgtaggtctaggtcgtacctacggtacgttaccggtaccgaggacctacgtaggtaccggtatacgtacgacggtacgaacttcgggtgacgtcgccacgtacttcgttcgtcttaccg

SEQ ID NO: 91320 - DNA, 744 bp, Homo sapiens
  misc_feature: GYAE6OF01B5QM3.5.57.F02.1.454.CMB.1.raw
  modified_base (164)..(164): a, c, t, g, unknown or other
  misc_feature (164)..(164): n is a, c, g, or t
  modified_base (333)..(333): a, c, t, g, unknown or other
  misc_feature (333)..(333): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
tcagatcagacacgcacgaccggtgctcgatttagctcgatatagttgggtttgggggaggaactgctcagttacggacccaggacggaaccagtggaacgccccagcgcagcttctcttcctcctgcctactctcggcctcccaggtactaccggttgggganatcgtgatgacgcagtctccgagacctagtcctggtctgtacgtcgaccgaggggatacgacgcccacctctcgcggacgacggccaagtccaaggtactagttggaacgctaacgttagcgtagtaaccaaaacaaacgtgaccacgccacagtacctctagtattcncgtcactaccgacnggccngagactctaaccanagtacttagaggtcgagaggtacgggtacgtacggaactacggacctttacgactttacgaaccacgtaaccttaccgagggtaaccgttacggacttaacggtaacgttaacggtaggttaaaaccgggttcgttaacggggtaatttttaaaccggtttacgtttaaccttaacgtaaaccggtaaactttaggttcgggttacggaaccgttagggtccccggttaaccttaccggggtacccgttaccggtacccgggaaagggtcctaaacgggttacgaaggttacctaaacgggtaccgtaggggtaacttaaccggtgggggtaactcctttagggacccaaggttccttaggtttccctaccgttaacc

SEQ ID NO: 91321 - DNA, 755 bp, Homo sapiens
  misc_feature: GYAE6OF01D65Z1.5.57.F02.1.454.CMB.1.raw
  modified_base (155)..(155): a, c, t, g, unknown or other
  misc_feature (155)..(155): n is a, c, g, or t
  modified_base (204)..(204): a, c, t, g, unknown or other
  misc_feature (204)..(204): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttgggganatcgtgatgacgcagtctccagccatcctgtctgtcgtctcgagggganagacgcccacctctcctgccgagggccagtcaacgaactagttgggtaacactaaacgttacgccttacggtaaaacccaaaaccgaaaaacccgtcgggacccacgtccctacccaacgtaccttccctacttaattttactccgttacaactacccgaaccgaccgggcctacgtgtaccttaccgtaccccaaactagtacttacgaaggttcggacgaagggtacggggtcgtacgggaactaacggtacctttcgaacgttcctacaacctagtcacggcgtaacggtacctaacgtagttacgtaggtaacgttacgttcggtaactttagttttaacttaccgttacggtaactaaaccgttagttcgggttacgtacggtacggttaccggtccggttaaccggttaccggttccgggacccggtaacggacccgtaaggtaacggttacggtaacttacggtaccggaacgggtaccgtaacggttcgggtacggtccgttaccgacccttaaccgtatttacccgttgttaccttacccgg

SEQ ID NO: 91322 - DNA, 915 bp, Homo sapiens
  misc_feature: GYAE6OF01EBPMX.5.57.F02.1.454.CMB.1.raw
tcagatcagacacgcacgaccggtgctcgatttagctcgatataggttgggtttgggggagaactgctcagttaggacccagacggaaccatggaacgccccagcgcagcttctcttcctctgctactctcggcctccaagacgttaccgggttggggatagttcgtgatcgacgcgtagtcctaccgacgacctactccgttcgttcgttggtcgtcccgtaccgggaaggggaacgaacgtacccgtacccctacccttccgtcgtacgaccggacggacctaaggtaccaaacgtactaggttacggtaacgaaccttaaaccgttacgtccgttaaccggtaaaaccctaaaaccggtaaaaacccgtcggaaccctaaccggtaccctacccgaccgtaacccttaccgttactttaaccgttttacgtaccgttaacctaccgtacccccgacggaccggtcctacgtcgtaaccgttccgtaaacccaacgtaacgttacttacgacggtacggtacggtacgggtacggtaccggtaacggtacgtaacgttaccgttaccgtaccgttacccttaaccgaaccctacggttaaccgaacgacccgtacggtaacccgtttaccgtaaccggttacgtaaacggttaaaccggttacgttttacggtaacggtttttaaaaccgttttccgtttaacggtaacgtaacccgttaaaacggttcggtttacgggtaaccgttccgggttaacgttccgggttaccgttaacccgggtaccggttcccgggaaccggaaaccgtacgtacggtacgttaacggtacgttaaccggacgggttaccgaagggttcctaaggccggttaacgtacctaccggtaccctagtttcttccggtacttaacccg

SEQ ID NO: 91323 - DNA, 727 bp, Homo sapiens
  misc_feature: GYAE6OF01B7C15.5.57.F02.1.454.CMB.1.raw
  modified_base (158)..(158): a, c, t, g, unknown or other
  misc_feature (158)..(158): n is a, c, g, or t
  modified_base (207)..(207): a, c, t, g, unknown or other
  misc_feature (207)..(207): n is a, c, g, or t
tcagatcagacacgcacgaccggtgctcgatttagctcgatatagttgggtttgggggaggaactgctcaggttaggacccagacggaaccagtggaagccccagcgcagcttctcttcctcctgctactcgtggcctcccagataccggttgggganatcgtgatgacgcagtctccagccatcctgtctgtgtcctcgagggganagacgcccaccctctcctgctagggccagtcagaactagtttgggacacaacgttgcctaggtaaccaaacaaaaccgtggaccaggtccctacccgagtaaccttcctactacttttactccgttactaccgttacccacccgtagggtcccactcgtaactccgtaccccaaccgtagtactttccgaggttcggaccgaaggtacggggttaccgtagggggaaccaacggtaccttacgacgttcctaccgacccgtattccgacgacgacggtaccgttaacacggttacctaggtaaaccggtacgttagggacttaacgttttaacttaccgtagtaccaaactaaggttcgttaggtcgtaacggtacggtacccgtaccggtaaccggttccgacccggtacgggacccagtacggtacgtaacgttaactacggtaaccgggtacgtaaacccgttggaccgggtacctacggtaccctaccgtaacgtttccttggttccctttaccgg

SEQ ID NO: 91324 - DNA, 799 bp, Homo sapiens
  misc_feature: GYAE6OF01EY0XN.5.57.F02.1.454.CMB.1.raw
  modified_base (157)..(157): a, c, t, g, unknown or other
  misc_feature (157)..(157): n is a, c, g, or t
  modified_base (211)..(211): a, c, t, g, unknown or other
  misc_feature (211)..(211): n is a, c, g, or t
tcagatcagacacgcacgaccggtgctcgatttagctcgatatagttgggtttgggggaggaactgctcagttaggacccagacggaaccatggaagccccagcgcagcttctcttccctcctgctactctcggctcccagactaccggttgggganatcgtgatgacgcagtcctccagcctatcctgtctgtcgtctccggaagggganacgacgccctaccctcgttccgtcggacgaccgggtacctaggttaccaaacgggtaaacctaggttacgggtaactaaccgtaagtttaccggaccgttaacggtaaaacccaaaaaccgtaaaaaacccgtcgggaaccctaccggtaccctaacccgtaacgtacccttaccctaccgtttaacgttttacttaccggttacctaccgttaccccgaacccggtaacggaccctacgtacgggtaccttaccgggtaacccaacgtagtaccgttacgacggtcgacgtagggtacggtcgtacgggaactagggtacctcgaccgtccgtaacctacgaaccgtgtaaccgacgtacggtactaacgtacgtacgtaacggtaacgttacgtccgggttaattaccgtttactacgtacgtaacgtaacgtaggttcgtccggacgtcgggttacctaccggtacggtaacccggttccgacccgggtaaccgtaacgtacggtacggacggttactaacggtcgtaaccggtacgacgttggacgtcccgttagacccgtactaccttccgtgtcccttaacg

SEQ ID NO: 91325 - DNA, 709 bp, Homo sapiens
  misc_feature: GYAE6OF01EI69C.5.57.F02.1.454.CMB.1.raw
  modified_base (157)..(157): a, c, t, g, unknown or other
  misc_feature (157)..(157): n is a, c, g, or t
  modified_base (695)..(695): a, c, t, g, unknown or other
  misc_feature (695)..(695): n is a, c, g, or t
tcagatcagacacgcacgaccggtgctcgatttagctcgatatagttgggtttgggggagaactgctcagttaggaccagacggaaccatggaacgcccagcgcagcttctccttcctcctgctactcgtcggcctcccagtataccggttgggganactcggtagatcggacgctacgtcctaccagcctattccgttgtctggtcgtcgtacggaggggacgacgaccgccctaccttctccgtcggaccggacggtccgtaagtacgaacgtaacctaggttcggtaactactaaccgttacgaccgttaacggaaacccaaaacctaaaccgtcgacccgaccgtaccctaccgaacgtaccttcctactttaatttctcgtaccactaccgacgcggacctatacgtacctacgtaacccaacgtagtactcgtagggtcgaacggtcggtacgggtcgacggtaacgtacgtctacgacttacccacgaacctagtaccgacgtactacgtaccgtaacgtacgttacgtaacggtacgttacgtagttacgtttactttacgttacgtacgttacgtaacgttcgttacggtagtacgtcggtccgtacgtaccggtacgtccggaccgacgcgtacgtagagtactacgacgtacggtacgaggtcgaccgcgtcgactacgttacncgttcgttctaccg

SEQ ID NO: 91326 - DNA, 781 bp, Homo sapiens
  misc_feature: GYAE6OF01A3JKX.5.57.F02.1.454.CMB.1.raw
  modified_base (153)..(153): a, c, t, g, unknown or other
  misc_feature (153)..(153): n is a, c, g, or t
  modified_base (205)..(205): a, c, t, g, unknown or other
  misc_feature (205)..(205): n is a, c, g, or t
  modified_base (446)..(446): a, c, t, g, unknown or other
  misc_feature (446)..(446): n is a, c, g, or t
  modified_base (734)..(734): a, c, t, g, unknown or other
  misc_feature (734)..(734): n is a, c, g, or t
tcagatcagacacgcacgaccggtgctcgatttagctcgatatagttgggtttgggggaggaactgctcagttaggacccagacggaacatggaacgcccagcgcagcttctcttcctcctgctactctggctccagactaccggttgggganatcgtgatcgacgcagtctcacgcctatcctggtcttgtctctcgagggganagacgtccaccctcgtcctgacgaacgggctacgtacgaacgaactacgtttaggaacgacctaaacgttcgtaccgtacggtaaacccaaaaccgaaaaccgtggacccacgtccctacgactacctcctcgtaattcacgttacacaccgacgacgcactatactaccgaccgtaacaggttactacgaacgggtcgaccgtaggacgggttacacgggtaacgtacttaccggtttanccgggttaccctacaacccgtagtacgaaccgtacgtaaccgggttactttaacccgagggttaacgtaaacgttaaacgggttaacgttaccggtacgtttaagttttaacgtaaccgtttaagtaaccctaaagagggttttagttaccgggttaacgttacggaccggtttaaccccgtacgggtaacccgggtttacccgaacccgggaccggtaaccgacgggaaccggtagtaaacgttaacgttaccgggaaaggtacccggttaaaggtcggtacccggnttaaacggaccgtacttaaacgggttccttaacttccgggttaaccc

SEQ ID NO: 91327 - DNA, 683 bp, Homo sapiens
  misc_feature: GYAE6OF01AP1R3.5.57.F02.1.454.CMB.1.raw
  modified_base (152)..(152): a, c, t, g, unknown or other
  misc_feature (152)..(152): n is a, c, g, or t
  modified_base (202)..(202): a, c, t, g, unknown or other
  misc_feature (202)..(202): n is a, c, g, or t
  modified_base (217)..(217): a, c, t, g, unknown or other
  misc_feature (217)..(217): n is a, c, g, or t
  modified_base (248)..(248): a, c, t, g, unknown or other
  misc_feature (248)..(248): n is a, c, g, or t
tcagatcagacacgcacgaccggtgctcgatttagctcgatatagttgggtttggggagaactgctcagttaggacccagacggaaccatggaagccccagcgcagcttctcttcctcctgctactctggcctcccagataccgttgggganatcgtgatgacgcagtctccagccatcctgtctgtgtcctccgagggganagtacgcccaccctntcctgcagggccagtcaagaacagttggtanctaacgttgcctaggtaaccaacaaaaacctggaccagccctcccagtacctcctctactttactccgttcactcccacccgtacgggcctactcgactcggtacccaaaccagtaccttacacggtcggacgaggtacgggtccgtagggtacaacggtaccttcgtaacgtcctaccaacccgtataccgaagccaagtaccggtacgtagttcgtagaacgtacgttcggacttaagttttactacgttacgtaacaaccgtaattcggtacgggttactagggtaccgtacccgttaccgggtaacccggttccggtacccgaacgggtacccacgtaggttacgaacttaccgtacgtaaccggtacgtaaacggtcggttaccgtacgttacgacctaacccgttaccgtacgttccgtttcttacccg

SEQ ID NO: 91328 - DNA, 709 bp, Homo sapiens
  misc_feature: GYAE6OF01E1BSX.5.57.F02.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (234)..(234): a, c, t, g, unknown or other
  misc_feature (234)..(234): n is a, c, g, or t
  modified_base (273)..(273): a, c, t, g, unknown or other
  misc_feature (273)..(273): n is a, c, g, or t
  modified_base (600)..(600): a, c, t, g, unknown or other
  misc_feature (600)..(600): n is a, c, g, or t
  modified_base (631)..(631): a, c, t, g, unknown or other
  misc_feature (631)..(631): n is a, c, g, or t
  modified_base (640)..(640): a, c, t, g, unknown or other
  misc_feature (640)..(640): n is a, c, g, or t
  modified_base (678)..(678): a, c, t, g, unknown or other
  misc_feature (678)..(678): n is a, c, g, or t
  modified_base (687)..(687): a, c, t, g, unknown or other
  misc_feature (687)..(687): n is a, c, g, or t
tcagatcagacacgcacgaccggtgctcgatttagctcgatatagttgggtttgggggagaactgctcagttaggacccagacggaaccatggaacgccccagcgcagcttctcttcctcctgctactcgtcggcctcccagactaccgggttggggacatcgtgatcgacgctacgtctccgagcctatcctgtctgtctccncggagggganacgcgaccctacctctccgngaccgacgggcctagtaccgaagtaccgtgttcggaacncctaaacttcgtacctaacggaaaccaaacgaaaaccgtcggacctaccgtccaccaacgtaccctctacttacgtttacgtccgtacctaccgtaccccgacggtacccggacctacgtactacccgtacccgtaacccgaacgtacggtacttaacggcggtacgtacgggtaacgggttacgggtacgacgggtaactaaccggttacgtacgtaccgtttaccaaccggtactaaccgtcgaaccgtcgaccgttacgtaacgtagtaacgtaacgtacggttctagttaacgtagtttactaggtactactagtagttcggngtacggtgccttaccgacggttccgaccggngtaccgacngacgtagtacacgtacggacgtactacgtcggctaccncggtaaccncttaaccgtctcgtccgttacg

SEQ ID NO: 91329 - DNA, 736 bp, Homo sapiens
  misc_feature: GYAE6OF01ESB9E.5.57.F02.1.454.CMB.1.raw
  modified_base (159)..(159): a, c, t, g, unknown or other
  misc_feature (159)..(159): n is a, c, g, or t
  modified_base (174)..(174): a, c, t, g, unknown or other
  misc_feature (174)..(174): n is a, c, g, or t
  modified_base (217)..(217): a, c, t, g, unknown or other
  misc_feature (217)..(217): n is a, c, g, or t
  modified_base (370)..(370): a, c, t, g, unknown or other
  misc_feature (370)..(370): n is a, c, g, or t
  modified_base (436)..(436): a, c, t, g, unknown or other
  misc_feature (436)..(436): n is a, c, g, or t
  modified_base (529)..(529): a, c, t, g, unknown or other
  misc_feature (529)..(529): n is a, c, g, or t
tcagatcagacacgcacgaccggtgctcgatttagctcgatatagttggggtttgggggaggactgctcagttaggacccagacggaaccatggaacgccccagcgcagcttctcttcctcctgcctactctggcctccagactaccggtttggggganagtcggtgatggacncacgtcctccagcctatcctgtctgtcgtctaccgaggggtancgacgccctaccctctccgtggaccgacgggtcctacggtaaccaaggtaaccgtagttacgggtaaccgacctaaaaccgttcgtcccgtaaccggtaaacccaaaacctaaaaaccggtccggacccgacggaccctacccgacgtacccnccttacattttacacgtttcctatccgaaccctaggggacccaaccgtgacctcgttacccaaccncgaacgtttcaaggtcggactaaggacggggttcgtacgggggaacctagaaccgtttcgaccggttaccgtacctaacccgtaacgtaccgntaacggccgtacgcgtaccaggtacgtacgtagtacttaggtactacgttactacttacgtacgtacgtaacgtaggtacggtacgtacgtacggtaccgttaccggtaaccggttaaccgggtacccgtacggtacgtacgtacgtacgtacgtacgtacgaacggtcgtacgtagtacgtccgtacgactaccgttacgtcgtcg

SEQ ID NO: 91330 - DNA, 814 bp, Homo sapiens
  misc_feature: GYAE6OF01C5UWX.5.57.F02.1.454.CMB.1.raw
  modified_base (153)..(153): a, c, t, g, unknown or other
  misc_feature (153)..(153): n is a, c, g, or t
tcagatcagacacgcacgaccggtgctcgatttagctcgatatagttgggttgggggaggaactgctcagttaggacccagacggaaccatggaagccccagcgcagcttctcttcctcctgctactctggctcccagactaccggttggganatcgtgatgacgcagtctcagccatcctgtctgtgtctccgaggggagacgacgccctaccctctcctggccgtacgggccagtacaagtaacgtacgttgggtagacctaaacgttagtccgttacggtaaaccaaaaacctaaaaaccggtcggacccaacgtaccctacccgaacgaaccttcctaccttaagtttaccgttccgttaactacctacccgaaccgtaacgggccctagtacgaacgttcccggaacccctaaacgacgttacgttccgaaggttcggacggtacgggtacgggtacgtacggggtaactacgtaaccgtttccgaggttaccttaccgacctacgtaccgacgacgtaacggtcccgttaacgacgtttacgtaacggttaaacgtcggttttaacggtcctttaagtttttaaccgttaacggttaccgttaaacgtaaaaccttaggttcggttaggttaacggtcgtacccggggttacccttaacggggtaccggtttaccccgggaaccggttaccgggtaacctacgggtaagtaccggtaaatacgttaccggaaccgggtagtaaacggtcgggttaccgggcttaaccgggaccttaacccgttagttcccttacggttcccttaaccg

SEQ ID NO: 91331 - DNA, 839 bp, Homo sapiens
  misc_feature: GYAE6OF01AY0ST.5.57.F02.1.454.CMB.1.raw
  modified_base (159)..(159): a, c, t, g, unknown or other
  misc_feature (159)..(159): n is a, c, g, or t
tcagatcagacacgcacgaccggtgctcgatttagctcgatatagttgggtttgggggaggaactgctcagttaggacccagacggaaccatggaagccaccagcgcagcttctcttcctcctgctactcgtggcctcccagacttaccggttgggganatcgtgatgacgcagtctaccagcctatcctgtcttgtcgtcctccggaggggagacgaccgccctacccctctccgtcgaccgcgggaccagtacaagtactaggttacggaacgtactaacgttacgaccgttaccggtaaacccaaaaccgaaaaccgttcggacccaacgtccctacccgacgtaccttcctacttaacgtttaccgttaccgttaccaccgttaccccggaaccgtaccgggtaccctacggtacgtaccgttacccgtaaccccgaaacgtacgtacgtccggtaacggtacggacgggtaacgggttaccggggtcggtaacgggtaccgtaacggttaccgttacgtaccgttaccgtaacccacggtaaccgtacgaaccggtccggtaacggtacgttaaccgtacggttaaccgtaaacgggtaaccggtttacggttaaccggtactttaaaccggtttttaacttaccggtttacgtaacgttaacctaaggtttccggtacggttaccgttacgggttccgttaacccgggtacggttaacccgtcccgggtaaccgggtaccggaaccgtacgtacgtaggttaacgtaccggtacggtagaaccggtacgttcgggtcgtaccgtacctcgtaacctcggtttcttccgttccg

SEQ ID NO: 91332 - DNA, 761 bp, Homo sapiens
  misc_feature: GYAE6OF01CQXTO.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (252)..(252): a, c, t, g, unknown or other
  misc_feature (252)..(252): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctcagccatcctgtctgtcgtcgtcgagggganagacgtccctacctctctcggcgacggccagtacagaactgttgggaanctaacgtacgccgtacggtaaaccaaacgaaaaccgtcggaccaccgtccctacccgagtacccttaccgtacttaagttttaccgtaccgtttacctacctaaccccgaaccggtaaccgggacccttaaacgttccggtaacttacccggtaaacccctaaaacgtacggttacttacgacggggttcggacgtaacggggtacgggttaccgtaggggaacctacggtaactttacgacgttaccgtaacgtaacctagttacgacggtacaacggttaccgtacgacggttacgtaacggtaacggttacgttacggactttaacgtttacttacggtacgtaaccaagtaacggttggtaccgtagtaccggtcggtaccgttaccggtaacggttccgaacccgtaagggtcctaaccggtaggtaggtacctacggaacggaccggtcgtaacggtggttacccgctaaccgtccgtaactagttcgttagttccgtaaccg

SEQ ID NO: 91333 - DNA, 705 bp, Homo sapiens
  misc_feature: GYAE6OF01AFIEH.5.57.F02.1.454.CMB.1.raw
  modified_base (212)..(212): a, c, t, g, unknown or other
  misc_feature (212)..(212): n is a, c, g, or t
  modified_base (472)..(472): a, c, t, g, unknown or other
  misc_feature (472)..(472): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactcgtggcctcccagtactaccggttggggagatcgtgatgacgctacgtctccagcctatcctgtctgtcgtctccggagggganagcgccctaccctctctgacgcggaccagtacaagtaactgttggtacactaacgttcgcccgtaacggtaaacccaaaacgaaacccgtcggaccaccgcccgtacccaagtcccttcctacttatttaccgtccgtacacctaccccgacgcgggaccctagtcgacctacccgaacccaacgtagtacgttacgagggtcgacggtacgggtaccgggtcggaaggacctacgtaccgtcgtacctacgaccacgtnacgtcgacgtacgtaacgtacgtaggtcgtaacggtaacgttacggtacggttactttacgtttactacgtacgtaacgtacgttaggtcggttagtacgttcggtaccgtaccggtaccgttaccgggcccgaacggtaccgtaccggtacgtaaggtcgaagtaccgtaggaaccggtagtacgtcgggtacgtccgtacgtacccacgttagtcctttagtccttacccg

SEQ ID NO: 91334 - DNA, 805 bp, Homo sapiens
  misc_feature: GYAE6OF01BAGB4.5.57.F02.1.454.CMB.1.raw
  modified_base (155)..(155): a, c, t, g, unknown or other
  misc_feature (155)..(155): n is a, c, g, or t
  modified_base (167)..(167): a, c, t, g, unknown or other
  misc_feature (167)..(167): n is a, c, g, or t
  modified_base (188)..(188): a, c, t, g, unknown or other
  misc_feature (188)..(188): n is a, c, g, or t
  modified_base (203)..(203): a, c, t, g, unknown or other
  misc_feature (203)..(203): n is a, c, g, or t
  modified_base (252)..(252): a, c, t, g, unknown or other
  misc_feature (252)..(252): n is a, c, g, or t
tcagatcagacacgcacgaccggtgctcgatttagctcgatatagttgggtttgggggagaactgctcagttaggacccagacggaaccatggaacgccccagccgcagcttctcttcctcctgctactctggctccagactaccggttgggganatcgtgatgacncagtctccagccatcctgtcngtcgctcgagggganacgacgcccaccctctccgtgcgacgggccagtcagaactgttaggacnctaacgttcgcctacggtaaccaaacaaaaccgtggaccacgtccctaccagtcctcctactatttactcgttacactcccaaccgcgggtacctacgtagtactacccgtaacccaaacgtacgtaacttcgaggttacggacgaggggttacgggtcggtaacggggtacctaggtaccttaccggtaacggttacctaccgaacctacggttacaacgtcggtaacgtaacccgttaagtaacggttaccctaagggtaaacgtttaccgttacgggttacgttttaacggttttaaacgttaccgttaaccggtaaccgtaaacgttacgggtttaacggttaccgggttacggtaaccggtttacccgggtaacccgttaccggggttaacccgttacccgggaaccccgtaacgggtaacccgtaaggtacgggttaccggtaaactaccgggtaacggtcccggggaaaccgttaacggtcgggttacccggactttaccgaacccggttaccggttatttccgttaccggttaactttaccccgg

SEQ ID NO: 91335 - DNA, 779 bp, Homo sapiens
  misc_feature: GYAE6OF01CM1CS.5.57.F02.1.454.CMB.1.raw
  modified_base (108)..(108): a, c, t, g, unknown or other
  misc_feature (108)..(108): n is a, c, g, or t
  modified_base (712)..(712): a, c, t, g, unknown or other
  misc_feature (712)..(712): n is a, c, g, or t
  modified_base (723)..(723): a, c, t, g, unknown or other
  misc_feature (723)..(723): n is a, c, g, or t
tcagatcagacacgcacgaccggtgctcgatttagctcgatataggttggggtttgggggagaactgctcagttacggaccagacggaaccatggaacgcccagcgcngcttctcttcctctgtctactcgtcgcctccagtacgtaccggttaggggatcttcggtagagtcgaccgctacgtcctccacgtcctacttccgtgtcttgtcgtccgtacgggaggggacacgccgccctacctcgtacgtcggcggtacggacctagtaacaacgtactaggttacggacctaacgttaacgttacggtacctaaccggtaaaaccaaaaccgtaacgccggaaccaccggtccctaccgaacgttaccttccttagtttaacgtttccgttaccgtttaacaccgttaccccggaacggtccggtacctacgttacggtaccttacccggaaaccctaacggttaaggtaccttcgggtaacggtcggtaaccgggtaagggttaccggggtacggtaaccggtaacttaccgtaccgttccaacgttacctaaccgaccttaggaccgacgtactacggtaactacgtcgtaactacggttagtaccgtttaagtactttaagtttaccaggttactactaagtttggcggttagtacgtcggtaccttacgggtacccggtacgtccggaaccgtgactaggacgtancgtcggtaacnccgggtattacgggtctaacggctacgtactacgttacttcgttacgttcctccgg

SEQ ID NO: 91336 - DNA, 753 bp, Homo sapiens
  misc_feature: GYAE6OF01AC3UL.5.57.F02.1.454.CMB.1.raw
  modified_base (131)..(131): a, c, t, g, unknown or other
  misc_feature (131)..(131): n is a, c, g, or t
  modified_base (225)..(225): a, c, t, g, unknown or other
  misc_feature (225)..(225): n is a, c, g, or t
  modified_base (251)..(251): a, c, t, g, unknown or other
  misc_feature (251)..(251): n is a, c, g, or t
  modified_base (358)..(358): a, c, t, g, unknown or other
  misc_feature (358)..(358): n is a, c, g, or t
  modified_base (683)..(683): a, c, t, g, unknown or other
  misc_feature (683)..(683): n is a, c, g, or t
  modified_base (739)..(739): a, c, t, g, unknown or other
  misc_feature (739)..(739): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactcnggtctcccagacgtaccggttggggagatcggtgatcggacgcgtagtctccagcctattccgtgtcgtgttacgtccgtccggaaggggacgngaaccgtccctacccgttccttccgnggaccggacgggcccagttaccgaaggtaacctgttggtacgacttaaacttcggacctaacggtaacccaaaactaaaccggtcggaccaacgtccctaccgaacnccgttactaccgttaatttcgtcgtacctacgaccgaaccggtcggcctacgttcggaccttaccgaaccctaacgtactaacgttccgacggtacggcgtaaggtcggtaccggtacggtaaactcggtacttacgaaccgtttcacgtacctagtacgtacgtcctaacggtacgtacctacggttaacgtacggtaacgttaccgttagggtaactttaaccgtttataacggttaccttacgaagttacggtcggtaagccttggaaccggttccaagggttaccgtccggacgtaccgaccggtaaatcgggacgtaacncggacggttcgaaggtcggttcgacccttagccggtacttacgttcgaccccggtnttcccgggttaccc

SEQ ID NO: 91337 - DNA, 872 bp, Homo sapiens
  misc_feature: GYAE6OF01CEEDN.5.57.F02.1.454.CMB.1.raw
  modified_base (154)..(154): a, c, t, g, unknown or other
  misc_feature (154)..(154): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctcggcctccagataccggttggganatcgtgatcgacgcagtcctccagccattccgtgtcgttcgtcgtccgttccggagggggaactacggaccgtacccctaccccgttccctccggtacggtacccggaccgggtaacctacggttaaccaacggtaacctaggtttacgggtacggtaccttaaaaccggttcgtacccggtaacggtaaaccccgtaaaaacctaaaacccggtcgggaacccctaccggtaccctaacccgtaacgtacccttacccttacttaacgtttaccgtaccgtacctaccgtaccccggtacggtaccggacttacggactaccgttacccaacccgtaacgtacgttacccgttacgggacggtacggtaacgtaccggggtagggttacccgaggtaaccgtacgtactttaaccggactaccctaccgtaaccgtacgtacgtaacgccgtacgggtaacttaacgtacgttacgacggttaacgttcggtagttacgtttaacgtttaccgtacgttaagaccgtaagtcggtttcgggtaaccttggtaccggttccgtaacccggtaccgggttaccggtaacccggggacgttaaccggtaccgtaacgggtacggttaggtacgtacccgtaaggggtaaccggtacctaggggttcggacgtttaccgtaccggacccttggaccctttcgttccggttaccttaaccgg

SEQ ID NO: 91338 - DNA, 784 bp, Homo sapiens
  misc_feature: GYAE6OF01DJMK7.5.57.F02.1.454.CMB.1.raw
  modified_base (153)..(153): a, c, t, g, unknown or other
  misc_feature (153)..(153): n is a, c, g, or t
  modified_base (727)..(727): a, c, t, g, unknown or other
  misc_feature (727)..(727): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtcgtctccgaggggacagacgcccaccctctccgtgcgacgggaccacgtacgaacgtaactagttagggtaacgacctaaaccttagccgttacggtaaaaccaaaacaaaaacccgttcggacccaccgccctacccgaacgtacccgtccttaccttacgttttacttcccggtttaaccaccgttaccccgaaccggtaccggggtaccctaacgttaggtaaccgttaccctaaaccccgtaaacccgaagtacgtttacgaaggttcggaaccggtaaggggaccggggttacgtaccggggttaaacacgggttacctttacggacgtttacgacctaacctattaaccggacgtaccgaaggtccgtaaccgttaggttaacccagggttaaaccgtacggtttacgggaccttttaggtttaacttaccggttacgtaactaaccggtagttcgttacggtcgtaacggtcgtaaccgttacgggtaccgttcccggaccgtaaccgggacttagacggtttacacggttnaccggtagcggtaacggtcggtacggctagaccgtacttagttcgtgtttcctaacg

SEQ ID NO: 91339 - DNA, 831 bp, Homo sapiens
  misc_feature: GYAE6OF01ETASM.5.57.F02.1.454.CMB.1.raw
  modified_base (157)..(157): a, c, t, g, unknown or other
  misc_feature (157)..(157): n is a, c, g, or t
  modified_base (251)..(251): a, c, t, g, unknown or other
  misc_feature (251)..(251): n is a, c, g, or t
tcagatcagacacgcacgaccggtgctcgatttagctcgatatagttggggtttgggggaggaactgctcagttaggacccagacggaaccatggaacgccccagcgcagtcttctcttcctcctgctactctgcctccagataccggttagggganatcgtgatgacgcagtctccagcctatcctgtctgtcgtctaccgaggggacacgcgccctaccctctccgtgcgacgggccagtcaagaactntttggacactaacttacgcctaggtaacccaaacaaaaccgtcggaccacgccctaccgacgtaccttccgtattactttacgtccgttaccaacctaccccgaacgtaccgggtaccctacgtagtacctccgtaaccccctaacgtacgtacgtttcggaggttacgggactaaggggtacgggtcctacggggaactacgttaccttacgtacgttacctaccgaccgtacgtccgaagccgtaacggtaccgtaacgtacgttaccgtaaggtaaccgttaccgttgggtaacccttttaaggttttacctttaaccggtacgttaaaccgaacgttaacggttacggttaccggtacggtaccggttacccggggttacccttaaccggggttaacccgggtttcccgggaaaccccgggttaaccgggtaaacccgtacggtaaccgggtttaacggaacttaaccgggtaaccggtaccggggtaacgttaaacccggggttccggtagggtcccgttaacccgtacccggtaaccccgttaggttttccgtaacccgtttcgttaacccccg

SEQ ID NO: 91340 - DNA, 700 bp, Homo sapiens
  misc_feature: GYAE6OF01DASFU.5.57.F02.1.454.CMB.1.raw
  modified_base (249)..(249): a, c, t, g, unknown or other
  misc_feature (249)..(249): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggagatcgtgatgacgcagtctccagccatcctgtctgtgtctccgaggggagagcgccctaccctctcctgcgacgggccagtcagaactagttcgganccgaacttagccgttacggtaacccaaacgaaaaacctcggacccaaggccctacccagtacctcctcttatttactccgttacacgtccgaccgacggccctagtcgactccgtaacccaacgtacgtacttcgaaggtcgacgtagggtacgggtcgtagggacgtacgtacttcgacgtccaccacctagtcgacgtacgaacgtccgttaacgtcgttacgtacggaaacgttccgttagggtaccttaaggttttaacttacgtacgtaccaaacgttagttacggttacggtacgtaagggttccggtacccggttaccgtaaccgggttcccgggaacccggtaaccgggtactacggtaacggttggaacttaggaccggtacggtacggtaacggtcgggttcgacggttccgacggtactcgttcgttcggttcttacccg

SEQ ID NO: 91341 - DNA, 686 bp, Homo sapiens
  misc_feature: GYAE6OF01BTTB9.5.57.F02.1.454.CMB.1.raw
  modified_base (152)..(152): a, c, t, g, unknown or other
  misc_feature (152)..(152): n is a, c, g, or t
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
  modified_base (204)..(204): a, c, t, g, unknown or other
  misc_feature (204)..(204): n is a, c, g, or t
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (515)..(515): a, c, t, g, unknown or other
  misc_feature (515)..(515): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagataccggtgggganatcgtgatgacgcagtctccagccatcctgtctgtgtcncgagggganagcnccacctntcngcgnggcagtcagaactgttgganactaacgttgccgtacggtaaaccaaaaccgaaaaaccgtcggaccaccgccctacccgaacgtaccttcccttactacgttttaacgtttccgttactacctacccgaccggtaccgggtacctacggtacaccgtttaccgaacccctaaacggtacgtactcgtacggtggacgtacgggtaggggtccgtaacgggaataccggtacttacgtacgtcctacactactacgacgctacggtctaacgactacgtagtaacgtcgttaacggtnttaagtttacgttactatacgaatagtaggtagtcgtacggtacggtcccgttaggtaacccggttcccggtacgggaacgtacgtaacggtagggacgttacgtacgtacgggtaggtaaccgtcgtcgggtacgtacacgtaccgaactcgttcttacgtccgttaccc

SEQ ID NO: 91342 - DNA, 957 bp, Homo sapiens
  misc_feature: GYAE6OF01B3APR.5.57.F02.1.454.CMB.1.raw
  modified_base (152)..(152): a, c, t, g, unknown or other
  misc_feature (152)..(152): n is a, c, g, or t
tcagatcagacacgcacgaccggtgctcgatttagctcgatatagttgggtttggggaggaactgctcagttaggacccagacggaaccatggaagccccagcgcagcttctcttcctctgctactctggctcccagactaccgttgggganatcgtagatgacgctagtctccagccactctgtctgtcgtcctaccgaggggagacgaccgccctaccttcgtccgtagccggtacggacctacggtacgaacggaaacttgttttacgggaactaccgttaaacgttacggcccgttaacgggtaaaccctaaaacgtaaaaacctcgggaccctaccgccctaccaacgtccctaccgtacttaactttcgtaccgttacaaccgtcccaaccggcggtcctacgtacggtactccggtacccaaacgtacgtacgttaccgtagggtcggtacgtaacggggtaccggggtttacggaacgggttaacccgtaaaccggttaccgtttaccgggtaaccgggtttacccgtacccctaaaaccgtaccggtttaccgaaccgggtacgttaaacccgggtaaccggttaaccttaccggggtttaaaaccgtaaacgggttaaccgggtttaccggttttaaccggggtaaccgtttttaacgggttttttaaacccgtaacgtttaaacccggtttaaccgtaaaacgtttaaccggggtttaagggttacccggggtttaaagtccccggggtttaaccggtttacccggtaaaccccggggggttacccgttttaaccccggggaccccggttaacggggtaacctaacgggttacggtacgttaaaccgtaccggtacgtaacccggggttaccgttaacggtcgggtttccgaccggtacgtaccccggtaacttcggttaacggtttccctcccgtttaacccggg

SEQ ID NO: 91343 - DNA, 724 bp, Homo sapiens
  misc_feature: GYAE6OF01ETDRK.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagcctactcctgtctgtcgtcctccggaggggacgagacgccctaccctcctccgtggaccgacgggcctagtacaagtaactagttaggtacgacctaacgttacgtaccgtacggtaaccaaaaccaaaccgtcgaccaccgtccctaccgacgtaccttcctacttaactttacgtccttaccaccgtaccccgaacggaccgggtacctacgtacgtaacgtcccacccgaacctagtacgtacgacggtcggacgtacgggtacgggttacgacggacgtacgtaccttacgacgtcctaacacgtactacggactacgacgtaccgtaactaggttaccgtagtaacgtcgttcgtaactttacgtttactagttacgtaaacgtatacggttaggtcgtacgacggtacgtacgttaccgggtaacgtccccggacggacccgggtaccaacggtacgtacggtaactacgtaccgacgggtacgtacggtcggtacccgtcgtaccgtacccgaactttaccggtcttccggtccttcccgg

SEQ ID NO: 91344 - DNA, 817 bp, Homo sapiens
  misc_feature: GYAE6OF01AE6OJ.5.57.F02.1.454.CMB.1.raw
tcagatcagacacgcacgaccggtgctcgatttagctcgatatagttgggtttgggggaggaactgctcagttaggacccagacggaaccatggaacgccccagcgcagcttcttcttcctcctgctactcgtcggctacccagtacgttaccggttggggacgtattcggtgtagtacggaacgtcacgttcctccagcctatcctgtctgtcgtcgtacgggaggggagacgaccgccctaccctcctaccgtcggacgaccggggacctagtacgaacgtaacgttacggttaggaacgtaccttaaacgttaccggtacccgttaaaccggtaaacccaaaaaaccgaaaacccggtccggaaccctaaccgcccttaacccgacgttcccctacttaccttactttacgttacctaccaccgtaccccgacgacggtaccctacggtacgtaccctaccgtaacccaacgttacgtaacttacggacggtacggacggtaacgggtacgggtacggtacgggaactacggttaacctgtacccgtacgtaacctacgtagtaccgtacggtaacgcggtaacccgtaacgtcggttaaaccgtaagggttacctacgggttattaacgttttaaacgttttacgtaccgttaaccgtaaataacgttagttacggtaccggttacggcggttccggtacgtaaccgttccggggaccgtaaccggtagaccgttacgagggtcgtaaacgtcgggaaacgtcgtacgacgttgagtaccctagtacccgttataccgtgtaccgtttctacc

SEQ ID NO: 91345 - DNA, 682 bp, Homo sapiens
  misc_feature: GYAE6OF01ETYWS.5.57.F02.1.454.CMB.1.raw
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
  modified_base (278)..(278): a, c, t, g, unknown or other
  misc_feature (278)..(278): n is a, c, g, or t
  modified_base (371)..(371): a, c, t, g, unknown or other
  misc_feature (371)..(371): n is a, c, g, or t
  modified_base (395)..(395): a, c, t, g, unknown or other
  misc_feature (395)..(395): n is a, c, g, or t
  modified_base (412)..(412): a, c, t, g, unknown or other
  misc_feature (412)..(412): n is a, c, g, or t
  modified_base (608)..(608): a, c, t, g, unknown or other
  misc_feature (608)..(608): n is a, c, g, or t
  modified_base (674)..(674): a, c, t, g, unknown or other
  misc_feature (674)..(674): n is a, c, g, or t
tcagatcagacacgcacgaccggtgctcgatttagctcgatatagttgggtttggggaggaactgctcagttaggacccagacggaaccatggaagccccagcgcagcttctcttcctcctgcctactctggctcccaagtacttaccgggttggggatcttccgtagactggacgctagtcctccagccattcctggtctagtgtccncgaggggtanagaccgccctacccgttctaccgtgccgaagggccttaagccaagaactagtcggtacncttaaacgttcgcgtacgaaccaaacgaaacctcggccacgcctacccgatacctccttactattactcgtccatcccacgacggcctacgtnacctctacccacgtgtacttacgngcgcgtagtcggtacgngggacacggtcttacgacgtaccttaccgatacgtctaacgtacgaagttccctaagtacgttacgacgtacgttacgtcgttactagttttactggaacttctaacgacgtttgacgttcgtacgttccggaccgttagttacccgggaccccggtacgacccggggtacttaacggacggttgtaaccggttanaccgggtaacgtccggtagtccgggacggttcaacccggttcctaagtcccccttagttcccgttnttaccccg

SEQ ID NO: 91346 - DNA, 750 bp, Homo sapiens
  misc_feature: GYAE6OF01E2KGQ.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctgctcccagactaccggttgggganatcgtgatgacgcagtctccagccatcctgtctgtcgtctcgagggganagacgcccacctctctgcgacgggccagtcaagaactagttaggacgactaacgttacgtaccgtaacggtaaacccaaaactaaaacccgtcggacccacgtccctacccgacgtaccttccttaacttaattttaccgtccgtttaccaaccgttacccccgaaccggaccggtaccctacgtacggtaccgttcccggtaaacccccaaacgttacgtaaccgtttcggaacggttacgggacgtacggggtacggggtacgtacggggaactacggttaccttacgacgttcctaaccaacctacgacgacgtaccgacggtaccgtaagacgtacgtaagtaaccgtgttacggtaactttacgttttaactcgtaagtaacctaagttgttcggttacgtagaccggttacacccggttacggtaaccggttcccggaacgaacgggacctaagggtcggtaacgtactaccgtacggacggtacggaacgttgggccgtaacgcgttacccgacttaccgttcttaacggtcttaacccg

SEQ ID NO: 91347 - DNA, 755 bp, Homo sapiens
  misc_feature: GYAE6OF01BOYZQ.5.57.F02.1.454.CMB.1.raw
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagacgtaccggttggggacatcgtgatgacgcagtctcagccatcctgtctgtcgtcctcgagggagacgacgcccacctctcctggacgacggcagtcaaggaacngttaggagaccttaacgtacgccgtacgtaaaccaaacctaaaaaccgtcggaccaacgtccctacccgaacgtaccttacccttactaacttttacgtaccgtttaccaacttaccccgaaccgtcggacctacgtgaccttaccgacccaacctgtactaccgagtcggactagggaccggttgtacggactacgactcgtaacgtcctacgaactacgtcgtaacgacgtacgaccgttacgacgttacgtaaggtaaccgttagttaccgaactttaggttttaaccttacgttcgaaacgtaacgttaaggtttcgtaccgttacggaacggttacccggttacgtaaccgggttaccggttacccggtaacccggacgtaccgtaacgtacgggttaacgtacgtacgtaaccggtacgggtaaccccgtaggtttaccgggaacggttcgtaacccgtaccggtccctttaacccgggtctttcccgggttaccttaaccccgg

SEQ ID NO: 91348 - DNA, 812 bp, Homo sapiens
  misc_feature: GYAE6OF01E4O4N.5.57.F02.1.454.CMB.1.raw
  modified_base (151)..(151): a, c, t, g, unknown or other
  misc_feature (151)..(151): n is a, c, g, or t
  modified_base (204)..(204): a, c, t, g, unknown or other
  misc_feature (204)..(204): n is a, c, g, or t
  modified_base (223)..(223): a, c, t, g, unknown or other
  misc_feature (223)..(223): n is a, c, g, or t
tcagatcagacacgcacgaccggtgctcgatttagctcgatatagttgggtttggggagaactgctcagttagacccagaccggaaccatggaacgccccagcgcagcttctcttcctcctgctactctcgctcccagactcggttggganatcgtgatcgacgcagtctccagcctatcctgtctgtgtcgtccgagggacgngtacgccacccttctaccngacggaccggaccagtacgaacggtaaacctagttaggtacgacttaacttcggccgttacggaaaccctaaaacgtaaaaacccgtcggaccaccgtccctacccgtaacacccttcctacttacttttaccgttaccgttaccaacccgtaccccgaacggtcgggacccctagtacgtcgtcctacccggtaaccacgttacgtacgacggtcgacggaggtacggggtacctcgggaactacggtacctacgtacgtcccttacgacccttaggcctaagccgagttaccgagttacgacgttacgtaacgttacgttcgtacttacgttttactacgttacgtaaccgtaactagtttcggtaacgttccgttaaggtaccgggttacccctttaacgggtaacccgttccggggtaaaccccggaaccggggtaccctaaaccggttaggggtaaccttaaacgccggtttaaacccgggggcgtttaaccgggtaacccgggtttggccccggtttagtaccccggttaacccttaacccgggaccggtttttcccctttaaaccgtcccgtttttaccccg

SEQ ID NO: 91349 - DNA, 710 bp, Homo sapiens
  misc_feature: GYAE6OF01DOMBO.5.57.F02.1.454.CMB.1.raw
  modified_base (151)..(151): a, c, t, g, unknown or other
  misc_feature (151)..(151): n is a, c, g, or t
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagatacgttggganatcgtgatgacgcagtctccagccatcctgtctgtgtcctccgagggganagaccgcccaccctctccgtggacgacgggccaggtacaagtaactagtttgggacgactaaacgttagcctacggtaaaccaaaaccaaaaaccgtcggaccaacgccctacccgaacgtacctcctacttaactttactccgtttcaactcccaccgacggcccatacgtactcgtacccaacgacgtactacgacggtcggacgtacgggtagggtcggtagggacaacggtacgttacacgtttacctaccgaacctacgtaccgagacgtacggtacttacgacgttactaggtaacgtacgtacggtaactttagtttacgttactacgtaactaacgtacgttagtacggtacgaaggttccggacgttaccggtaaccgtttccggaccccgaagggtacccgaacggtacgtacggtactaggtacccgaaagggtccctaagggttcgtacggggtaccaacggtccgtaacctaacttcgttacggttcctttacccg

SEQ ID NO: 91350 - DNA, 685 bp, Homo sapiens
  misc_feature: GYAE6OF01AV0ES.5.57.F02.1.454.CMB.1.raw
  modified_base (361)..(361): a, c, t, g, unknown or other
  misc_feature (361)..(361): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatccgtgtctgtgtcctccgaggggagagacgcccacctctccgtgcgagggccagtcaacgactagttggacgactaacgttacgccgtacggtaaccaaaacgaaaaccgtcggaccacgccctaccaacgacctcctatactttactccgtaccactcccgacgcggtacccatcgtacncgtaaccccaacgtagtactcgtaggcgacgaggtcggtacggtacggacacgtactacgacgtctaccacctacgtacacgcgtaacgtagtacagttcgtaaggaacgttacgttagactttacgtttacttaacgtagtacctaaatacggttggtacggtacgtacgggtaccgtaccggtaccggtaacggttccccggaaccggtaacggacccgtagtaccggtacggtaaacgttaccgtacggaaccgggttaccgtaacgttcggggtccgtccgtacgtacccggtactacctttcgtccgtttccttacccg

SEQ ID NO: 91351 - DNA, 825 bp, Homo sapiens
  misc_feature: GYAE6OF01B43UY.5.57.F02.1.454.CMB.1.raw
  modified_base (755)..(755): a, c, t, g, unknown or other
  misc_feature (755)..(755): n is a, c, g, or t
  modified_base (786)..(786): a, c, t, g, unknown or other
  misc_feature (786)..(786): n is a, c, g, or t
tcagatcagacacgcacgaccggtgctcgatttagctcgatataggttgggttggggagaactgctcagttacggacccagacggaaccatggaacgccccagcgcagcttctcttcctcctgcctactcgtggcctacccgaggtacgtaccggttgggggaatatcgtaggatcgaccgctaggtcctcacgcctatcctggtctggtgtaccgtccggaggggacacgaccgcctaccctctcctggcgacggccaagtcgaagtacgttagttgggacctactaacgttacgccgttaacgtaaacccaaacaaaaccgtcggaccaccgtcccgtaccgaacgtaccgttcccttagttaactttaacccgtctacctaacgtccccgtaaccggtaccggccctaagtaccggtaacctttacccggaaccccaaacgtaacggttccttacggacggttcggaacggacggggtagggtaccgtaaggtacgtaacgtcgtttaccgacgtacctaccggtaccaagtaccgggactaacgtaccgtacggttaacctacggtaacgttaacggtaaacggtttaccggttaacgtacggttttaaacgttacggtttaccctagggtaaacctaaacgtttacgggttaggtaaccgggttaccgttacggtaccgggtaccccgtttaaacggggtaccccggttttcccgggaacccgtacgggtaacccacggttacggttaanaacccggtgtacccgggaaggacttaccggnggacttcgaccgttacacgttgtacgttcgtcccttacg

SEQ ID NO: 91352 - DNA, 642 bp, Homo sapiens
  misc_feature: GYAE6OF01DHSM7.5.57.F02.1.454.CMB.1.raw
  modified_base (165)..(165): a, c, t, g, unknown or other
  misc_feature (165)..(165): n is a, c, g, or t
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
  modified_base (250)..(250): a, c, t, g, unknown or other
  misc_feature (250)..(250): n is a, c, g, or t
  modified_base (383)..(383): a, c, t, g, unknown or other
  misc_feature (383)..(383): n is a, c, g, or t
  modified_base (401)..(401): a, c, t, g, unknown or other
  misc_feature (401)..(401): n is a, c, g, or t
  modified_base (534)..(534): a, c, t, g, unknown or other
  misc_feature (534)..(534): n is a, c, g, or t
  modified_base (603)..(603): a, c, t, g, unknown or other
  misc_feature (603)..(603): n is a, c, g, or t
  modified_base (630)..(630): a, c, t, g, unknown or other
  misc_feature (630)..(630): n is a, c, g, or t
tcagatcagacacgcacgaccggtgctcgatttagctcgatatagttgggtttggggaggaactgctcagttaggacccagacggaaccatggaagccccagcgcagccttctcttccctcctgctactctggctcccagactccggtgggacatcgtgatgacncagtctccagcctatcctgtctgtgtcctcgaggganacgacgccctacctctccngcgacggccagtacagtaactgttagganctaacgtgccgtacgaaaccaaaccaaaaccgtcgccacgccctccacgtacctcgtactatttacgtacctcactccacgacggcctagtctactccgaacccacgtatcgttcgagtcgagaggtgtacgngtacacgtctcgcgtacnccgagtctacgcgaacgtgacgttacgtacgcgttaagacgttaccgttggtactttagtttaactcgtacgtaacgtaactaggtttcgcgggttaactcggtccggtttacgtaacccgtcgggttacccnccgggttaagaccgtaaggtcgtaaagaccgttcaacgggaccgtacgttaacgggttcgaaccggttnacccgtacacccttgttaccccggttnttcccgtaaccg

SEQ ID NO: 91353 - DNA, 758 bp, Homo sapiens
  misc_feature: GYAE6OF01EUI54.5.57.F02.1.454.CMB.1.raw
  modified_base (154)..(154): a, c, t, g, unknown or other
  misc_feature (154)..(154): n is a, c, g, or t
  modified_base (172)..(172): a, c, t, g, unknown or other
  misc_feature (172)..(172): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtcnccagccatcctgtctgtgtctcgaggggtgagcgcccacctctctgccgagggccctagtcaagtaacgntttagggagactaaacgtttcgaccgttacggtaacccaaaaaccgtaaaaacccgtcggacctacggacccttacccgagtaaccccttcccttacttaacgtttacttccggtttacactaccccgaccggaacgggaccctaacgttaggtactttaccggaaccccaaaccgtacgttaacgtttaccgaaggttcggacgtaacgggtacggggttcgtaacgggggtaacctaacgttaacgtacgttaacgtcccttacggaaccctacgtacgaaccggacacgtaccgtaagacggtttactagggtaacgtcgtttaggtacgtttaacgttttataccctagtaactaaccgtagttacggtcgtaacgcggttacggtccgttacccgtaacgggttcccgtacccgggaacggtaacccgagtaccgggtagtaacgttacggacggtaaccggtacgtacggttcgaggtccctcgaccttacacgtttctacgttcgttac

SEQ ID NO: 91354 - DNA, 669 bp, Homo sapiens
  misc_feature: GYAE6OF01C965D.5.57.F02.1.454.CMB.1.raw
  modified_base (127)..(127): a, c, t, g, unknown or other
  misc_feature (127)..(127): n is a, c, g, or t
  modified_base (149)..(149): a, c, t, g, unknown or other
  misc_feature (149)..(149): n is a, c, g, or t
  modified_base (155)..(155): a, c, t, g, unknown or other
  misc_feature (155)..(155): n is a, c, g, or t
  modified_base (159)..(159): a, c, t, g, unknown or other
  misc_feature (159)..(159): n is a, c, g, or t
  modified_base (170)..(170): a, c, t, g, unknown or other
  misc_feature (170)..(170): n is a, c, g, or t
  modified_base (205)..(205): a, c, t, g, unknown or other
  misc_feature (205)..(205): n is a, c, g, or t
  modified_base (220)..(220): a, c, t, g, unknown or other
  misc_feature (220)..(220): n is a, c, g, or t
  modified_base (414)..(414): a, c, t, g, unknown or other
  misc_feature (414)..(414): n is a, c, g, or t
  modified_base (445)..(445): a, c, t, g, unknown or other
  misc_feature (445)..(445): n is a, c, g, or t
  modified_base (482)..(482): a, c, t, g, unknown or other
  misc_feature (482)..(482): n is a, c, g, or t
  modified_base (639)..(639): a, c, t, g, unknown or other
  misc_feature (639)..(639): n is a, c, g, or t
  modified_base (648)..(648): a, c, t, g, unknown or other
  misc_feature (648)..(648): n is a, c, g, or t
tcagatcagacacgcacgaccggtgctcgatttagctcgatatagttgggttgggggagaactgctcagttaggacccagacggaaccagtggaacgcccagcgcagtcttctctcctctgctactntggctccagactacggtggganatcgtnacgngacgtcagtcnccagcctagtcctgtactgtcgtcgacggaggganacgacgccctacctntcgcgacgtacggcaagtccgaagaagtagtttacggaacgtacctaaacgttacggtacccgtaacgtaaaaccaaaaccgtaaacgacgccaaccgtccaacgactaccttctaacttacttacggtactacgtaacgccgaacggactccgtacgtacgttaactaccgaccaaaactaggtccttaacgnggaacggacgtagggacgttcgaacggtaanacgtctacacgtctacgactagcgacagacgtgtacngttaacagtagtactacggtattacgttactataccgaagtactaagtggttagacgtaacggacgttccggaacggttacgaccgtaccggtacggacctaaggtactacggaactacggtaacgagggttaaccagggtcgtacgggtagtaccncccgtttanaccgttcttcgttcttacccg

SEQ ID NO: 91355 - DNA, 745 bp, Homo sapiens
  misc_feature: GYAE6OF01E34SA.5.57.F02.1.454.CMB.1.raw
  modified_base (157)..(157): a, c, t, g, unknown or other
  misc_feature (157)..(157): n is a, c, g, or t
  modified_base (686)..(686): a, c, t, g, unknown or other
  misc_feature (686)..(686): n is a, c, g, or t
  modified_base (714)..(714): a, c, t, g, unknown or other
  misc_feature (714)..(714): n is a, c, g, or t
  modified_base (726)..(726): a, c, t, g, unknown or other
  misc_feature (726)..(726): n is a, c, g, or t
tcagatcagacacgcacgaccggtgctcgatttagctcgatatagttggggtttgggggaggaactgctcagttaggacccagacggaaccatggaagccccagcgcagcttctcttccctcctgctactctggctcccagactaccggttgggganatcgtgatgacgcagtctccagccatcctgtctgtgtcctccgaagggggagacgagcccctaaccctcttacccgtggccgaagggggctaaaacgtccgaagaaactaggtttagggtaacgacctaaaccgtttagacccgtaacggtaaacccgaaaacctaaaaaccgtcggacccgaaccgtccccgtaccctaacgtacccttaccctacttacgttttacttaccgttacctaactaccccaacccggacgggacccaacgtacgacgttacccgtaacccaaccgtagtactacgtacggtcgacgtaagggtcgggttacgacgggtaacacggttaccttacgtacgtaccaccgtaccagtacctacgaccgtacgtacgtaacgtacgtacgtacggtaacgtacgttacggacttaacgttttacttacttaacgtactaaactaggttacgtagtacgtaggttaccgtacgtacgacccggttcggacccgaacgactacgtagtagcgtaancggtaacggcgtaacgtggtcggtaccncgtaacccgtanacttccgttcgttcttacg

SEQ ID NO: 91356 - DNA, 752 bp, Homo sapiens
  misc_feature: GYAE6OF01CAVDY.5.57.F02.1.454.CMB.1.raw
  modified_base (153)..(153): a, c, t, g, unknown or other
  misc_feature (153)..(153): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggtgggganatcgtgatcgacgcagtctccagccatcctgtctgtcgtccgtccggaggggagacgacgccctaccctcgtcctggaccgacgggccagtacaacggaactagttaggtacgtactaaaccgttagtccgtacgtaaacccaaaacaaaaaccgtcggacccaacgccctacccacgacctacctactactttacttccgttacacctacccgaaccgacgggccctactcggtacttaccaaccccgaaccagtaacttaccgaaggtcggacgtagggtacgggtcggtacgggaactaacgtaccgtcgtaacctcgtaactacctacgtaccgaacgaccgacgtacgtaacgtacgttaccgtaacggtaaacgtacggtttacgtacgtttaacgtttaacgtttacgtaccggttaactaaacgttacgttacgggacggttacggtaccggtcggtaccccgttacgggttaccggtacccggtaccggaaccggaccgtaggtcgtaacggaactaaccgggtacggaccggttaacgcggtcggttacgggacttacgaccctacgtaccgttcttacggttctccgg

SEQ ID NO: 91357 - DNA, 744 bp, Homo sapiens
  misc_feature: GYAE6OF01DVN66.5.57.F02.1.454.CMB.1.raw
  modified_base (209)..(209): a, c, t, g, unknown or other
  misc_feature (209)..(209): n is a, c, g, or t
tcagatcagacacgcacgaccggtgctcgatttagctcgatatagttgggttgggggagaactgctcagttaggacccagacggaaccatggaagccccagcgcagcttctcttcctcctgctactctggcctcccagacttaccggttggggatatcgtgatgacgtcagtctccagccattcctgtctgtcgtcctacggagggganacgtaccgcccacccttgtcccgaggaccggacgggacccagtccaaaggtaacctagtttacgggaacgtacctaaacgttcgaccgttacggtaaacccaaaacgtaaaaccgtccggaccctacgaccctaccgacgttacctcctacttatttactccgttactactaccgaccgtacggacctagtcgtacgttaccgaacccaacgtatacgttacgaggttcggacgacgggtacgggtcgacggtaactacggtaccttacgacgtacctaacgacctagtacacgaccgtaaggtacctaagtcgtacgttaacgacgttacgttagactttaagtttacgtactacgtaactaacgtattacggtacgtaggacgttacggtaccggttaaccgttcccggttacggacccgtacgggacctaacgggtcgggtacgtaaccgttacgacgggttaaacgggtacgtacggtagggtccggtacttaccgcgttaacccgttcgttacttggtaccctttacccg

SEQ ID NO: 91358 - DNA, 721 bp, Homo sapiens
  misc_feature: GYAE6OF01CA02H.5.57.F02.1.454.CMB.1.raw
  modified_base (155)..(155): a, c, t, g, unknown or other
  misc_feature (155)..(155): n is a, c, g, or t
tcagatcagacacgcacgaccggtgctcgatttagctcgatatagttgggtttgggggaggaactgctcagttaggacccagacggaaccatggaacgcccagcgcagcttctcttcctcctgctactctggctcccagactaccggttgggganatcgtgatgacgcagtctccagccatcctgtctgtgtctccgaggggagagacgcccacctctcctgcgacgggcctagtcaagtaactagttgggacactaacgttacgccgtacggtaaccaaaacgtaaaaccgtcggacccacgccctaccgagtacctcctactatttactcgtcactccgaaccgacggtacctacgtacgtacgtaccgtaccccaaacgtagtaactccgaaggtcggaaccaggggtacgggtacgtacggggactaacggtactttacgaacgtcctaaccgaacctagtaccgtacgaccgtagtacccgtaacgtagtacctaaggtaaacgttcgttacggtaacctttaggttttaaccttacggtagtaaacccgtaagtaacggttcgggttacgtacgtaccgggtacgtaaccggtcccgggttaaaccggttccggaacccggttacgggtaccaagtcggtacggacttacgcggtaaaggtaccggtagtcggtccggcgttacgacccgtacttacgttcttgttccttaaccg

SEQ ID NO: 91359 - DNA, 923 bp, Homo sapiens
  misc_feature: GYAE6OF01DOMKT.5.57.F02.1.454.CMB.1.raw
  modified_base (231)..(231): a, c, t, g, unknown or other
  misc_feature (231)..(231): n is a, c, g, or t
tcagatcagacacgcacgaccggtgctcgatttagctcgatatagttggggtttgggggaggaactgctcagttaggacccagacggaaccatgggaagccccagcgcagcttctcttcctcctgctactctcggcctcccagagtaccggttggggagatcgtgatcgacgcagtctccagcctatcctgtctgtgtcctcggaggggagagacgccctaccctctccgngcgtacggccagtcaacgaactagttaggactactaactacgtaccgtacggtaaaaccctaaaaccgaaaaccgtcggaccctaaccgcccacccgtaacgtacctttccctaacttacgttttacgttacccgttacgaacccttacccggaacccggtaaccggggtaccctaaccgttacggtaaccgttaaccccggtaaccccaaacctaaaggttacgttaacggacgggttccgggtaaccgaaggggtaccggggttcggttaacggggggaaaccttacgggttaaccctttacggaccgtttacccgaaccgtaaccgttaaccgtacggtaacgggacccgtaaaccggttcccggttaaaacgtacgggttacggtaaacgggttaaaccgggttaccgggtttaacggtaccgtttttaaacgttttaacgggtttaccttaaccggtttaaaccgaaagttttacggttacggttaccggggttaccgtacggggttacccgtaaccccggggtttaacccggggtttaacccggtacccggggacccggttaacccgggaacccgtaaacgggcggttaacgggtaacccttacggtaaccgggacgggtaaccgttacggtggggtaccctcggaactacccgtactttacgttccggttatttccccgtaaccg

SEQ ID NO: 91360 - DNA, 788 bp, Homo sapiens
  misc_feature: GYAE6OF01CD0JE.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagactaccggttggggagatcgtgatgacgcagtctccagccatcctgtctgtgtctcgaggggagagacgcccacctcgtcctgaccgaggaccagtacgaagaactagttagggacgactaaacgttacgtaccgttacggaaaccctaaaaccgtaaaaaccgtcggaccacgccctacccgaacgtaccttacccttacttaacttttacttaccgttacctactccccgtaaccgacggaccctaacgtacgtaccgttacctaaccccgtaaaccgaagttacttaccgtaacggtacggacggtaagggtacggggttacggtacgggaacgttaacggtaccttacgtaccgttacctaaccaaccgtaactacgaacgtaccgaaggtccgtaacgtacgttacggtaaggtaaacggtcgttagggtaccctttaagtttacttaacgtacgtaacgtaaagtacggttaggttaccggtaacgttacgggtacgggtaccccgttacgggtaaccgggttaaccccggacgaacggtaccgaaaccgggttacgtacggtaaactacggtccggtaaacgtaccggtaaggttccgggacgtaccgacgtacctaaccgagtttcttaccgttcgttacc

SEQ ID NO: 91361 - DNA, 817 bp, Homo sapiens
  misc_feature: GYAE6OF01EH7NK.5.57.F02.1.454.CMB.1.raw
  modified_base (156)..(156): a, c, t, g, unknown or other
  misc_feature (156)..(156): n is a, c, g, or t
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaactgctcagttaggacccagacggaaccatggaagccccagcgcagcttctcttccctcctgctactctggctcccagtataccggttgggganatcgtgatgacgcagtctcagccatcctgtctgtgtctccgagggganagacgcccacccttcgtccgtcggacgacggggaccctaaggtaccaagtaaaccgtagttttgggaacgacctaaaacgttttcggacccgttacgggtaaacccaaaaacccgtaaaaaaccgtcggacccaacgcccgtacccaacgtaacctcccttaccttaattttactccgtttacaccttaccccgaaccgacgggaccctactaggtactacccgtaaccccaaacgtacgtactttaccgagggttacggaccgtaaaggggtacggggttacggtaggggtacctaaacgttaccgttacgtacggttacccttaaccgaaccctacttaccgaacggtaccgtacgggtaaccttaacgtacggttacgtaaggaaaccgtttaccggtttggaacctttaagggtttttacttaaccgttacgtaaccaaacgttagttacggttacgtacgtacggttaccggtacccgtaacgggttaaccggttccggtaccgaaccggtaccaggtacggtagtacgtactaccggaaggtaccggtaagtcgggtacggtacctacgtaaccacccggttaatttccgttcgttacctttacccg

SEQ ID NO: 91362 - DNA, 693 bp, Homo sapiens
  misc_feature: GYAE6OF01BQQ1W.5.57.F02.1.454.CMB.1.raw
  modified_base (156)..(156): a, c, t, g, unknown or other
  misc_feature (156)..(156): n is a, c, g, or t
  modified_base (205)..(205): a, c, t, g, unknown or other
  misc_feature (205)..(205): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
tcagatcagacacgcacgaccggtgctcgatttagctcgatataggttggggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgcccacctctcctgcagggccagtcagacnttggancaacttagcctaggtaaccaaacaaaaccgtggaccagccacccagacctcctctatttatccgttcacgtccaccgagggcctactgactcgtaccccaaacgtacgtacttccaaggttcggacgtagggtaacggggttcgacgggaacacggtaacttcaacggttcctaccaccgacttcgaacgtccgtacgtacggtaaccagttaccgtaaggaaacgtaccgttaggaccgtttaagttttaactttaccgtaggttacctaaacgtagttacggtacggtacgtagggtcggtacccgttacgggtaaccggttcggtacccccgtaagggtacccaaggtacggtacggtacgttacgtccggaacggtaccggaacggttcggtacgggtacctaacggtaccctaccgtaacgttcgttaccgttcccttaaccg

SEQ ID NO: 91363 - DNA, 535 bp, Homo sapiens
  misc_feature: GYAE6OF01BNPRK.5.57.F02.1.454.CMB.1.raw
  modified_base (201)..(201): a, c, t, g, unknown or other
  misc_feature (201)..(201): n is a, c, g, or t
  modified_base (347)..(347): a, c, t, g, unknown or other
  misc_feature (347)..(347): n is a, c, g, or t
  modified_base (388)..(388): a, c, t, g, unknown or other
  misc_feature (388)..(388): n is a, c, g, or t
  modified_base (404)..(404): a, c, t, g, unknown or other
  misc_feature (404)..(404): n is a, c, g, or t
  modified_base (491)..(491): a, c, t, g, unknown or other
  misc_feature (491)..(491): n is a, c, g, or t
  modified_base (530)..(530): a, c, t, g, unknown or other
  misc_feature (530)..(530): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagataccgttggggagatcgtgatgacgcagtctccagccatcctgtctgtgtctccgagggganagacgcccaccctctcctgcagggccaggtcagaacatttggagcaaactttagcctggtaacccaaacaaaaaacctggaccaagcctacccagacctcctcatttactcgttcactccaccaggccaactgactgtcccaaccngacttcagtgacagagggtctagggacagacttcagtctanaccatcagcagcgtanacgtctagaagtcgttagctaagtttatactgtactaacaagtgtagtcaggtcggtacctacgaacgttcggcctacggacgacgngtaggactatcgagtcgactgtgactgcaccatctcgtnttacc

SEQ ID NO: 91364 - DNA, 844 bp, Homo sapiens
  misc_feature: GYAE6OF01EX69M.5.57.F02.1.454.CMB.1.raw
  modified_base (154)..(154): a, c, t, g, unknown or other
  misc_feature (154)..(154): n is a, c, g, or t
  modified_base (172)..(172): a, c, t, g, unknown or other
  misc_feature (172)..(172): n is a, c, g, or t
  modified_base (201)..(201): a, c, t, g, unknown or other
  misc_feature (201)..(201): n is a, c, g, or t
  modified_base (255)..(255): a, c, t, g, unknown or other
  misc_feature (255)..(255): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtcncagccatcctgtctgtgtctccgaggganagacgcccaccctctccgtcgacgacgggccagtacgaagaactagttggtaanccgtaaacgttcgacccgtacggtaaacccaaaacgtaaaaaccgtcggacccaaccgtccctacccgtaacgtaaccccttccttaactttaacttttacgttccgtttacctaacccgttaccccgaaccgtaccgggtaccctacgtaacggtacttaccccggtaaccccaaaccgttaggtaactttcccggtaaggggttaccggacccggttaaagggggtaacggggtttacccgggtaaaggggtacccctaacggttaacccggtttcgtaaaccggtccctttaaaccgaacccgtaagttacccaaggtcccgaacggttacccgtaagtaccggttaggtaacggtaaacgtttacggcggttaacgttaagttttacttacggtactaccaaagttacggtggtacggtacgtacgggttacgtacccggttcggttaacccggtaccgggtaccccggtaacgggacccgtaagtacgggtaacggtataccgggtaacgtaaccggggacctcgggttaggccggtaccccgttacaaccgttacctaggttccctttcgttctttaaccccg

SEQ ID NO: 91365 - DNA, 641 bp, Homo sapiens
  misc_feature: GYAE6OF01AH2NV.5.57.F02.1.454.CMB.1.raw
  modified_base (158)..(158): a, c, t, g, unknown or other
  misc_feature (158)..(158): n is a, c, g, or t
  modified_base (313)..(313): a, c, t, g, unknown or other
  misc_feature (313)..(313): n is a, c, g, or t
  modified_base (453)..(453): a, c, t, g, unknown or other
  misc_feature (453)..(453): n is a, c, g, or t
  modified_base (491)..(491): a, c, t, g, unknown or other
  misc_feature (491)..(491): n is a, c, g, or t
  modified_base (531)..(531): a, c, t, g, unknown or other
  misc_feature (531)..(531): n is a, c, g, or t
  modified_base (577)..(577): a, c, t, g, unknown or other
  misc_feature (577)..(577): n is a, c, g, or t
  modified_base (608)..(608): a, c, t, g, unknown or other
  misc_feature (608)..(608): n is a, c, g, or t
  modified_base (628)..(628): a, c, t, g, unknown or other
  misc_feature (628)..(628): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggcctcccagtacttaccggttgggganatcgtgatgacgcagtcctccagccactctgtctgtcgtctccgaggggagacgacgccctaccctctccgtgccgtacggacctagtaccgaagtaaccgtgttacgggtacacctaacgttacgtccttaacggaaacctaaaccgaaaccgngacccacgccctaccacgtacctcctactaatttcctcgtacacaccgaccgtacggacctagtcacgttccacccaactagtacgtcgagtcggacgtaggtgggtcgaggacttacgaccttgacgtcctacaccgtntacggacgcacgtacgacgtacgtactaggtaaccgtntacgttattacgttactatcgaactaagttcgtgtacggntacggtcgtaccgtacgttaccggtacgccgtaacggattaccggngtaggtaacaccgtaggacgactaggttcgngtacgtcgaccattcccgtnttcgtccgtaccg

SEQ ID NO: 91366 - DNA, 703 bp, Homo sapiens
  misc_feature: GYAE6OF01D4CLG.5.57.F02.1.454.CMB.1.raw
  modified_base (154)..(154): a, c, t, g, unknown or other
  misc_feature (154)..(154): n is a, c, g, or t
  modified_base (606)..(606): a, c, t, g, unknown or other
  misc_feature (606)..(606): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatggacgcagtctccagccattcctgtctgtgtcctcgaggggagagacgcccacctctcctggcgacgggccagtacagaactagtttggacgactaaacgttcgaccgtacggtaaccaaaacgtaaaaaccgtcggacccacgcctaccacgactcctctactttcttcttacacctccaccgacggccactcgactacgacccaacagtacttacgaggtcggacgacgggtacgggtcggtacgggaacctagtaccttacaggttaccctacacctatacgacgcgtaacgtaccgttaacgcgttacgtaaggtaacgtacgttggtaacctttaggttttacttacggtactactaaactagtttagggtcgtagtacggttaccggtaccgttaccggtaccggttcccgggaacccggtaacgggaccctaacggngggttaaccgtacgttaacgtaccggtaggggtaacctacgggttacggcggtacgttaccggacctacgttacttccggtttcttccgttaacccg

SEQ ID NO: 91367 - DNA, 774 bp, Homo sapiens
  misc_feature: GYAE6OF01AXLPI.5.57.F02.1.454.CMB.1.raw
  modified_base (156)..(156): a, c, t, g, unknown or other
  misc_feature (156)..(156): n is a, c, g, or t
  modified_base (174)..(174): a, c, t, g, unknown or other
  misc_feature (174)..(174): n is a, c, g, or t
  modified_base (206)..(206): a, c, t, g, unknown or other
  misc_feature (206)..(206): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggcctcccagagtaccggttgggganatcgtgatgacgcagtcnccagccatcctgtctgtgtcgtccgagggganagacgtccaccctctccgtgcgagggcctagtacaagaactagttcggacgacctaaacgttacgccgtaacggtaaaccaaaaccgtaaaaaccgtcggaccaacgtccctaacccgtaacgtacccttacctacttaacgttttacctaccgttacctaacctaccccgtaaccggaccgggtaccctaacgttacgtaccgtacccgtaaaccccaaaccgtaaggttaaccttacggacgtacggaccggaagggtacgggttacggacggtaaccacggtacttacgtacgttacctaccaacgtacgtacgaacgacgaacggtacgtaacgtaacgttcgtaaacggtaaagttccgttagtaacgtttaacggttttaactaaccggttacgtaaactaaacgtaagttcgggttaacgtacggtaacgggttccggtaccggttaaccgggtaccggtacccggtacgaaccgggtaacgacgtaggtacgtactacggtaaggtaccgaaggttacggtcgacggtcacgtacgaacttaccgtcttcgttcctaccg

SEQ ID NO: 91368 - DNA, 744 bp, Homo sapiens
  misc_feature: GYAE6OF01AWHQA.5.57.F02.1.454.CMB.1.raw
  modified_base (202)..(202): a, c, t, g, unknown or other
  misc_feature (202)..(202): n is a, c, g, or t
  modified_base (385)..(385): a, c, t, g, unknown or other
  misc_feature (385)..(385): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccaccctcctcctggcacgggccagtccaggaactgttgggacgactaaaccgttagacccttaggtaacccaaaacaaaaaccctgggaccacggccctacccagacctccctctacttttacgttccgttacactcccaaccgagggacccactagacttccgtaccccaaaccnggtacttacaaggttcggaccagggtacgggtccgtagggaaccagtaccgtttacgacgttcctaaccaaccgagttaccgaacgccgtaacgaccggttaacgtccggtacgttacgggtaaactaccggtttaggcccgtttaagttttacgtttaccgttaacgtaacctaaactaaggttccggttagggttaccgtacgtcgggttacccttccgggtaaccggttccgggaccccgtaacggggacctaccgaaggtccggtaaagttaccgtacggtaaacggcggttaaacgtcgggtcgggtaccttacgggaaccctaccgttacgtaccttcgggttcctttaccgg

SEQ ID NO: 91369 - DNA, 827 bp, Homo sapiens
  misc_feature: GYAE6OF01B4JAI.5.57.F02.1.454.CMB.1.raw
  modified_base (203)..(203): a, c, t, g, unknown or other
  misc_feature (203)..(203): n is a, c, g, or t
tcagatcagacacgcacgaccggtgctcgatttagctcgatatagttggggtttgggggaggaactgctcagttaggacccagacggaaccatggaagccccagcgcagcttctcttccctcctgctactctggctcccagataccggttggggagatcgtgatgacgcagtctccagccatcctgtctgtgtctcgaggganagacgcccaccctctccgtgcgacgggccagtcaagaactagttcggacacctaacttacgccgtacggtaacccaaaaccgtaaaaacccgtcggaccctaccggccctacccgacgacccttcccctataacttttactccgtttaccacttaccccaacccggtacgggaccctacgtacgtacgtaccccgtacccccgtaaacctacgttaacgttccgaaggttaccggacgtaacgggtacggggttacccggtacggggtaccgtaacggtacccgtttaactacccggttacctacccgtaacccgtacgttaccgaaccggtccgtaacggtacccgttaacgtaccggttacgtaacggaacgtttacccggttggttaaccgtttaacgtttttacgttaaccttaccggttaactaaaccggttaagttagggttaccgttacggtaccggttaccggtacccggttaacccggttacccgggttacccgggaacccgtaaccggggacccttaaccggtagggttaaccgtagtaccgttaacgggtaccgtacggtaacggtcgggtaccgtcgtaccgacgtaacctagttcggttcctccgttaccg

SEQ ID NO: 91370 - DNA, 660 bp, Homo sapiens
  misc_feature: GYAE6OF01BIBSE.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (252)..(252): a, c, t, g, unknown or other
  misc_feature (252)..(252): n is a, c, g, or t
  modified_base (546)..(546): a, c, t, g, unknown or other
  misc_feature (546)..(546): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgccagggccagtccagtaactagttggaacncctaaacttcgccttacggtaacccaaaactaaaaaccgtcggacccaacgtccctacccgacgtaccttcctacttaagtttactccgttaccacgttaccccgaaccgacgggtacccacttacgaacgtttccgaacccctaacgacgtacttcgaggtcggacgtagggtacgggtcgtagggaactacgtccttgacgtctaccgacctactcgacgcaacggtccgtaacgtagtctaggtaacgtcgttggacttagtttacttatgtaacaagtagttgtcgtagngttaccgtccgtaacgtaccggttccgaccggacggtaccacggaggtagtactaacgtcggtaggtataccggtgtaccggcgtaaccgactacgtattccgctttcgtaccg

SEQ ID NO: 91371 - DNA, 696 bp, Homo sapiens
  misc_feature: GYAE6OF01BHD8D.5.57.F02.1.454.CMB.1.raw
  modified_base (154)..(154): a, c, t, g, unknown or other
  misc_feature (154)..(154): n is a, c, g, or t
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
tcagatcagacacgcacgaccggtgctcgatttagctcgatatagttggggttgggggaggaactgatcagttaggacccagacggaaccatggaagccccagcgcagcttctcttcctcctgctactctcggctcccagataccgttgggganatcgtgatgacgcagtcctaccgagcctatcctggtctgngtccncggagggganagcgcccaccctctcctagccgagggccagtcgaagtaactagttggacactaaacgttgaccctaacggaaacctaaaacgaaaaccgtcggaccacgacccttaccgacgtacctcctatactttacgtccttcaacgtacccacggacggcaccgtacgacgtacctacccaacgtacgtattaccgaggttacggacgaacgggtagggttacgaggggaactaacggtaccctttagaccgtttaccaaccgtaccgtactaccgaggaccggtacgttacgtaacccgtaagggttccctaaaggtaacgtacggtttggtaccttaaagggtttacttacgtacgtaaacaacgtagttcgggtactaggtcgtccgggtacctacggtaccggcctaacggacgtacgaccgtagtacgtctaacgcggtagacgtacgtggtacgacgtcgtactacccttagtcttagtcttacccg

SEQ ID NO: 91372 - DNA, 875 bp, Homo sapiens
  misc_feature: GYAE6OF01BIAK7.5.57.F02.1.454.CMB.1.raw
  modified_base (156)..(156): a, c, t, g, unknown or other
  misc_feature (156)..(156): n is a, c, g, or t
tcagatcagacacgcacgaccggtgctcgatttagctcgatatagttgggttgggggaggaactgctcagttaggacccagacggaaccatggaagccccagcgcagcttctcttcctcctgctactctcggctcccagactaccggttggggganatcgtgatcgacgcagtcctccagccatcctgtctgtcgtcctaccggaggggagacgacgcccacctctccgtcggacgacggacctagtacgaacgaactaggttggaacacgtaaccgttacgaccgtaacggaacctaaaaccaaaaccgtcgaccacgtaccctccaagtcctcctactaactttacgtccgttaactaccgtacccgaaccgtacggtacccagtacgtactaccgtacccaaacgtagtacctacgaggtacgcgtaaacggcggggtacgtacgggaaccgtaacggttaccttacgtaccgtaccctaaccgaaaccgtcgtaccgaaccgtaccggtaaacggtacccgttaaccgtacggtacgttacggaaaccggttacttacggggttaaacgtttaactttttaccgggttaaaccgttaggttaaaccctaaacggttttaggtacggggttttaaccgggtaccggtttaccggggtaaacccgttcccgggtaaccccgtaaccgggttttaccccggggaacctaaacccgggggttaccaccgggttaaccggttaacgggttaaacggttaaacccgtacggggtaaccgggttaacggtacgggttaacccgggacgggttacccgaaccgttacccgttaaacccggttaacccgttttccggtccgtttaaacccgttaccccgg

SEQ ID NO: 91373 - DNA, 762 bp, Homo sapiens
  misc_feature: GYAE6OF01BV6VP.5.57.F02.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggcctcccagactaccggttggggatatcggtgatgacgcagtctccagccatcctgtctgtcgtcncggagggganagcgccctacctctcctggcgacggccagtacaagtaactgttacggactacctaacgttcgcccgttaacggtaaacccaaaacctaaaacccgtcggacccacgtacccctacccagtacccttaccgttacttacttttacgtcgttaccaccttacccgaaccggtcgggaacctacgtacgtaccgttacccgaaccccgtaaacgtacgttacttacggaaggtcggaacggtaacggggtacggggttcggaacgggtaacgtaacgttaccgttcgacgtcctaaccaccgtagtacgcgtacgacggttacctaacgtaccggttcgtaaacggtaaggttaccggttcgggttaatttaacgggttttaacttaccggaacttaacgtaattaaggttcggtacgtacgtacgggtccgtacccttaacggggtaccgtcccgggaccgaggaccctaggtaggtacgtaagtaccgacggtaccgggtacgacggttcggctaacgggtcctaaccgtacttgtaccttccgttaccgttaccc

SEQ ID NO: 91374 - DNA, 702 bp, Homo sapiens
  misc_feature: GYAE6OF01CGGU9.5.57.F02.1.454.CMB.1.raw
  modified_base (106)..(106): a, c, t, g, unknown or other
  misc_feature (106)..(106): n is a, c, g, or t
  modified_base (152)..(152): a, c, t, g, unknown or other
  misc_feature (152)..(152): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgnagcttctcttcctcctgctactctggctccagatccggttgggganatcgtgatgacgcagtctcagccatcctgtctgtcgtccgtccgagggganagacgccctaccctctcctgacgcgggaccagtaccacgtaacgtaggtttacggaaccgtactaaaccgttacgtacccgttaacggtaaaccccaaaaacctaaaaacccgtcggaccctaccgaccctacccgacgtaccttccttctattttactccgttactacctacccaacggccggactcgtacacgtttcccgacccaacgtagtctacggacgtcgacggaagggtacgggttcgtacggtacgaggttcctcacggtttcacgactacgtacgacgacgtacgtaccgtacgtacgtacgtacgtaacgtcgtttaggactttaagttactttaaccgttgtaaacctattagttggtcgggtaacgttcggtaccggtcgttaacggggtcgtacccgacggaccgacggtactcggtacgtaactcgacggtcgaagttacggggtcgcggcaacgtccgactaccgtgtttccgttacttcccgg

SEQ ID NO: 91375 - DNA, 731 bp, Homo sapiens
  misc_feature: GYAE6OF01DZX1R.5.57.F02.1.454.CMB.1.raw
  modified_base (154)..(154): a, c, t, g, unknown or other
  misc_feature (154)..(154): n is a, c, g, or t
  modified_base (251)..(251): a, c, t, g, unknown or other
  misc_feature (251)..(251): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctcgaggggagagacgcccaccctctcctggcgacgggccagtcaagaactagttggacnctaacgttgccgtacggtaaccaaaactaaaaccgtggaccacgccctaccagtacctcctactatttactccgttacacctaccgaaccgacggtaccctactgtactccgtaaccccaaactagtacttccgagggtacggacgtaaggggtacggggtaccgtaggggaacctagtaccgttacgacgttccctaccgtaaccaacgtacgagtaccgacggtacccgtaacgtaggtaccgttaaggaaccgttacgttcggtaaccttttaaggtttaactttaccgtagtaactaaacgttagttaggttcgggtacgtacggttaccgggtacccggttacggttaacccgggttccggaaccccgtaacgggacccgaaggtacgggttacggtaaactcggtaacggacgggtaccgtaacggttgggtaccgtacgtacgacccgtaactcgttcttcggttcccttacg

SEQ ID NO: 91376 - DNA, 772 bp, Homo sapiens
  misc_feature: GYAE6OF01EJMBE.5.57.F02.1.454.CMB.1.raw
  modified_base (156)..(156): a, c, t, g, unknown or other
  misc_feature (156)..(156): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagagtaccggtttgggganatcgtgatgacgcagtcctccagccatcctgtctgtcgtctccgaggggagagacgcccaccctctccgtgcgacggccagtacaagtacgtagttggtagacctaacgttacgaccgtaggtaaacccaaaaccgtaaaacccgtcggaccctaaccgtcccgtaacccgacgtacccgttccttacttaacgttttacttaccggtttaccaacctaccccgaccggtaccgggtaccctacgttacgtacttacccgaaccccgaacgtaacgttactacgtacggtacggtacggtaagggtacggtacggtacgggacctaaggtactcgtacgtcctaccacgtactacgagtccgtacgtaccgtacgtacgtacgttaacggtaacgttacgttagtacgtttaacttttacgttaacgtagttaacccgtaaagttcgttacgggtacgtacggtaccggtacggttcccggtaacgggttaacccgggttccgacccgggtaacggtaccctagggtacgtacgtaacgtacgtaccgggtacgtaacggttcgtacgggacgtccgtacgtaccttaccgtagttcccttaggttccgttacccg

SEQ ID NO: 91377 - DNA, 734 bp, Homo sapiens
  misc_feature: GYAE6OF01CUHB9.5.57.F02.1.454.CMB.1.raw
  modified_base (163)..(163): a, c, t, g, unknown or other
  misc_feature (163)..(163): n is a, c, g, or t
  modified_base (269)..(269): a, c, t, g, unknown or other
  misc_feature (269)..(269): n is a, c, g, or t
  modified_base (708)..(708): a, c, t, g, unknown or other
  misc_feature (708)..(708): n is a, c, g, or t
tcagatcagacacgcacgaccggtgctcgatttagctcgatatagttggggtttgggggaggaactgctcagttaggacccagacggaaccatggaacgccccagcgcagtcttctcttcctcctgctactctcggcctcccagacgttaccggttggggganacttcggtgacgtcggaccggcacggttcctccgacgccctattcccgtgttcgttggttcgttacccgaccgggagggggagacgtaccgccctacccgtctccngccgacggccagtacaagtaacgtgttagacgactaacgttcgaccgttacgaaccaaaacgaacgtccggacaaccgtccacccgtactaccctactacttactttacctccgtcctactacccgaccgacgggtccctacgaccgttactacccgaacctacctaagtactacgcggttacggacgtacggggtacgtcggaaccgtactaacggtcttaccggtactcctaaccggaacttacgctaacgcgtacggaaccgtcgttaggtacccgagtaccgtacgttccggtaaattttccgggtatacgtaccacgtaagttgtcgtacggtacgacgggtaccgtacccggttacggtacccggaccgacggtacccggacctaggtagaccgtagtcggacggtaccggtctaggcggttcaacccggtanaccgttacgtcttccggtctccttcg

SEQ ID NO: 91378 - DNA, 701 bp, Homo sapiens
  misc_feature: GYAE6OF01ARWBH.5.57.F02.1.454.CMB.1.raw
  modified_base (686)..(686): a, c, t, g, unknown or other
  misc_feature (686)..(686): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctggctcccagataccggttggggagatcgtgatgacgcacgtctccacgccatcctgtctgtgtctccgaggggagacgacgccctacccgtctccgtgcgaacgggcctaagtacaagtaaactagttagggtaacgtaccgaaaccgtttacgacccgttaacggttaaaaccctaaaaaacctaaaaaacccgtgggaacccgaaccgtaaccctacccaacgtaacctaccccttacttactttacttacccgttacactaaccccacgacggcctacacggtataccgaccaacgagtactacaaggtacggacgaggtacgggtctagggaactaacgtaccttacgacgttccaacacgtataccgagaccaggtaccacgtatcgtagaacgtacgttacggattagttttaactacgtgtaaactaaggtacttggtacggtacaggtcgtaccgtacgtaacggttcggcccgaacgggtacctaagaggtcgtaaacgtacgtgacggggtaactaagttcggagtccctaggtaccaacttacncgttgtcccttaacg

SEQ ID NO: 91379 - DNA, 802 bp, Homo sapiens
  misc_feature: GYAE6OF01C7B66.5.57.F02.1.454.CMB.1.raw
  modified_base (154)..(154): a, c, t, g, unknown or other
  misc_feature (154)..(154): n is a, c, g, or t
  modified_base (173)..(173): a, c, t, g, unknown or other
  misc_feature (173)..(173): n is a, c, g, or t
  modified_base (262)..(262): a, c, t, g, unknown or other
  misc_feature (262)..(262): n is a, c, g, or t
  modified_base (350)..(350): a, c, t, g, unknown or other
  misc_feature (350)..(350): n is a, c, g, or t
  modified_base (778)..(778): a, c, t, g, unknown or other
  misc_feature (778)..(778): n is a, c, g, or t
  modified_base (785)..(785): a, c, t, g, unknown or other
  misc_feature (785)..(785): n is a, c, g, or t
tcagatcagacacgcacgaccggtgctcgatttagctcgatatagttgggttgggggaggaactgctcagttaggacccagacggaaccatgggaagccccagcgcagcttctcttcctcctgctactctggcctcccagactaccgtgggganatcgtgatcgacgcagtcnccagccatcctgtctgtcgtcctccgaggggagacgacgcccaccctctcccgtgccgagggccacgtcaaggaactaggttcggaacnctaacgttacgtccgtaacggtaaacccaaaaccgaaaaaccgtcggaccctaaccggaccccgttacccaacgtaccttaccccttnttaaacgttttaacctcccgtttaaccacccttacccgaacccgggtacggaccctaagtcgtaaccggtccctaaaccccaaacgtaacgtaacttcggtacggttacggcggtaaacgggtacgggtccggtagggaactccggtaactttacccgacgtttcccaacctactactacgacgtactacggtccgtaaacgtcgtaacgtaagggtaacgttacggttaacgtaccgtttaagttttaaccgttacggaacgtaacctaaacgtttagtcggggttattaccggaggttaccgtcccggttaacgggttacccgttaccgggacccgtaacggtaccgtaagtacgggttacggaacgtttccgacgggacgggtaacgtaccggttaggggccaacgtcgtaaccccgtaacgttnttccggnggtttttccctacccgg

SEQ ID NO: 91380 - DNA, 859 bp, Homo sapiens
  misc_feature: GYAE6OF01BNV38.5.57.F02.1.454.CMB.1.raw
  modified_base (107)..(107): a, c, t, g, unknown or other
  misc_feature (107)..(107): n is a, c, g, or t
  modified_base (130)..(130): a, c, t, g, unknown or other
  misc_feature (130)..(130): n is a, c, g, or t
  modified_base (167)..(167): a, c, t, g, unknown or other
  misc_feature (167)..(167): n is a, c, g, or t
  modified_base (173)..(173): a, c, t, g, unknown or other
  misc_feature (173)..(173): n is a, c, g, or t
  modified_base (182)..(182): a, c, t, g, unknown or other
  misc_feature (182)..(182): n is a, c, g, or t
  modified_base (244)..(244): a, c, t, g, unknown or other
  misc_feature (244)..(244): n is a, c, g, or t
  modified_base (320)..(320): a, c, t, g, unknown or other
  misc_feature (320)..(320): n is a, c, g, or t
  modified_base (469)..(469): a, c, t, g, unknown or other
  misc_feature (469)..(469): n is a, c, g, or t
  modified_base (818)..(818): a, c, t, g, unknown or other
  misc_feature (818)..(818): n is a, c, g, or t
  modified_base (835)..(835): a, c, t, g, unknown or other
  misc_feature (835)..(835): n is a, c, g, or t
tcagatcagacacgcacgaccggtgctcgatttagctcgatataggttggggttgggggaggaactgctcagttacggaccagacggaaccagtggaacgcccagcncagcttctcttcctctgctactntcggctccagacgtaccggttggggacagtcgtagancggacncgacttccncgacgcctactccttgtctcggtcgtcgaaccgggaggggacacgccacctaccttctacgnggacggacggaccagtaccgagaagtcggttaaggactacgtaacgttcgaccgttaacgaaacctaaacgaaacnccggacaccgcctaccgtagtacccttctaacttaagttttaccgtaccggttaacacctaaccggaaccggtacggtacgtaccgtaacgtccgtaaaccgtcccctaagtaacgtacttacgggtacggtacgaccggttaacgggngggttacggaaccggtaacgtaacgttaccgttacgtaaccgggccttaaccgttaacgaaccttcgggggaactaacggtacccggttaaggtaaccgtaacgggtaccgttaaacgtacggttaaccgggttaccggtaacgtttaacggttttaacggtaaccttaacggtaaaccgttacggttaaacgttcggggttaaccgtaaccgggtccgtaacccgggtttacccgaaaccgggggttcccgtaaccgggtacgggtaaccccgtacgggtaaaccggttaggaacccggtttaacgaacggtaccggtacgggtaaacgtcgggtaacgccggtaacnccgggttaaacctcgtntttaccgctttaaccggttacccg

SEQ ID NO: 91381 - DNA, 945 bp, Homo sapiens
  misc_feature: GYAE6OF01E2Q85.5.57.F02.1.454.CMB.1.raw
  modified_base (155)..(155): a, c, t, g, unknown or other
  misc_feature (155)..(155): n is a, c, g, or t
  modified_base (176)..(176): a, c, t, g, unknown or other
  misc_feature (176)..(176): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctggctcccagagtaccgttgggganatcgtgatgacgcagtctccngcctatcctgtctgtgtcctcgagggagacgacgccaccctctccgtcgcgacgggaccagtaccgaacgaactagttggtacgtaccaacctttacggcccttacggtaaacccaaaacctaaaaaccgtcggacccaacggtccctacccgtaaccgtaccctcccttacttaacttttccttaccgtttaacctaaccgtacccgaacccggtaccgggtaccctaccgtacgttacgtacccgtaacccccgaaaccgtacgttacgttaccgtaacggtaccggtacgaacggggtaacggggttaccggtaccggggtaaccgtaacggttaccctttacggtaacccggtttaccctaaacccgtacccgttaaacggtcccgtaacggtaacccgaaccggttaacccgggtttaaccgtaccggtttaacggttaaaccgggtaaacggttttaaccgggtttcggtttaaaccggttttaaggtttttttaaacccgttaaccggttaaacgtttaaaaccccgtaaaggtttacggtttacccgggtttagggttaacccggttaacgggtttccccgggacccggtttaaacccggggttaaaccccgggttcccgggaacccccgggtaacgggttaaccctacgggttaacgggtacgttaaacgttacggttaaccggaccggggttaactaaccgggttcggtaccggtacgtacccgcgtaaaccgttacttcggttacgtttccccgtacc

SEQ ID NO: 91382 - DNA, 853 bp, Homo sapiens
  misc_feature: GYAE6OF01BHZF6.5.57.F02.1.454.CMB.1.raw
  modified_base (154)..(154): a, c, t, g, unknown or other
  misc_feature (154)..(154): n is a, c, g, or t
  modified_base (166)..(166): a, c, t, g, unknown or other
  misc_feature (166)..(166): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctgctcccagataccggttgggganatcgtgatgacncagtctccagccatcctgttctgtcgtctccggaggggagacgaccgccctacccttcgtcctaggccgacgggcctagtaccgaacgtaacgttagttaggtacacctaacgttcgtaccggtaacggtaaaccccaaaaaccgtaaaaccggtccggaccgtacctcccgtaccgacgtaccttaccttacttacgttttacttaccgttactaaccgtacccgaccggtacgggacctaacgtcgtactaccccggtaacccctaaacgtacgttaccgtacggtacgggtacggtaacggacgggttacggtaaccgggtccggtaacgttaaccgttaccgttacgtaccggtacctacccgtaacctaacgtaccgtaccggaaccgtaccgggtacccttaaacggtcgttaaccgggttaaacgtaacggtttaccggtacggttaaccgtttacgttttacgttacgtaacctaacggttaaacgtcgttacggttccggtaatcgggttaccgtccggttaaccgggtaacccggttcccgggtaacgaccgggtaacgtacggtaaacggtcgttaaacggtaccgtacggtaacgggttaacgttaccggtgggttagacccggtttaaccgacgttaacccggttattcccgtttaccggttctttaaccccgg

SEQ ID NO: 91383 - DNA, 798 bp, Homo sapiens
  misc_feature: GYAE6OF01A4DTL.5.57.F02.1.454.CMB.1.raw
  modified_base (154)..(154): a, c, t, g, unknown or other
  misc_feature (154)..(154): n is a, c, g, or t
  modified_base (166)..(166): a, c, t, g, unknown or other
  misc_feature (166)..(166): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacncagtctccagccattcctgtctgtcgtctaccgaggggacgagacgccctacccctctcctagcgagggccctagtccaagaactgttagggtacactaacgttagccctaggtaacccaaaacaaaaccctggacccacgccctacccacgtacctcctactattttactccgtttcactacccaccgacgggtccagtacgacttaccgtacccaaccagtacttcgaggtacggacgaggtacgggtcgtagggactacgtaccttcgacgttccgtaccaccgtataccgaagtacgacggtaccgttaacgtacggttaccgtaaggtaaccggttacgtttacgggtaaccgtttaaggtttttaaccttaacgttaccgttaaactaaaccggtttaggtttaggttaccgggttacgacgggtttacccggtacccgttaaccgggtaaccccgggttacccgggaccccgggtaacgggaaccccgttaagtaacggttacgggtaaacttaccgggtaaccggtacggggtaacccttaacggttggggtaacccggtacgttaccccggtaacccgtacgttaccggtttacccgtttcggttaccccgtttttaacccgg

SEQ ID NO: 91384 - DNA, 657 bp, Homo sapiens
  misc_feature: GYAE6OF02IREM8.5.57.F02.1.454.CMB.1.raw
tcagatcagacacgcacgaccggtgctcgatttagctcgatatagttgggtttggggaggaactgctcagttaggacccagacggaaccatggaagccccagcgcagcttctcttcctcctgctactctggctccagataccggttgggagatcgtgatgacgcagtctccagccatcctgtctgtgtcctccgaggggagagacgcccaccctctcctgcgagggtcagtcaagaactagttggagactaaacttagccgttacggtaacccaaaaccaaaaaaccgtcgggacccaacggcccctaccccgaagaccttccctactaattttaactccgttacactcccaaccgacgggccactgatcgtacccaaccagacttcagtgcaggaggtcgtgggacagtacttcgagtctacaccatcgagcagcgtacagtctagaacgtacgttggacttaagtttacttactgtacaaactaagttggtacggtcaaggttcggtacccgttacggtaaccggtttccgggaccccgtaaggggacccaaacgtaggtacggtattacgtaccgaagggaccgtaaacggttcgggtacgggtaccgttacggaccctaacccgtaacgttccgtttacggttccctttaccg

SEQ ID NO: 91385 - DNA, 497 bp, Homo sapiens
  misc_feature: GYAE6OF02GY5YU.5.57.F02.1.454.CMB.1.raw
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttagcctggtaccaacaaaacctggccagcctcccagactcctcatttatcgttcatccaccagggccactgatcgtcccaaccagattcagtgcagagggtctgggacagacttcagtctcaccatcagcagagtacagtctgaagcttggcagtttattactgtacaacaatgtgtcagtgcctcgaacgttcggcccagggaccacgagtggatagtcgaggcgaacgtgtggctgcaccatctgtcttc

SEQ ID NO: 91386 - DNA, 495 bp, Homo sapiens
  misc_feature: GYAE6OF02HFZ84.5.57.F02.1.454.CMB.1.raw
  modified_base (199)..(199): a, c, t, g, unknown or other
  misc_feature (199)..(199): n is a, c, g, or t
  modified_base (422)..(422): a, c, t, g, unknown or other
  misc_feature (422)..(422): n is a, c, g, or t
  modified_base (463)..(463): a, c, t, g, unknown or other
  misc_feature (463)..(463): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttgggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattaactgtcaacaatgnggtcagtggcctcgaaacgttgcccagggaccacagtgganatcagcgaactgtgctgcgaccatctgtcttc

SEQ ID NO: 91387 - DNA, 503 bp, Homo sapiens
  misc_feature: GYAE6OF02HQLO5.5.57.F02.1.454.CMB.1.raw
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtancaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtacaacaatgtggtcagtggcctcgaacgttcggcccagggaccacgagtggatagtcgaaggcgaactgtggctgcaccatctgtcttc

SEQ ID NO: 91388 - DNA, 499 bp, Homo sapiens
  misc_feature: GYAE6OF02GQR97.5.57.F02.1.454.CMB.1.raw
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacatgtggtcagtggcctcgaacgttcggcccagggccacagtggatatcgaaggcgaacgtgtggctagcaccatctgtcttc

SEQ ID NO: 91389 - DNA, 497 bp, Homo sapiens
  misc_feature: GYAE6OF02JEK62.5.57.F02.1.454.CMB.1.raw
  modified_base (200)..(200): a, c, t, g, unknown or other
  misc_feature (200)..(200): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttgggctagtttattactgtcaacaatgtggtcagtggcctcgaacgttcgccagggaccagagtgatatcgaggcgaactgtggctgcaccatctgtcttc

SEQ ID NO: 91390 - DNA, 497 bp, Homo sapiens
  misc_feature: GYAE6OF02ILTDC.5.57.F02.1.454.CMB.1.raw
  modified_base (419)..(419): a, c, t, g, unknown or other
  misc_feature (419)..(419): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttgcctggtaccaacaaaaacctggccagcctcccagactcctcatttatcgttcatccaccagggccactgatcgtcccaaccagattcagtggcagagggtctgggacagacttcagtctcaccatcagcagcgtacagtctgaagacttggctagtttattactgtacaanatgtgtcagtgcctcgaacgttcgcccagggaccacgagtgatagtcgaggcgaactgtcggctgcaccatctgcttc

SEQ ID NO: 91391 - DNA, 493 bp, Homo sapiens
  misc_feature: GYAE6OF02JB4F9.5.57.F02.1.454.CMB.1.raw
  modified_base (240)..(240): a, c, t, g, unknown or other
  misc_feature (240)..(240): n is a, c, g, or t
  modified_base (327)..(327): a, c, t, g, unknown or other
  misc_feature (327)..(327): n is a, c, g, or t
  modified_base (484)..(484): a, c, t, g, unknown or other
  misc_feature (484)..(484): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggancaacttagcctggtaccaacaaaaacctggccagcctcccagactcctcatttatcgttcatccaccaggccactgatgtcccaacngattcagtgcagagggtctgggacagacttcagtctcaccatcagcagcgtacagtctgaagacttggctagtttattactgtacaacaatgtgtcagtgcctcgaacgttcggccagggaccacgagtggatagcgaaggcgaatgtgctgcaccntctgtctcg

SEQ ID NO: 91392 - DNA, 489 bp, Homo sapiens
  misc_feature: GYAE6OF02I3JDZ.5.57.F02.1.454.CMB.1.raw
  modified_base (200)..(200): a, c, t, g, unknown or other
  misc_feature (200)..(200): n is a, c, g, or t
  modified_base (296)..(296): a, c, t, g, unknown or other
  misc_feature (296)..(296): n is a, c, g, or t
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
  modified_base (486)..(486): a, c, t, g, unknown or other
  misc_feature (486)..(486): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttancgttcatccaccagggccactgatgtcccaaccagattcagtggcagagggtctgggacagacttcagtctcaccatcagcagcgtacagtctgaagacttgggcagtttattactgtcaacaatgtggtcagtggcctgaacgttcgccagggaccangtgatancgaggcaatgtgctgcacatctgnttc

SEQ ID NO: 91393 - DNA, 489 bp, Homo sapiens
  misc_feature: GYAE6OF02I32V5.5.57.F02.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (239)..(239): a, c, t, g, unknown or other
  misc_feature (239)..(239): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctntcctgcagggccagtcagacattggancaacttagcctggtaccaacaaaaacctggccagcctcccagactcctcatttatcgttcatccaccaggccactgatgtcccaaccagattcagtggcagaggtctgggacagacttcagtctcaccatcagcagcgtacagtctgaagacttggcagtttattactgtacaacaatgtgtcagtcgctgacgttcgccaggccacagtcgatagtcgaggcgaacgtgtggctgcaccatctgtcttc

SEQ ID NO: 91394 - DNA, 492 bp, Homo sapiens
  misc_feature: GYAE6OF02G1OWO.5.57.F02.1.454.CMB.1.raw
  modified_base (200)..(200): a, c, t, g, unknown or other
  misc_feature (200)..(200): n is a, c, g, or t
  modified_base (416)..(416): a, c, t, g, unknown or other
  misc_feature (416)..(416): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccaggccactgatgtcccaaccagattcagtggcagagggtctgggacagacttcagtctcaccatcagcagcgtacagtctgaagacttggcagtttattactgtcaanatgtgtcagtgcctgaacgttcgcccagggaccacgagtgatagtcgaggcaactgtggctgcaccatctgtcttc

SEQ ID NO: 91395 - DNA, 497 bp, Homo sapiens
  misc_feature: GYAE6OF02G5B8E.5.57.F02.1.454.CMB.1.raw
  modified_base (296)..(296): a, c, t, g, unknown or other
  misc_feature (296)..(296): n is a, c, g, or t
tcagatcagacacgcacgaccggtgctcgatttagctcgatatagttgggtttggggaggaactgctcagttaggacccagacggaaccgatggaagccccagcgcagcttctcttcctcctgctactctggctcccagataccgttggggagatcgtgatgacgcagtctccagccatcctgtctgtgtctccaggggacagagccaccctctcctgcagggccagtcagaacattggagcaacttagcctggtaccaacaaaaacctggccagcctcccagactcctcatttancgttcatccacaggccactgatgtcccaaccagattcagtggcagagggtctgggacagacttcagtctcaccatcagcagcgtacagtctgaagacttggcagtttattactgtcaacaatgtggtcagtgcctgaacgttcggcccagggaccacgagtggatagtcaggcaactgtacggctgcaccatctgtcttcg

SEQ ID NO: 91396 - DNA, 499 bp, Homo sapiens
  misc_feature: GYAE6OF02G1440.5.57.F02.1.454.CMB.1.raw
  modified_base (212)..(212): a, c, t, g, unknown or other
  misc_feature (212)..(212): n is a, c, g, or t
  modified_base (296)..(296): a, c, t, g, unknown or other
  misc_feature (296)..(296): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctntcctgcagggccagtcagaacattggtagcaacttagcctggtaccaacaaaaacctggccagcctcccagactcctcatttancgttcatccaccagggccactgatgtcccaaccagattcagtggcagagggtctgggacagacttcagtctcaccatcagcagcgtacagtctgaagacttggctagtttattactgtacaacaatgtggtcagtgcctcgaacgttcgcccagggaccacgagtggatagtcgaggcgaactgtgcgtgcacatctgtcttc

SEQ ID NO: 91397 - DNA, 535 bp, Homo sapiens
  misc_feature: GYAE6OF02JSCAA.5.57.F02.1.454.CMB.1.raw
  modified_base (207)..(207): a, c, t, g, unknown or other
  misc_feature (207)..(207): n is a, c, g, or t
  modified_base (299)..(299): a, c, t, g, unknown or other
  misc_feature (299)..(299): n is a, c, g, or t
  modified_base (311)..(311): a, c, t, g, unknown or other
  misc_feature (311)..(311): n is a, c, g, or t
  modified_base (328)..(328): a, c, t, g, unknown or other
  misc_feature (328)..(328): n is a, c, g, or t
  modified_base (381)..(381): a, c, t, g, unknown or other
  misc_feature (381)..(381): n is a, c, g, or t
  modified_base (404)..(404): a, c, t, g, unknown or other
  misc_feature (404)..(404): n is a, c, g, or t
  modified_base (513)..(513): a, c, t, g, unknown or other
  misc_feature (513)..(513): n is a, c, g, or t
tcagatcagacacgcacgaccggtgctcgatttagctcgatatagttgggtttgggggtagggaacgtggcgtcagttaggacccagacggaaccgatggaagccccagcgcagcttctcttcctcctgctactctggctcccagactaccgttggggagatcgtgatgacgcagtctccagccatcctgtctgtgtctccaggggnagagccaccctctcctgcagggccagtcagaacagttggtagcaacttagctggtaccacaaaactggccagcctcccagactcctcattancgttcatccacnggccatgatctccaacngattcagtgcaggaggtctcggggacagacgttcaggtctcacctatcgagcngctacagtctgaagtctaggacngtttaattcagttcaactaatgtggtacacgtgcctaggaacgtttccggaccgtacggaccaacgacgtaggatacgtcgaacgggcaacgtcggtcgacgttcgacncccaagtccgttcgctttaccg

SEQ ID NO: 91398 - DNA, 499 bp, Homo sapiens
  misc_feature: GYAE6OF02GK90F.5.57.F02.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctntcctgcagggccagtcagaacattggagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggctagtttattactgtcaacatgtgtcagtgcctcgaacgttcggcccagggaccacgagtgatactcgaggcgaactgtggctgccactctcgtctctac

SEQ ID NO: 91399 - DNA, 501 bp, Homo sapiens
  misc_feature: GYAE6OF02GT7NJ.5.57.F02.1.454.CMB.1.raw
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggacagtttattactgtcaactaatgtgtcagtggcctcgaacgttcggcccagggaccacagtgatatcgaaggcgaactgtgcgtgcaccatcgtgtcttac

SEQ ID NO: 91400 - DNA, 497 bp, Homo sapiens
  misc_feature: GYAE6OF02FUFQY.5.57.F02.1.454.CMB.1.raw
  modified_base (201)..(201): a, c, t, g, unknown or other
  misc_feature (201)..(201): n is a, c, g, or t
  modified_base (297)..(297): a, c, t, g, unknown or other
  misc_feature (297)..(297): n is a, c, g, or t
  modified_base (479)..(479): a, c, t, g, unknown or other
  misc_feature (479)..(479): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttancgttcatccaccagggccactgatgtcccaacagattcagtgcagagggtctgggacagacttcagtctcacatcagcagcgtacagtctagaagacttggctagtttattactgtacaacatgtgtcagtgcctcgaacgttcgaccaggaccacgagtggatatcgaggcgaactgtcgntcgctacatctgtctacg

SEQ ID NO: 91401 - DNA, 497 bp, Homo sapiens
  misc_feature: GYAE6OF02GW1PA.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccagggccactgatgtcccaaccagattcagtggcagaggtctgggacagacttcagtctcaccatcagcagctacagtctgaagacttggctagtttattactgtcaacaatgtggtcagtgcctcgaacgttcggcccagggaccagagtgatatcgaggcgaactgtggctgcaccatctgtctacg

SEQ ID NO: 91402 - DNA, 495 bp, Homo sapiens
  misc_feature: GYAE6OF02F9AVN.5.57.F02.1.454.CMB.1.raw
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttggggtttgggggaggaactgctcagttaggacccagacggaaccatggaagccccagcgcagcttctccttcctcctgctactctggctcccagataccgttggggagatcgtgatgacgcagtctccagccatcctgtctgtgtctccagggganagagccaccctntcctgcagggccagtcagaacattggancaacttgcctggtaccaacaaaaacctggccagcctcccagactcctcatttatcgttcatccaccagggccactgatgtcccaaccagattcagtgcagagggtctgggacagacttcagtctcacatcagcagcgtacagtctgaagcttggactagtttattactgtacaatatgtgtcagtgcctgaacgttcgccaggaccagagtgatagcgaggacgaactggtgctgcaccatcctgtccttcg

SEQ ID NO: 91403 - DNA, 493 bp, Homo sapiens
  misc_feature: GYAE6OF02G33EI.5.57.F02.1.454.CMB.1.raw
  modified_base (200)..(200): a, c, t, g, unknown or other
  misc_feature (200)..(200): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacatgtgtcagtggcctcgaacgttcgcccgagggacccagagtgatatcgaggcgaactgtgctgcacatctgtctc

SEQ ID NO: 91404 - DNA, 504 bp, Homo sapiens
  misc_feature: GYAE6OF02JBBS1.5.57.F02.1.454.CMB.1.raw
  modified_base (417)..(417): a, c, t, g, unknown or other
  misc_feature (417)..(417): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggtagcaacttagcctggtaccaacaaaaacctggccagcctcccagactcctcatttatcgttcatccaccaggccactgatgtcccaaccagattcagtggcagagggtctgggacagacttcagtctcaccatcagcagcgtacagtctgaagcttggctagtttatactgtcaanaatgtggtcaggtgcctcgaacgttcgacccagggaccacagtgatagtcaggcaacgtgtcggctggcaccgtatcctgtcttacg

SEQ ID NO: 91405 - DNA, 506 bp, Homo sapiens
  misc_feature: GYAE6OF02I4YKD.5.57.F02.1.454.CMB.1.raw
  modified_base (201)..(201): a, c, t, g, unknown or other
  misc_feature (201)..(201): n is a, c, g, or t
  modified_base (384)..(384): a, c, t, g, unknown or other
  misc_feature (384)..(384): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaacctggccagcctcccagacctcctcatttatcgttcatccaccaggccactgatcgtcccaaccagattcagtggcagagggtctgggacagacttcagtctcacatcagcagctacngtcagagacttggctagttattactgtacaacatgtggtcagtgcctagacgttcggcccaggacccacagttaggatactcgacggacgtaacgtgtggcctgccaccatcgtggtcttcg

SEQ ID NO: 91406 - DNA, 496 bp, Homo sapiens
  misc_feature: GYAE6OF02GJXMG.5.57.F02.1.454.CMB.1.raw
  modified_base (200)..(200): a, c, t, g, unknown or other
  misc_feature (200)..(200): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccagggccactgatgtcccaacagattcagtggcagagggtctgggacagacttcagtctcacatcagcagcgtacagtctgaagacttggctagtttatactgtcaactatgtggtcagtgcctgacgttcgccaggccagagtgatagtcgaggtcgaacgtgtggtctgccaccgatcgttgtcttc

SEQ ID NO: 91407 - DNA, 516 bp, Homo sapiens
  misc_feature: GYAE6OF02I7DAN.5.57.F02.1.454.CMB.1.raw
  modified_base (203)..(203): a, c, t, g, unknown or other
  misc_feature (203)..(203): n is a, c, g, or t
  modified_base (243)..(243): a, c, t, g, unknown or other
  misc_feature (243)..(243): n is a, c, g, or t
  modified_base (301)..(301): a, c, t, g, unknown or other
  misc_feature (301)..(301): n is a, c, g, or t
tcagatcagacacgcacgaccggtgctcgatttagctcgatatagttgggtttggggaggaactgctcagttaggacccagacggaaccatggaagccccagcgcaagcttctcttccctcctgctactctggctcccagataccgttggggagatcgtgatggacgcagtctccagccatcctgtctgtgtctccagggganagagccaccctctcctgcagggccagtcagaacattgganctaacttagccttggtaccaacaaaaacctggaccagcctcccagactcctcatttancgttcatccaccaggccactgatcgtcccaacagattcagtcggcagtacggtctgggacagacttcagtctcaccatcagcagcgtacagtctagaagtacttggctagtttatactgtacaacaatgtgtcagtgcctgacgttcgccagggacccagagtggatacgtcgacggcgtaacgtgtaggcttacgcaccgatccgtgtccttac

SEQ ID NO: 91408 - DNA, 504 bp, Homo sapiens
  misc_feature: GYAE6OF02IVFML.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggctagtttattactgtacaactaatgtgtcagtgcctcgaacgttcggccagggaccacgagtggatatcgaaggcgaactgtacggctgccaccatctgtcttc

SEQ ID NO: 91409 - DNA, 491 bp, Homo sapiens
  misc_feature: GYAE6OF02IRHTX.5.57.F02.1.454.CMB.1.raw
  modified_base (451)..(451): a, c, t, g, unknown or other
  misc_feature (451)..(451): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccacaggccactgatcgtcccaacagattcagtggcagagggtctgggacagacttcagtctcaccatcagcagcgtacagtctagaagacttggcagtttattactgtcaactatgtgtcagtgcctcgacgttcgccaggccagngtgatatcgaggcgaacgtgtggctgcaccatctgtcttc

SEQ ID NO: 91410 - DNA, 512 bp, Homo sapiens
  misc_feature: GYAE6OF02GYU1A.5.57.F02.1.454.CMB.1.raw
  modified_base (201)..(201): a, c, t, g, unknown or other
  misc_feature (201)..(201): n is a, c, g, or t
  modified_base (297)..(297): a, c, t, g, unknown or other
  misc_feature (297)..(297): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttancgttcatccaccagggccactgatcgtcccaacagattcagtgcagagggtctgggacagacttcagtctcaccatcagcagcgtacagtctgaagacttggctagtttattactgtacaacaattgtggtcaggtcggcctcgaacgttcggacccagggacccacgagtcggatacgtcgaggacgacgtgtcggctgcaccatctgtcttcg

SEQ ID NO: 91411 - DNA, 500 bp, Homo sapiens
  misc_feature: GYAE6OF02FZYQK.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctggtaccaacaaaaacctggccagcctcccagactcctcatttatcgttcatccaccagggccactgatgtcccaaccagattcagtggcagagggtctgggacagacttcagtctcacatcagcagcgtacagtctgaagtacttggctagtttattactgtacaacaatgtggtcagtggcctgaacgttcggcccagggaccagagtgatatcgaggcgtaactgtgctggcaccatctcgtcttc

SEQ ID NO: 91412 - DNA, 497 bp, Homo sapiens
  misc_feature: GYAE6OF02GEB33.5.57.F02.1.454.CMB.1.raw
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtgcctcgaacgttcggcccagggaccacagtggatatcgaaggcgaactgtggctgcaccatctgtctc

SEQ ID NO: 91413 - DNA, 491 bp, Homo sapiens
  misc_feature: GYAE6OF02IHZOD.5.57.F02.1.454.CMB.1.raw
  modified_base (200)..(200): a, c, t, g, unknown or other
  misc_feature (200)..(200): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccaggccactgatgtcccaaccagattcagtgcagaggtctgggacagactcagtctcaccatcagcagcgtacagtctgaagacttggctagtttattactgtacaactaatgtggtcagtgcctcgaacgtcgccaggacacagtgatatcgaggcgactgtgctcgcaccatctcgtcttac

SEQ ID NO: 91414 - DNA, 508 bp, Homo sapiens
  misc_feature: GYAE6OF02HT58B.5.57.F02.1.454.CMB.1.raw
  modified_base (201)..(201): a, c, t, g, unknown or other
  misc_feature (201)..(201): n is a, c, g, or t
  modified_base (463)..(463): a, c, t, g, unknown or other
  misc_feature (463)..(463): n is a, c, g, or t
  modified_base (490)..(490): a, c, t, g, unknown or other
  misc_feature (490)..(490): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaaacaaaaacctggccagcctcccagactcctcatttatcgttcatccaccagggccactgatgtcccaaccagattcagtggcagagggtctgggacagacttcagtctcaccatcagcagcgtacagtctgaagacttggctagtttattactgtacaacaatgtggtacagtggcctcgaacgttcggcccagggacccanagtggatatcgaaggcgaactgtcggntgcacctatcttgtcttc

SEQ ID NO: 91415 - DNA, 509 bp, Homo sapiens
  misc_feature: GYAE6OF02H1BP4.5.57.F02.1.454.CMB.1.raw
  modified_base (415)..(415): a, c, t, g, unknown or other
  misc_feature (415)..(415): n is a, c, g, or t
  modified_base (482)..(482): a, c, t, g, unknown or other
  misc_feature (482)..(482): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatcgtcccaaccagattcagtggcagagggtctgggacagacttcagtctcaccatcagcagcgtacagtctgaagtcttggctagtttattacgtntacaactaatgtggtcagtcggcctcgaacgttcggcccagggaccacgagtaggatatcggggaancggaactgtcgctgcaccatctgtctc

SEQ ID NO: 91416 - DNA, 496 bp, Homo sapiens
  misc_feature: GYAE6OF02I67X4.5.57.F02.1.454.CMB.1.raw
  modified_base (201)..(201): a, c, t, g, unknown or other
  misc_feature (201)..(201): n is a, c, g, or t
  modified_base (487)..(487): a, c, t, g, unknown or other
  misc_feature (487)..(487): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccaggccactgatgtcccaacagattcagtgcagagggtctgggacagacttcagtctcaccatcagcagcgtacagtctagaagacttggctagtttattactgtcaactaatgtgtcagtgcctcgaacgttcgccaggccacgagtaggatagtcgaggcgaacgtgtgctgcaccntctgtcttc

SEQ ID NO: 91417 - DNA, 939 bp, Homo sapiens
  misc_feature: GYAE6OF02J3DY1.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttggggaggaactgctcagttaggacccagacggaaccatggaacgccccagcgcagcttctcttcctcctgctactctggctcccagataccgttgggganatcgtgatgacgcagtctccagccatcctgtctgtgtctccgagggganacgacgcccacccttctccgtagccgacgggcccaaggtaccaaggtaacctagtttcgggtaacgacctaaaaccgtttacggaccccgttaacgggttaaaccccaaaacccgtaaaaaaaccccgttcggggaccccaaccggtacccccttaccccgaacggtaacccttccccttacttaactttttaaccttcccggttacctaaccgttacccccgaaccggtaaccgggggtacccctaaccgttacggtaacttccggtaacccccaaaccgtacggtaaccgtttccgaacgggttcggaccgtaacggggtacgggttccgtacggggaacctacggtaccttacgaacgttcctacccgaaccctacgtccgaacggtaccgtaacggtaccgttaaccgtacggtttaccgttaagggtaaaccggttaccgtttacgggaaccttttaaaggttttttaaacctaccgttacggttaaacctaaaaccgttaacggttcgggtttacgggtaccgttaacgggttaccgggttaccccgttaacccgggttaaacccgggtttcccgggaaccccgggtaaacgggtaacccgtaacgtaacgggttacggtaacttacggttaacccggaacgggttaccggtaaaccggttcgggttaccggtaccgttaccgggtaccctaaccgttactttacccgttacggtttaccctttaacccgg

SEQ ID NO: 91418 - DNA, 528 bp, Homo sapiens
  misc_feature: GYAE6OF02IRISK.5.57.F02.1.454.CMB.1.raw
  modified_base (417)..(417): a, c, t, g, unknown or other
  misc_feature (417)..(417): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaanatgtgtcagtggcctcgacgttcggcccagggacccagagtgggactagtccgagggtaccgaacgtggtcggaccttggaccgtacccgaagtccttaggtcctttaccg

SEQ ID NO: 91419 - DNA, 503 bp, Homo sapiens
  misc_feature: GYAE6OF02GDDO2.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggaccagcctcccagactcctcatttatcgttcatccaccagggccactgatcgtcccaaccagacttcagtggcagagggtctgggacagacttcagtctcaccatcagcagcgtacagtctagaagacttggctagtttattactgtacaactaatgtgtcagtgcctcgaacgttcggacccagggaccagagtgatatcgaggcgaactgtgctgcaccatctgtcttc

SEQ ID NO: 91420 - DNA, 499 bp, Homo sapiens
  misc_feature: GYAE6OF02IA6M4.5.57.F02.1.454.CMB.1.raw
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggctagtttattactgtacaacaatgtgtcagtggcctcgaacgttcgcccagggaccagagtgatatcgaggacgaactgtggactgcaccatctgtcttc

SEQ ID NO: 91421 - DNA, 509 bp, Homo sapiens
  misc_feature: GYAE6OF02HH8YC.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
  modified_base (382)..(382): a, c, t, g, unknown or other
  misc_feature (382)..(382): n is a, c, g, or t
tcagatcagacacgcacgaccggtgctcgatttagctcgatatagttggagtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgcagggccagtcagaacnttggagcaacttagcctggtaaccaaacaaaaactgccagcctccagactcctcatttatcgttcatccaccaggccactgatcgtcccaacagattcagtgcagaggtctgggacagacttcagtctcacatcagcagcgtanagtctagaagtacttggctagtttattactgtacaaacaatgtggtcagtcgacctcgaacgttccggcccagggaccacgagtcgatacgtcgaggcgtaactggtgctagcgtaccagtctagtc

SEQ ID NO: 91422 - DNA, 492 bp, Homo sapiens
  misc_feature: GYAE6OF02HE6ZY.5.57.F02.1.454.CMB.1.raw
  modified_base (201)..(201): a, c, t, g, unknown or other
  misc_feature (201)..(201): n is a, c, g, or t
  modified_base (418)..(418): a, c, t, g, unknown or other
  misc_feature (418)..(418): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccaggccactgatgtcccaaccagattcagtggcagagggtctgggacagacttcagtctcaccatcagcagcgtacagtctgaagacttggctagtttattactgtcaanatgtgtcagtgcctcgaacgttcgccaggaccacagtggatatcgaggcgaactgtgctgcaccatctgtcttc

SEQ ID NO: 91423 - DNA, 489 bp, Homo sapiens
  misc_feature: GYAE6OF02G8M6Q.5.57.F02.1.454.CMB.1.raw
  modified_base (242)..(242): a, c, t, g, unknown or other
  misc_feature (242)..(242): n is a, c, g, or t
  modified_base (417)..(417): a, c, t, g, unknown or other
  misc_feature (417)..(417): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtancaacttagcctggtaccaacaaaaacctggccagcctcccagactcctcatttatcgttcatccaccagggccactgatgtcccaaccagattcagtggcagaggtctgggacagacttcagtctcaccatcagcagctacagtctgaagacttggctagtttatactgtacaanatgtgtcagtgcctgaacgttcgcccagggaccagagtgatatcgaggcaactgtgctgcacgatctgtctc

SEQ ID NO: 91424 - DNA, 844 bp, Homo sapiens
  misc_feature: GYAE6OF02G204I.5.57.F02.1.454.CMB.1.raw
tcagatcagacacgcacgaccggtgctcgatttagctcgatataggtaggggttggggaggactgctcagttaggacccagacggaaccatggaaacgcccagcgcagtcttctcttcctcctgctactcgtgcctccagactaccggttggggaatatcgtgatcgacgcacgtcgtccacgcctattcctgtcctggtagtctccgaggggactacgacgccaccctcggtcctaggccgagggcctagtcacgaactacttacggtacgtcaaccttacggacctacggtaaccaaacctaaaaaccgtcggaccacgtcccgtcccacgtacctcctactaactttacgtaccgttactacttaccgaccgacggggccaaccgtggacttacgtaccccaaaccgacgtaacgtttccgaaggttcgggaccgaagggtacggggttccgttagggggaacctaacggtaacctttaccgaacggtttccttaccgaacccgtaacgtttcccgaacggaccgaaacggtacccgtttaaaccggtacgggttacccttaagggaaaacggttaccgttttacggggaacccttaagggtttttaacgtttaacgtttacgtttaaccgtaaaccgtaaagtttcggttaaggttaacgtagggttaccgggttacccgttaaccgggttaaacggggtttcccggttacccgggtaacgggtaacccggtaaacgtacgggtacggtacggttaacgtaccggtaacgggtaaccgtaaacgttcgggttacggaccgttcggacctaaccgtacttaccgttaggttcccttaaccg

SEQ ID NO: 91425 - DNA, 501 bp, Homo sapiens
  misc_feature: GYAE6OF02I523H.5.57.F02.1.454.CMB.1.raw
  modified_base (201)..(201): a, c, t, g, unknown or other
  misc_feature (201)..(201): n is a, c, g, or t
  modified_base (425)..(425): a, c, t, g, unknown or other
  misc_feature (425)..(425): n is a, c, g, or t
  modified_base (489)..(489): a, c, t, g, unknown or other
  misc_feature (489)..(489): n is a, c, g, or t
  modified_base (495)..(495): a, c, t, g, unknown or other
  misc_feature (495)..(495): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccagggccactgatgtcccaacagattcagtgcagaggtctgggacagacttcagtctcaccatcagcagctacagtctagaagacttggctagtttattatgtacaacaatgtagtnagtgcctcgaacgttcgcccgaggaccagagtgatacgtacgaggcacgtgtcggctgccaccntccgtntcttcg

SEQ ID NO: 91426 - DNA, 529 bp, Homo sapiens
  misc_feature: GYAE6OF02GO7S5.5.57.F02.1.454.CMB.1.raw
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccacctctcctgcagggccagtcagaacattggtagcaacttagcctggtaccaacaaaaacctggccagcctccagactcctcatttatcgttcactccaccgagggccactcgatcgtacccaaccagtacttcgagtcggacaggagggtcagggacagtactcagtctcaccatcagcagcgtacagtctagaagtcttaggctagtttattactgtacaactaagtgtagtcagtcggctacgaacgttcgaccgaggacccagagtgatacgtcgaaggccgtaacgtcggtcgtctcgccaccagttctcgtcttacg

SEQ ID NO: 91427 - DNA, 499 bp, Homo sapiens
  misc_feature: GYAE6OF02HTLTO.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggtgagatcgtgatgacgcagtctccagccatcctgtctgtgtctccagggganagagccaccctctcctgcagggccagtcagaacattggancaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggctagtttattactgtacaacaatgtggtcagtgcctcgaacgttcgcccgagggaccacgagtggatagtcgaggcgaactgtggctgcaccatctgtcc

SEQ ID NO: 91428 - DNA, 526 bp, Homo sapiens
  misc_feature: GYAE6OF02IDRDU.5.57.F02.1.454.CMB.1.raw
  modified_base (200)..(200): a, c, t, g, unknown or other
  misc_feature (200)..(200): n is a, c, g, or t
  modified_base (241)..(241): a, c, t, g, unknown or other
  misc_feature (241)..(241): n is a, c, g, or t
  modified_base (429)..(429): a, c, t, g, unknown or other
  misc_feature (429)..(429): n is a, c, g, or t
  modified_base (483)..(483): a, c, t, g, unknown or other
  misc_feature (483)..(483): n is a, c, g, or t
tcagatcagacacgcacgaccggtgctcgatttagctcgatatagttgggtttggggaggaacgtgctcagttaggacccagacggaaccatggaagccccagcgcagcttctcttcctcctgctactctggctcccagataccgttgggagatcgtgatgacgcagtctccagccatcctgtctgtgtctccagggganagagccaccctctcctgccagggccagtcagaacattggancaaacttagcctggtaccaacaaaaacctggaccagcctacccagactcctcatttatcgttcattccaccaggccactgatcgtacccaacagattacagtcgcacgaggtctggacagacttcagtctacaccatcagcacgcgtaacagtcctagaaagtacgttgctagtttatactgtacaanaatgtagtcagtgcctacgaacgttcgccacggacaccgagtcggatactacgngtacgaactcgtaggtcgtcgacacctagtctacgtcttaccg

SEQ ID NO: 91429 - DNA, 495 bp, Homo sapiens
  misc_feature: GYAE6OF02F9DSG.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaacaaaaacctggccagcctcccagactcctcatttatcgttcatccaccaggccactgatgtcccaacagattcagtggcagagggtctgggacagacttcagtctcaccatcagcagcgtacagtctagaagacttggctagtttattactgtacaacatgtgtcagtgcctcgaacgttcggcccaggaccacagtgatatcgaggcgaacgtgtggctgcaccatctgtcttc

SEQ ID NO: 91430 - DNA, 499 bp, Homo sapiens
  misc_feature: GYAE6OF02GOP9U.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggctagtttattactgtcaacaatgtggtcagtggcctcgaacgttcggcccaggaccagagtgatatcgaggcgaactgtggctgcaccatctgtcttcg

SEQ ID NO: 91431 - DNA, 490 bp, Homo sapiens
  misc_feature: GYAE6OF02JCUQP.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccaggccactgatgtcccaacagattcagtggcagagggtctgggacagactcagtctcaccatcagcagcgtacagtctgaagacttggcagtttatactgtcaactatgtgtcagtgctgaacgttcgccaggaccacagtgatatcgaggacgaactgtggctgcaccatctgtcttacg

SEQ ID NO: 91432 - DNA, 455 bp, Homo sapiens
  misc_feature: GYAE6OF02HGOMX.5.57.F02.1.454.CMB.1.raw
  modified_base (313)..(313): a, c, t, g, unknown or other
  misc_feature (313)..(313): n is a, c, g, or t
  modified_base (349)..(349): a, c, t, g, unknown or other
  misc_feature (349)..(349): n is a, c, g, or t
  modified_base (427)..(427): a, c, t, g, unknown or other
  misc_feature (427)..(427): n is a, c, g, or t
  modified_base (432)..(434): a, c, t, g, unknown or other
  misc_feature (432)..(434): n is a, c, g, or t
  modified_base (436)..(455): a, c, t, g, unknown or other
  misc_feature (436)..(455): n is a, c, g, or t
tcagatcagacacgcacgaccggtgctcgatttagctcgatatagttgggtttgggggaagaggaagactgacggtcccccaggagtccagagtgcgtcgcaagtattggcagtgtgaaatttgacaccttatatgcagactctgtgaggggccgcttcaccgtgtccagagacaactccaagaacgccgtctatttgcagatggacagcctgagagtcgacgacacgggcatctattattgtacggcggccgagcgaatactctcttactttctggagtcagggagtcccggtcactgtctcctcagcctcnccagggcccatcggtctcccctggcacctctccagngcacctctggggcacagcgccctgggctgcctggcaaggactacttcccgtgtctgatctgagcggctggcaaggcanatagnnngnnnnnnnnnnnnnnnnnnnn

SEQ ID NO: 91433 - DNA, 523 bp, Homo sapiens
  misc_feature: GYAE6OF02HEW2T.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggagcaacttagcctggtaccaacaaaaacctggccagcctcccagactcctcatttatcgttcatccaccaggccactgactcgtcccaaccagacttcagtggcagagggtctgggacagacttcagtctcaccatcagcagcgtacagtctagaacgtacttggctagtttatacttgtacaaacattggtgtcaggtcgcctcgaacgttcgcccgacgggaccacgagtaggatagtacgaggaccgaacgtggtcggctacgcgacctatcgtgtcttc

SEQ ID NO: 91434 - DNA, 534 bp, Homo sapiens
  misc_feature: GYAE6OF02I0P0K.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (295)..(295): a, c, t, g, unknown or other
  misc_feature (295)..(295): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttgcctggtaccaacaaaaacctggccagcctcccagactcctcatttancgttcatccaccagggccactgatcgtcccaacagattcagtggcagagggtctgggacagacttcagtctcaccatcagcagcgtacagtctagaagcttggactagtttattactgtacaactaatgtaggtctaggtcggcctacggtaacgttccgggaccctaaggggaccctaacgagtggatagtcgaaggtacgaactggtacggctcggaccacctagtcttgtccttcg

SEQ ID NO: 91435 - DNA, 512 bp, Homo sapiens
  misc_feature: GYAE6OF02JCZF3.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaacaaaaacctggccagcctcccagactcctcatttatcgttcatccaccagggccactgatcgtcccaaccagattcagtggcagagggtctagggacagacttcagtctcaccatcagcagcgtacagtctagaagcttggctagtttatactgtacaacatgtggtcagtcggcctcgaacgttcggaccagggaccagacgtgatatcgaggtccgaacgtgtacggctacgactaccagtctgtcttcg

SEQ ID NO: 91436 - DNA, 496 bp, Homo sapiens
  misc_feature: GYAE6OF02F20PP.5.57.F02.1.454.CMB.1.raw
  modified_base (420)..(420): a, c, t, g, unknown or other
  misc_feature (420)..(420): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggccagtttattactgtacaanaatgtgtcagtgcctcgacgttcgcccaggaccacgagtgatagtcaggcgaactgtggctgcaccatctgtcttc

SEQ ID NO: 91437 - DNA, 502 bp, Homo sapiens
  misc_feature: GYAE6OF02F8SEM.5.57.F02.1.454.CMB.1.raw
  modified_base (386)..(386): a, c, t, g, unknown or other
  misc_feature (386)..(386): n is a, c, g, or t
  modified_base (492)..(492): a, c, t, g, unknown or other
  misc_feature (492)..(492): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacngtctgaagacttggctagtttattactgtacaacatgtggtcagtgcctcgaacgttcgcccagggaccacgagtgatactcgaaggcgaacgtgtgctggcaccntctgtcttcc

SEQ ID NO: 91438 - DNA, 507 bp, Homo sapiens
  misc_feature: GYAE6OF02F8J35.5.57.F02.1.454.CMB.1.raw
  modified_base (418)..(418): a, c, t, g, unknown or other
  misc_feature (418)..(418): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccaggccactgatgtcccaaccagattcagtggcagagggtctgggacagacttcagtctcaccatcagcagctacagtctagaagcttggctagtttattactgtacaanatgtggtcagtggcctgaacgttcgccgaggaccacgagtggatacgtcgaaggcgaacgtgcggtctgccacctatcgtgtccttacc

SEQ ID NO: 91439 - DNA, 546 bp, Homo sapiens
  misc_feature: GYAE6OF02JTWUH.5.57.F02.1.454.CMB.1.raw
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
  modified_base (375)..(375): a, c, t, g, unknown or other
  misc_feature (375)..(375): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagccaccctctcctgcagggccagtcagaacattggancaacttagcctggtaccaacaaaacctgaccagcctcccagacctcctcatttacncgttcatccaccagggccactgactcgtacccaaccagacttcagtggacaggagggtctgggacagacttcagtcncaccatcagcagcgtacagtctagaatacttggctagtttatactgtacaactatgtagtctagtgacctagaacgttcggacccgaagggacccacgtaggtcggattacgtacgaacggaccgtaagttcgtagggccttaggaccaccgtatccgttgtaccttaccg

SEQ ID NO: 91440 - DNA, 506 bp, Homo sapiens
  misc_feature: GYAE6OF02JIEXS.5.57.F02.1.454.CMB.1.raw
  modified_base (443)..(443): a, c, t, g, unknown or other
  misc_feature (443)..(443): n is a, c, g, or t
  modified_base (469)..(469): a, c, t, g, unknown or other
  misc_feature (469)..(469): n is a, c, g, or t
  modified_base (481)..(481): a, c, t, g, unknown or other
  misc_feature (481)..(481): n is a, c, g, or t
  modified_base (483)..(506): a, c, t, g, unknown or other
  misc_feature (483)..(506): n is a, c, g, or t
tcagatcagacacgcacgaccggtgctcgatttagctcgatatagttgggtttgggggtaaggaggaagacgtgacggtcccccacggagtccagagtgcgtcgcaagtattggcagtgtgaaatttgacaccttatatgcagactctgtgaggggccgcttcaccgtgtccaagagacaactccaagaacgccgtctatttgcagatggacagcctgagagtcgacgacagggcatcattatggtaacgcggccaagcaatactctcttactttctggagtcagggacgtccggtcactgtctcctcagcctccacctagggcccactcggtcttcccccgtggcccaccgtccctccaaacgacgccacctcctagggggcaacacgcgccctgggcctgcccgtggtccaaggaccttactccccgtgtactgaacttcncgtagcgggtcgacgcgaacgggtcnccggataacggncnnnnnnnnnnnnnnnnnnnnnnnn

SEQ ID NO: 91441 - DNA, 568 bp, Homo sapiens
  misc_feature: GYAE6OF02HIU8R.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (328)..(328): a, c, t, g, unknown or other
  misc_feature (328)..(328): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctntcctgcagggccagtcagacnttggancaacttgcctggtacaacaaaacctggaccagcctccagactcctcatttatcgttcactccacaggccactgactcgtcccaacngacttcagtcgcagagggtctgggacagtacttcgagtctcaccatcagcagcgtacgagtctagaacgtcgttggactagtttattacgtagtacaactaagtcggtggtacgaggtcggaccttacggaacgttccggcccgtaaggggaccctacgtaggtacggacttacgcggtaacggcgtaaacttggtacggtactacggcctaacccgtagttccgtaggttaccttaccg

SEQ ID NO: 91442 - DNA, 491 bp, Homo sapiens
  misc_feature: GYAE6OF02HGB5K.5.57.F02.1.454.CMB.1.raw
  modified_base (393)..(393): a, c, t, g, unknown or other
  misc_feature (393)..(393): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggagcaacttagcctggtaccaacaaaaacctggccagcctcccagactcctcatttatcgttcatccaccagggccactgatgtcccaacagattcagtggcagagggtctgggacagacttcagtctcaccatcagcagcgtacagtctgaanacttggctagtttattactgtcaacaatgtgtcagtgcctgaacgttcgccagggccagagtgatagtcgaggcgaactgtgctgcaccatctgtctc

SEQ ID NO: 91443 - DNA, 510 bp, Homo sapiens
  misc_feature: GYAE6OF02GO956.5.57.F02.1.454.CMB.1.raw
  modified_base (390)..(390): a, c, t, g, unknown or other
  misc_feature (390)..(390): n is a, c, g, or t
  modified_base (462)..(462): a, c, t, g, unknown or other
  misc_feature (462)..(462): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtcngaagacttggctagtttattactgttcaaactaatgtgtcagtgcctcgaacgttcgcccaggaccacgagnggatatacgaggcaacgtgcggtctgaccacctagtccttgtcttacc

SEQ ID NO: 91444 - DNA, 531 bp, Homo sapiens
  misc_feature: GYAE6OF02IJQLF.5.57.F02.1.454.CMB.1.raw
  modified_base (385)..(385): a, c, t, g, unknown or other
  misc_feature (385)..(385): n is a, c, g, or t
  modified_base (527)..(527): a, c, t, g, unknown or other
  misc_feature (527)..(527): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgccagggccagtcagaacattggtagcaaacttagcctggtaaccaacaaaaacctggccagcctccagactcctcattatcgttcatccaccaggccactgatgtcccaaccagattcagtgcagaggtctgggacagacttcagtctacaccatcagcagcgtacgntcgagaagtcgtgacgttagtttactactcgactaaactagtggtgtactaggtcgtcctacgtaacggttccgaccgacggacacgtacgtagatactcgaaggacgtaagtggtacgcgtcgacctaccactcgtcgttntccg

SEQ ID NO: 91445 - DNA, 511 bp, Homo sapiens
  misc_feature: GYAE6OF02JBY3L.5.57.F02.1.454.CMB.1.raw
  modified_base (201)..(201): a, c, t, g, unknown or other
  misc_feature (201)..(201): n is a, c, g, or t
  modified_base (423)..(423): a, c, t, g, unknown or other
  misc_feature (423)..(423): n is a, c, g, or t
  modified_base (477)..(477): a, c, t, g, unknown or other
  misc_feature (477)..(477): n is a, c, g, or t
  modified_base (502)..(502): a, c, t, g, unknown or other
  misc_feature (502)..(502): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaacaaaaacctggccagcctcccagacctcctcatttatcgttcatccaccagggccaactcgatcgtcccaaccagattcagtgcagagggtctgggacagacttcagtctcaccatcagcagcgtagagtcctgaagacttggctagttttatactgtacaanaatgtagtcagtggcctcgaacgttcggcctaagggacctaacaggtcggatanccgaggcaacttgcggctgccaccntctgtcttc

SEQ ID NO: 91446 - DNA, 516 bp, Homo sapiens
  misc_feature: GYAE6OF02I6Y6B.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (419)..(419): a, c, t, g, unknown or other
  misc_feature (419)..(419): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttgcctggtaccaacaaaaacctggccagcctcccagactcctcatttatcgttcatccaccagggccactgactcgtcccaaccagattcagtggcagagggtctgggacagacttcagtctcaccatcagcagcgtacagtctgaagacttggctagtttatactgtacaanaattgtggtcagtcgtacctcgtaacgttccggacccgagggacccacgagtggtatatcgaggtacgaacgtgtggctgcacctatctgtcttacg

SEQ ID NO: 91447 - DNA, 506 bp, Homo sapiens
  misc_feature: GYAE6OF02F4KLG.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggctagtttaattactgttacaactaatgtggtcagtcggcctcgaacgttcggacccaggacccacgagtggatatcgaggcgaactggtgctgcaccatctgtctc

SEQ ID NO: 91448 - DNA, 574 bp, Homo sapiens
  misc_feature: GYAE6OF02IZI8E.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (460)..(460): a, c, t, g, unknown or other
  misc_feature (460)..(460): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctggtaaccaaacaaaaacctggaccagcctacccagactcctcatttactcgttcatccaccaggccactgactcgtacccaaccagtacttcagtggacagtacgggtctagggacaggtaccttacgagtctacacctatcgaagcaacgtcgtaacagtcagaagtacgtttggactaagtttattacgtgtaactaacaagttgnggttacaggttcggaccctacggtaacggttccggaccgtacgggacctacgacgtgagtactcgaaggtacaacgtaggtcgacgtcgaccgaccgtactcgtacgttcttac

SEQ ID NO: 91449 - DNA, 494 bp, Homo sapiens
  misc_feature: GYAE6OF02GSOJG.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtgtcagtgcctcgaacgttcgcccaggaccacgagtgatatcgaggcgaactgtgctgcaccatctgtcttc

SEQ ID NO: 91450 - DNA, 501 bp, Homo sapiens
  misc_feature: GYAE6OF02GQNI8.5.57.F02.1.454.CMB.1.raw
  modified_base (432)..(432): a, c, t, g, unknown or other
  misc_feature (432)..(432): n is a, c, g, or t
  modified_base (493)..(493): a, c, t, g, unknown or other
  misc_feature (493)..(493): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttagcctggtaccaacaaaaacctggccagcctcccagactcctcatttatcgttcatccaccagggccactgatcgtcccaaccagattcagtggcaggagggtctgggacagacttcagtctcaccatcagcagcgtacagtctagaagtacttggctagtttattactgtacaacaatgtgtcngtcgcctcgaacgttcgcccgagggaccacagtgatatcgaggctaactgtggctgcaccntctgtctc

SEQ ID NO: 91451 - DNA, 448 bp, Homo sapiens
  misc_feature: GYAE6OF02GJQ3K.5.57.F02.1.454.CMB.1.raw
  modified_base (442)..(448): a, c, t, g, unknown or other
  misc_feature (442)..(448): n is a, c, g, or t
tcagatcagacacgcacgaccggtgctcgatttagctcgatatagttgggtttgggggaagaggaagactgacggtccccccaggagtccagagtgcgtcgcaagtattggcagtgtgaaatttgacaccttatatgcagactctgtgaggggccgcttcaccgtgtccagagacaactccaagaacgccgtctatttgcagatggacagcctgagagtcgacgacacgggcatctattattgtacggcggccgagcaatactctcttactttctggagtcagggagtcccggtcactgtctcctcagcctccaccaagggcccatcggtcttccccctggcaccctcctccaagacgcacctctggggcacagcgccctgggctgcctggtcaaggactacttcccgtgtctgatctgagcgggctggcaaggcgcatagnnnnnnn

SEQ ID NO: 91452 - DNA, 517 bp, Homo sapiens
  misc_feature: GYAE6OF02IQ230.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (508)..(508): a, c, t, g, unknown or other
  misc_feature (508)..(508): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggancaacttgcctggtaccaacaaaaacctggccagcctcccagactcctcatttatcgttcatccaccagggccactgatcgtcccaaccagattcagtggcagagggtctgggacagacttcagtctcaccatcagcagcgtacagtctagaagacttggctagtttattactgtacaaactaatgtggtacaggttcggaccttcgtaaccgttcggacccagggacccaacgaggtgatatacgaggcgaacgtgtgctgcaccntctgtcttc

SEQ ID NO: 91453 - DNA, 545 bp, Homo sapiens
  misc_feature: GYAE6OF02H0VBS.5.57.F02.1.454.CMB.1.raw
  modified_base (200)..(200): a, c, t, g, unknown or other
  misc_feature (200)..(200): n is a, c, g, or t
  modified_base (240)..(240): a, c, t, g, unknown or other
  misc_feature (240)..(240): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctggtaccaacaaaaacctggccagcctcccagactcctcatttatcgttcatccaccaggccactgatcgtcccaaccagattcagtggcagagggtctgggacagacttcagtctcaccatcagcagcgtacagtctgaagacttggctagtttatacttgtacaaactaatgtggttacaggttcggacccttacggtaaacgtttccggacccgacgggaccacgagtggacttagtcgaaggccgtaacgttcggtggtcctacggaccaccgtatcttcgttccttaccg

SEQ ID NO: 91454 - DNA, 496 bp, Homo sapiens
  misc_feature: GYAE6OF02HS3C3.5.57.F02.1.454.CMB.1.raw
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
  modified_base (453)..(453): a, c, t, g, unknown or other
  misc_feature (453)..(453): n is a, c, g, or t
  modified_base (465)..(465): a, c, t, g, unknown or other
  misc_feature (465)..(465): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaaacaaaaacctggccagcctcccagactcctcatttatcgttcatccaccagggccactgatcgtcccaaccagattcagtggcagagggtctgggacagacttcagtctcaccatcagcagcgtacagtctgaagcttggctagtttattactgtcaanatgtgnagtgcctgaacgtcggccaggccaagngtggatagtcgnggcaagtgtggctgcacctagtctgtcttac

SEQ ID NO: 91455 - DNA, 517 bp, Homo sapiens
  misc_feature: GYAE6OF02JAL7Q.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (497)..(497): a, c, t, g, unknown or other
  misc_feature (497)..(497): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttgcctggtaccaacaaaaacctggccagcctcccagactcctcattatcgttcatccaccagggccactgatgtcccaacagattcagtggcagagggtctgggacagactcagtctcacatcagcagctacagtcagaagacttggactagtttatacttgtacaactaattgtggtacaggttacgcccgtacgaacggttccggcccgagggaccacgagtcggatactcgaggacgacgtgtcgcgngacaccgtatctcgtcttcg

SEQ ID NO: 91456 - DNA, 508 bp, Homo sapiens
  misc_feature: GYAE6OF02G49P7.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctggtaccaacaaaaacctggccagcctcccagactcctcatttatcgttcatccaccagggccactgatgtcccaaccagattcagtgcagagggtctgggacagacttcagtctcaccatcagcagcgtaacagtctgaagacttggctagtttattactgtacaactaatgtggtcaggtgcctagaacgttcgacccgagggaccacgagtggatagtcgaaggcgaacgtgtggctgcaccatctgtcttacc

SEQ ID NO: 91457 - DNA, 617 bp, Homo sapiens
  misc_feature: GYAE6OF02GWYJ8.5.57.F02.1.454.CMB.1.raw
tcagatcagacacgcacgaccggtgctcgatttagctcgatatagttgggtttgggggaggaactgctcagttaggacccagacggaaccatggaagccccagcgcacgcttctcttccctcctgctactctggctcccagataccgttggggagatcgtgatgacgcagtctccagccatcctgtctgtcgtctccaggggagagagccaccctctcctgcagggccagtcagaactattggagcaacttagcctggtaccaacaaaaacctggccagcctcccagacctcctcatttatcgttcatccaacgaggccactgactcgtacccaaccagtacttcgagtggcagtacgggtctgggacaggtaccttcgacgtctaccacctataccgagaccaagtccgttaacgagttcctaggaaagtaccttagggactaagttttaattaccgtagttaacctaaactaagttcggtagtacgagtcggacctacggtaacggttccggacccgtaagggtaacccaacgtaggtcggtactacggtacggaacgggtaccgtaacgtggtacggtctacggccaaccgtacgtccgttcgtcccttacccg

SEQ ID NO: 91458 - DNA, 540 bp, Homo sapiens
  misc_feature: GYAE6OF02JN4D0.5.57.F02.1.454.CMB.1.raw
  modified_base (201)..(201): a, c, t, g, unknown or other
  misc_feature (201)..(201): n is a, c, g, or t
  modified_base (386)..(386): a, c, t, g, unknown or other
  misc_feature (386)..(386): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggaccagcctcccagactcctcatttatcgttcactccaccaggccactgatcgtcccaacagattcagtgcagaggtctagggacagacttcagtctcgaccatcagcagcgtanagtctgaagacttggactagtttattactgtacaacaatgtggtcaggtcgacctacgaacggttcgaccagggaccacgtagtaggataagtccgtaaggaccgtaacggttagcggtacgtacgtcgaacctagtaccttcggtacttaccg

SEQ ID NO: 91459 - DNA, 495 bp, Homo sapiens
  misc_feature: GYAE6OF02GF1ME.5.57.F02.1.454.CMB.1.raw
  modified_base (464)..(464): a, c, t, g, unknown or other
  misc_feature (464)..(464): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtgtcagtggcctgaacgttcggcccaggaccacagtggatancaggcgaactgtggctgcaccatctgtcttc

SEQ ID NO: 91460 - DNA, 490 bp, Homo sapiens
  misc_feature: GYAE6OF02G7MRK.5.57.F02.1.454.CMB.1.raw
  modified_base (152)..(152): a, c, t, g, unknown or other
  misc_feature (152)..(152): n is a, c, g, or t
  modified_base (200)..(200): a, c, t, g, unknown or other
  misc_feature (200)..(200): n is a, c, g, or t
  modified_base (240)..(240): a, c, t, g, unknown or other
  misc_feature (240)..(240): n is a, c, g, or t
  modified_base (316)..(316): a, c, t, g, unknown or other
  misc_feature (316)..(316): n is a, c, g, or t
  modified_base (454)..(454): a, c, t, g, unknown or other
  misc_feature (454)..(454): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcccacctctcctgcagggccagtcagaacattggancaacttagcctggtaccaacaaaaacctggccagcctcccagactcctcatttatcgttcatccaccaggccactnatcgtcccaaccagattcagtggcagagggtctgggacagacttcagtctcaccatcagcagcgtacagtctgaagcttggctagtttattactgtacaacatgtgtcaggtgcctcgaacgttcgccgaggaccagngtgatatcgaggcgaatggtgctgcacatctgtctc

SEQ ID NO: 91461 - DNA, 538 bp, Homo sapiens
  misc_feature: GYAE6OF02JW2Q6.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagacattggagcaacttagcctggtaccaacaaaaacctggccagcctcccagactcctcatttatcgttcatccaccaggccactgatcgtacccaaccagtacttcagtggcaggaggtctgggacagacttcgagtctcaccatcagcagccgtacagtctagaacgtcgttggactaggtttacttactgtacaactaatggtgtacaggtcgccctacgacgttccgaccgtaggaccctagagtagattactacgacggtacgaagtcgtaggcctaggcctaccgtactcgtcgtcttacg

SEQ ID NO: 91462 - DNA, 491 bp, Homo sapiens
  misc_feature: GYAE6OF02FU4H2.5.57.F02.1.454.CMB.1.raw
  modified_base (201)..(201): a, c, t, g, unknown or other
  misc_feature (201)..(201): n is a, c, g, or t
  modified_base (452)..(452): a, c, t, g, unknown or other
  misc_feature (452)..(452): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccaggccactgatgtcccaacagattcagtggcagagggtctgggacagacttcagtctcaccatcagcagcgtacagtctgaagacttggcagtttattactgtcaacaatgtggtcagtgcctgaacgttcggccaggaccanagtgactatcgaggcgaactgtgctgcaccatctgtctc

SEQ ID NO: 91463 - DNA, 497 bp, Homo sapiens
  misc_feature: GYAE6OF02IBIVL.5.57.F02.1.454.CMB.1.raw
  modified_base (201)..(201): a, c, t, g, unknown or other
  misc_feature (201)..(201): n is a, c, g, or t
  modified_base (297)..(297): a, c, t, g, unknown or other
  misc_feature (297)..(297): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganaaagccaccctctcctgcagggccagtcagaacattggtagcaacttagcctggtaccaacaaaaacctggccagcctcccagactcctcatttancgttcatccaccaggccactgatgtcccaaccagattcagtggcagaggtctgggacagacttcagtctcaccatcagcagcgtacagtctgaagcttggctagttttattactgtcaacatgtgtcagtcgcctcgaacgttcgccagggaccacagtgatagtcaggcgaactggtgctgcaccatctgttcctctac

SEQ ID NO: 91464 - DNA, 501 bp, Homo sapiens
  misc_feature: GYAE6OF02JA11Y.5.57.F02.1.454.CMB.1.raw
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacnttggtancaacttgcctggtaccaacaaaaacctggccagcctcccagactcctcatttatcgttcatccaccagggccactgatcgtcccaaccagattcagtggcagagggtctgggacagacttcagtctcaccatcagcaggcgtacagtctagaagacttggctagtttattactgtacaactaatgtggtcagtgcctcgacgttcgccagggccacagtggactagtcgaggtcgaacgtgtgctgcaccatctgtcttc

SEQ ID NO: 91465 - DNA, 507 bp, Homo sapiens
  misc_feature: GYAE6OF02H7KZT.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (471)..(471): a, c, t, g, unknown or other
  misc_feature (471)..(471): n is a, c, g, or t
  modified_base (497)..(497): a, c, t, g, unknown or other
  misc_feature (497)..(497): n is a, c, g, or t
  modified_base (504)..(504): a, c, t, g, unknown or other
  misc_feature (504)..(504): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtancaacttgcctggtaccaaacaaaaacctggccagcctcccagactcctcatttactcgttcatccaccagggccactgatcgtcccaaccagattcagtggcagagggtctgggacagacttcagtctcacatcagcagcgtacagtctagaagacttggctagtttattactgtacaacatgtgtcagtggcctcgaacgttcgaccagggaccagagtgatgtacgnggtaccgactggtcgcgtcgacaccntctcgtntcc

SEQ ID NO: 91466 - DNA, 496 bp, Homo sapiens
  misc_feature: GYAE6OF02F0KFN.5.57.F02.1.454.CMB.1.raw
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
  modified_base (245)..(245): a, c, t, g, unknown or other
  misc_feature (245)..(245): n is a, c, g, or t
  modified_base (481)..(481): a, c, t, g, unknown or other
  misc_feature (481)..(481): n is a, c, g, or t
tcagatcagacacgcacgaccggtgctcgatttagctcgatataggtttggggtttgggggaggaactgctcagttaggacccagacggaaccatggaagccccagcgcagctttctcttcctcctgctactctggctcccagataccgttgggagatcgtgatgacgcagtctccagccatcctgtctgtcgtcctccagggganagagccaccctncctgcagggccagtcagaacattggancaacttgcctggtaccaacaaaaacctggccagcctcccagactcctcatttatcgttcatccaccagggccactgatgtcccaacagattcagtggcagaggtctgggacagacttcagtctcacatcagcagcgtacagtctgaagacttggctagtttattactgtcaactaatgtggtcagtgcctcgaacgttcgcccgaggaccacgagtgatatcgaggcaacgtgtgntgcacatctgtcttc

SEQ ID NO: 91467 - DNA, 502 bp, Homo sapiens
  misc_feature: GYAE6OF02F5M5W.5.57.F02.1.454.CMB.1.raw
  modified_base (201)..(201): a, c, t, g, unknown or other
  misc_feature (201)..(201): n is a, c, g, or t
  modified_base (380)..(380): a, c, t, g, unknown or other
  misc_feature (380)..(380): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaacaaaaacctggccagcctcccagactcctcatttatcgttcatccaccaggccactgatgtcccaacagattcagtgcagaggtctgggacagacttcagtctcacatcagcagcgtacngtctgaagcttggctagtttattactgtacaacaatgtggtcagtcgcctacgacgttcggacccagggaccacgagtggatagtcgaggcgaacgtgtggctgcaccgatcgttcgtcttc

SEQ ID NO: 91468 - DNA, 576 bp, Homo sapiens
  misc_feature: GYAE6OF02IYFHY.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (352)..(352): a, c, t, g, unknown or other
  misc_feature (352)..(352): n is a, c, g, or t
  modified_base (389)..(389): a, c, t, g, unknown or other
  misc_feature (389)..(389): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttgcctggtaccaacaaaacctggaccagcctcccagactcctcatttatcgttacatccaccaggccactgatcgtcccaacagattcagtggacaggacgggtcngggacagtacttcagtctacacactcagccagcgtanagtctgaacgacttggactaggtttattactagtacaaataacttgtagtctaaggtcggcctacggtaacgttccggacccgtagggacccaagtacggtaggtacgttacgtcggaaggtaccggaaacgttcggtacggtacgtcggtaccaacccgtagttaccgttcggttcctttaacccg

SEQ ID NO: 91469 - DNA, 496 bp, Homo sapiens
  misc_feature: GYAE6OF02IPBZW.5.57.F02.1.454.CMB.1.raw
  modified_base (201)..(201): a, c, t, g, unknown or other
  misc_feature (201)..(201): n is a, c, g, or t
  modified_base (457)..(457): a, c, t, g, unknown or other
  misc_feature (457)..(457): n is a, c, g, or t
  modified_base (486)..(486): a, c, t, g, unknown or other
  misc_feature (486)..(486): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccacctctcctgcagggccagtcagaacattggagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggctagtttattactgtcaacatgtggtcagtggcctcgaacgttcggcccaggccaacngtgatatcgaggcaagtgtggctgcaccntctgtcttac

SEQ ID NO: 91470 - DNA, 506 bp, Homo sapiens
  misc_feature: GYAE6OF02IC9N4.5.57.F02.1.454.CMB.1.raw
  modified_base (390)..(390): a, c, t, g, unknown or other
  misc_feature (390)..(390): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttagcctggtaaccaacaaaaacctggaccagcctcccagactcctcatttatcgttcatccaccagggccactgatgtcccaacagattcagtgcagagggtctggacagacttcagtctcaccatcagcagctacagtcagaancttggctagtttattactgtacaactaatgtgtcagtggcctacgaacgttcggaccgagggaccacgagtgatagtcgaggacgtaactggtgctcgcgaccatctcgtcttacg

SEQ ID NO: 91471 - DNA, 499 bp, Homo sapiens
  misc_feature: GYAE6OF02FIQH7.5.57.F02.1.454.CMB.1.raw
  modified_base (468)..(468): a, c, t, g, unknown or other
  misc_feature (468)..(468): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttatactgttcaacaatgtggtcagtggcctcgaacgttcggcccagggaccacgagtggatancgaggcgaactgtggctgcaccatctgtctc

SEQ ID NO: 91472 - DNA, 523 bp, Homo sapiens
  misc_feature: GYAE6OF02I10QY.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (473)..(473): a, c, t, g, unknown or other
  misc_feature (473)..(473): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttgcctggtaccaacaaaaacctggaccagcctcccagacctcctcatttatcgttcatccaccagggccactgatcgtcccaaccagattcagtggcagagggtctgggacagactcagtcctcaccatcagcagcgtacagtctagaagacttggactagtttacttactagtacaactaagtgtgtacagtcgcctcgacgttcgaccagggaccagagtgatancgaggcgtaacgtggtcggtactcgacctaccgtactcgtacgtcttacg

SEQ ID NO: 91473 - DNA, 502 bp, Homo sapiens
  misc_feature: GYAE6OF02F72RJ.5.57.F02.1.454.CMB.1.raw
  modified_base (235)..(235): a, c, t, g, unknown or other
  misc_feature (235)..(235): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacnttggagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcctagtttattactgtacaacaatgtgtcagtggcctcgaacgttcggcccagggaccacgagtggatatcgaggcgaactgtgctgcaccgatctgtcttac

SEQ ID NO: 91474 - DNA, 494 bp, Homo sapiens
  misc_feature: GYAE6OF02FZFP9.5.57.F02.1.454.CMB.1.raw
  modified_base (201)..(201): a, c, t, g, unknown or other
  misc_feature (201)..(201): n is a, c, g, or t
  modified_base (460)..(460): a, c, t, g, unknown or other
  misc_feature (460)..(460): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtacaacatgtgtcagtgcctcgacgttcgccaggaccagagtgatancgaggcgaactgtgcgtcgcaccatctgtcttac

SEQ ID NO: 91475 - DNA, 553 bp, Homo sapiens
  misc_feature: GYAE6OF02H0RZT.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctggtaccaacaaaaacctggccagcctccagactcctcatttatcgttcactccaaccaggccactgactcgtcccaaccagtattcagtcggacagagggtctgggacaggacttcgagtctacaccatcagcagctacagtcagaagacgttggactagtttattactgtacaactaatgtggtactaggtcgaccctacgtaacggttcccggacccgacgggaccaacgagtacggacttacgtcgaagggtaccgtaagtggttacggcgttaggccaccgtactcgtccgtcttac

SEQ ID NO: 91476 - DNA, 542 bp, Homo sapiens
  misc_feature: GYAE6OF02GKBEC.5.57.F02.1.454.CMB.1.raw
tcagatcagacacgcacgaccggtgctcgatttagctcgatatagttggggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagaggagcccaccctctcctgcgagggccagtcagaacattggtagcaacttagcctggtaccaacaaaaacctggaccagcctcccagactcctcatttatcgttcactccaccagggccactgatcgtacccaacagattcagtggcagaggtctgggacagtacttcagtctcacatcagcagcgtacagtctagaagtcgttggactagtttacttactgtacaactatgtagtcagtcgacctacgacgttcgacccgaggaccacgtagtggatacgtcgaagggcctaagttggtacggtcgtggacctaccgtatccgttcggtcctttaccg

SEQ ID NO: 91477 - DNA, 500 bp, Homo sapiens
  misc_feature: GYAE6OF02FIC2O.5.57.F02.1.454.CMB.1.raw
  modified_base (460)..(460): a, c, t, g, unknown or other
  misc_feature (460)..(460): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccaggccactgatgtcccaacagattcagtgcagagggtctgggacagacttcagtctcaccatcagcagcgtacagtctgaagacttggctagtttatactgtcaactatgtggtcagtgcctcgaacgttcgaccaggaccacagtgatancgaggccgaactggtagctggctaccgatcctgtcttacg

SEQ ID NO: 91478 - DNA, 569 bp, Homo sapiens
  misc_feature: GYAE6OF02IXIA9.5.57.F02.1.454.CMB.1.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (296)..(296): a, c, t, g, unknown or other
  misc_feature (296)..(296): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaagggganagagccaccctntcctgcagggccagtcagaacattggagcaacttagcctggtaccaacaaaaacctggccagcctcccagactctcatttancgttcatccaccaggccactgatgtcccaaccagattcagtggcagaggtctggacagacttcagtctcaccatcagcagcgtacagtctgaagacttggcagtttatacgtgtacaaactaatcgtggtacaaggttggaccctcggaaacgttccggtacccgacgggtaccaccgagtacggtataacgttacgaacggtaccggtaaacgtaacggttcggaccgttaggtacccgtaaccgtaacgtaccgtttcgtaccgtttaacc

SEQ ID NO: 91479 - DNA, 504 bp, Homo sapiens
  misc_feature: GYAE6OF02G0SY3.5.57.F02.1.454.CMB.1.raw
  modified_base (494)..(494): a, c, t, g, unknown or other
  misc_feature (494)..(494): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaacagattcagtggcagagggtctgggacagacttcagtctcaccatcagcagcgtacagtctgaacgacttggctagtttattactgtacaacatgtggtcagtgcctcgaacgttcggcccagggaccacgagtgatacgtcgaggcgaacgtgtcggctgcaccntctgtcttcg

SEQ ID NO: 91480 - DNA, 616 bp, Homo sapiens
  misc_feature: GYAE6OF02GKZI3.5.57.F02.1.454.CMB.1.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagccaccctctcctgcagggccagtcagaacagttgganctaacttgcctggtaaccaaacaaaaacctggaccacgccctacccagacctcctctactttactcgttcactcccaccgacgggccactgactcgtacccaacagacttcagtcggacaggtacgggtcgtagggacagtacttcgagtctaccaccatcaagccaagtccgtaactacgtctagaaacgtacgttcggacttaagtttaacttacgtagttaccaaataagttgtaggtacaggtcggtacccttacggtaaccggttccggacccgtaacgggaaccctaacggacggtaggtatacgtacgacgggtacgtaacgtggttacggctacggacctaacctacgttcgttcgtacttaccg

SEQ ID NO: 91481 - DNA, 511 bp, Homo sapiens
  misc_feature: GYAE6OF02H5ZW1.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (474)..(474): a, c, t, g, unknown or other
  misc_feature (474)..(474): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctggtaccaacaaaaaacctggccagcctcccagactcctcattatcgttcatccaccagggccactgatcgtcccaacagattcagtggcagagggtctgggacagacttcagtctcaccatcagcagcgtacagtctagaagacttggctagttttattactgtacaactaatgtagtcagtcgcctacgaacgttcggcccgagggaccacgagtcgatancgaggaccgaagtggtgctgcacctatcgtgtcttcc

SEQ ID NO: 91482 - DNA, 516 bp, Homo sapiens
  misc_feature: GYAE6OF02GXG4T.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatcgtcccaaccagattcagtggcaggagggtctgggacagacttcagtctcaccatcagcagcgtacagtctgaagtacttggactagtttattactgtacaacaattgtggtcagttggcctcgaacggttccggcccgtagggacccagagtggatagtcgaggacgaacgtgtgctgcaccatctgtcttacg

SEQ ID NO: 91483 - DNA, 509 bp, Homo sapiens
  misc_feature: GYAE6OF02F4YHZ.5.57.F02.1.454.CMB.1.raw
  modified_base (201)..(201): a, c, t, g, unknown or other
  misc_feature (201)..(201): n is a, c, g, or t
  modified_base (392)..(392): a, c, t, g, unknown or other
  misc_feature (392)..(392): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaacaaaaacctggccagcctcccagacctcctcatttatcgttcatccaccagggccactgatcgtcccaaccagattcagtggcagagggtctgggacaggacttcagtctcaccatcagcagcgtacagtcngaagacttggctagtttattactgtacaactaatgtgtcagtggcctgaacgttcgaccgagggaccacgagtgatatcgaggacgaacgtggtcgctggcaccgatcttgtcttac

SEQ ID NO: 91484 - DNA, 506 bp, Homo sapiens
  misc_feature: GYAE6OF02HLY1E.5.57.F02.1.454.CMB.1.raw
  modified_base (201)..(201): a, c, t, g, unknown or other
  misc_feature (201)..(201): n is a, c, g, or t
  modified_base (297)..(297): a, c, t, g, unknown or other
  misc_feature (297)..(297): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttancgttcatccaccagggccactgatcgtcccaaccagattcagtggcagagggtctgggacagacttcagtctcaccatcagcagcgtacagtctagaagacttgggctagtttacttactgtacaactaatgtggtcagtggcctacgaacgttcggcccagggacccagagtgatatcgaaggcaactgtggctgcaccatctgtctc

SEQ ID NO: 91485 - DNA, 596 bp, Homo sapiens
  misc_feature: GYAE6OF02GLRKU.5.57.F02.1.454.CMB.1.raw
  modified_base (154)..(154): a, c, t, g, unknown or other
  misc_feature (154)..(154): n is a, c, g, or t
tcagatcagacacgcacgaccggtgctcgatttagctcgatatagttggggtttggggaggaactgctcagttaggacccagacggaaccatggaagccccagcgcagcttctcttcctcctgctactctggctcccagataccgttggggganatcgtgattgacgcagtctccagccatcctgtctgtgtctccgaggggagagagccaccctctccgtgcagggccagtcaagaacattggtagcaaacttgcctggtaaccaacaaaaacctggaccagccctcccagacctcctctattactcgtcactccacgacgggccacgtgatcgacccaacagattcagtgacagaggtctagggactagacttcgagtctcactatcagtcagtcgtacacgtctagaacgtacgttacgactagttttacttacgtacgttacaaacgtaatcggtacggttactacgggtcgtacccgtacggtaaccggttccgggacccgtaagggaccctaacgagtacggtatacgtacgaaggtaccgtaacgtggttacggacctcgacctaccgtagtccgttacgtaccttacg

SEQ ID NO: 91486 - DNA, 526 bp, Homo sapiens
  misc_feature: GYAE6OF02HS4CG.5.57.F02.1.454.CMB.1.raw
  modified_base (201)..(201): a, c, t, g, unknown or other
  misc_feature (201)..(201): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgccagggccagtcagaacattggtancaaacttagcctggtaccaaacaaaaacctggccagcctcccagacctcctcatttatcgttcatccaccagggccactgatcgtcccaacagattcagtggcagagggtctgggacagacttcagtctcaccatcagcagcgtaacagtctgaaagcttggctagtttattactgtacaactaatgtagtcaggtggccctagaacgttcgacccagggaccacgagttggattagtcgaaggacgaacgtgtggcttggaccaccattctagttccttacg

SEQ ID NO: 91487 - DNA, 630 bp, Homo sapiens
  misc_feature: GYAE6OF02IEOCJ.5.57.F02.1.454.CMB.1.raw
  modified_base (154)..(154): a, c, t, g, unknown or other
  misc_feature (154)..(154): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttggggaggaactgctcagttaggacccagacggaaccatggaagccccagcgcgagcttctcttcctcctgctactctggctcccagactaccgttgggganatcgtgatgacgcagtctccagccatcctgtctgtgtctccagggganagagccaccctctcctgccagggccagtcagaactattggagcaacttacgcctaggtaccaacaaaaacctggaccacgcctcccagacctcctacatttactcgttcactcccaccgtacgggccactacgactcgtacccaaccacgacttccaggtcggctaggtacgggtcgtagggactagaccttcaacgtctacacatccagccagtaccgtacacgtctaggtaagtacgttggacttaagttttaacttacgttcgtactaacgtaagttgtacggtcgtaaggttcggtaccctacggtaacgttccggacccgtaggacctaacgaggttacggtattacgttacgacgggtaccgtaacggtcggttaacggtcttacggacctaacccgttactaccgttcgttaccgttaccg

SEQ ID NO: 91488 - DNA, 565 bp, Homo sapiens
  misc_feature: GYAE6OF02IWZNX.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccacctctcctgcagggccagtcagaacattggagcaacttgcctggtaccaaacaaaacctggaccagcctcccagactcctcatttatcgttcatccaccaggccactgactgtacccaacagacttcagtcggcaggacgggtctagggacagtacttcagtctaccacatcagcagcgtacagtcagaagcttggactagtttattactgttacaactatgtaggtacaggtcgtcccgtagtaacgttccggaccctacgggtaacccgacgaaggtacgtagtacgtaccgagggtaccgaaacgttcggtaggtcctacggacctaacccgtagttccgttcgtaccttaccg

SEQ ID NO: 91489 - DNA, 498 bp, Homo sapiens
  misc_feature: GYAE6OF02HID70.5.57.F02.1.454.CMB.1.raw
  modified_base (201)..(201): a, c, t, g, unknown or other
  misc_feature (201)..(201): n is a, c, g, or t
  modified_base (418)..(418): a, c, t, g, unknown or other
  misc_feature (418)..(418): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggctagtttattactgtcaanaatgtggtcagtgcctcgaacgttcggcccaggaccacgagtggatagtcgaggcgaactgtgctgcaccatctgtcttc

SEQ ID NO: 91490 - DNA, 641 bp, Homo sapiens
  misc_feature: GYAE6OF02JRWKF.5.57.F02.1.454.CMB.1.raw
  modified_base (141)..(141): a, c, t, g, unknown or other
  misc_feature (141)..(141): n is a, c, g, or t
  modified_base (153)..(153): a, c, t, g, unknown or other
  misc_feature (153)..(153): n is a, c, g, or t
  modified_base (189)..(189): a, c, t, g, unknown or other
  misc_feature (189)..(189): n is a, c, g, or t
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
tcagatcagacacgcacgaccggtgctcgatttagctcgatatagttgggtttgggggtaggaacgtggctcagttaggacccagacggaaccatggaagccccagcgcagcttctcttcctcctgctactctgctccagntaccgttggganatcgtgatgacgcagtctccagccatcctgtctgtntctccagggganagagcccaccctntcctgccagggccagtcagaactgttggagctaacttgcctggtaccaacaaaacctggacctacgcctacccagactcctactacttactcgttcatccactacggccactgtactcgtacccaactacacttcagtacgtcaaggtggtcgtacgggactagtacttacgagtcctacactactcgagacagtaccgtacacgtcgtagtaacgtcttaggactagtttactactacgtactaaacgtaatgttacggtactacggttacggtcccgtacgttaaccggttccggtaacccgtacgggtaccccaacgttacgtacgggtacttacggtaaccgtaacgggtaccgtaaccgtacgggtttaacggccgttacggaccgtaacccgtacgtccgtttacgtaccgttttaacccg

SEQ ID NO: 91491 - DNA, 509 bp, Homo sapiens
  misc_feature: GYAE6OF02IY0VM.5.57.F02.1.454.CMB.1.raw
  modified_base (200)..(200): a, c, t, g, unknown or other
  misc_feature (200)..(200): n is a, c, g, or t
  modified_base (240)..(240): a, c, t, g, unknown or other
  misc_feature (240)..(240): n is a, c, g, or t
  modified_base (295)..(295): a, c, t, g, unknown or other
  misc_feature (295)..(295): n is a, c, g, or t
  modified_base (419)..(419): a, c, t, g, unknown or other
  misc_feature (419)..(419): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttgggagatcgtgatgacgcagtctccagccatcctgtctgtgtctccgagggganagagccaccctctcctgcagggccagtcagaacattggancaacttgcctggtaccaacaaaaacctggaccagcctcccagactcctcatttancgttcatccaccagggccactgatcgtcccaacagattcagtggcagacgggtctgggacagacttcagtctcacatcagcagcgtacagtctagaaagcttggctagtttattactgtacaanattgtggtcaggtcgcctacgtaagttccgccagggtacccacgagtggatagtcgaggcgaacgtgtggctagcaccgatctgtcttac

SEQ ID NO: 91492 - DNA, 604 bp, Homo sapiens
  misc_feature: GYAE6OF02H1M2I.5.57.F02.1.454.CMB.1.raw
  modified_base (206)..(206): a, c, t, g, unknown or other
  misc_feature (206)..(206): n is a, c, g, or t
  modified_base (355)..(355): a, c, t, g, unknown or other
  misc_feature (355)..(355): n is a, c, g, or t
  modified_base (571)..(571): a, c, t, g, unknown or other
  misc_feature (571)..(571): n is a, c, g, or t
tcagatcagacacgcacgaccggtgctcgatttagctcgatatagttgggtttgggggtagggaacgtgctcagttaggacccagacggaaccatggaagccccagcgcagcttctcttcctcctgctactctggctcccagataccgttggggagatcgtgatgacgcagtctccagccatcctgtctgtgtctcccaggggganagacgcccacccgtctcctgccagggccagtcaagaacagttggagcaacttagcctaggtaccaaacaaaaacctggaccagcctcccaagactccactatttactcgttacactccaaccagggccacgtcgatcgtcccaaaccanattcagtcggcaagacgggtcgtagggacaggaactttgaagtcgtacaccatacagacagtcgtaaaccagtacctagaaacgtacgttacggacttaaggtttaacttaactgtacaaacgtaatgtaggtacagtacggcctaccgaacggttcgacctaacggggaacaccgtaagtcgtacgtagtaccgaggtagaacgtaggttacggnttacggactaccctaagtcttcgtgtttaaccc

SEQ ID NO: 91493 - DNA, 553 bp, Homo sapiens
  misc_feature: GYAE6OF02ICSWQ.5.57.F02.1.454.CMB.1.raw
  modified_base (152)..(152): a, c, t, g, unknown or other
  misc_feature (152)..(152): n is a, c, g, or t
  modified_base (200)..(200): a, c, t, g, unknown or other
  misc_feature (200)..(200): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctctcctgccagggccagtcagaacatttggagcaacttagcctggtaaccaacaaaaacctggccagcctcccagacctcctctatttactccgtttcactccaccaggccactgatcgtacccaaccagattcagtcgcagagggtctgggacagacttcagtctacaccatcagcagcgtacagtctagaagtcttggctaagtttattactgtacaactatggtacgtcgaggtcggcctacgtaacgttccggacccacgggaccaacgtagtacggacttagtcgaacggaccgtaacgtcggttcgccgttagcctaccacgttctcgtacttaccg

SEQ ID NO: 91494 - DNA, 494 bp, Homo sapiens
  misc_feature: GYAE6OF02HEPAA.5.57.F02.1.454.CMB.1.raw
  modified_base (201)..(201): a, c, t, g, unknown or other
  misc_feature (201)..(201): n is a, c, g, or t
  modified_base (477)..(477): a, c, t, g, unknown or other
  misc_feature (477)..(477): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgtcatccaccagggccactgatcgtcccaaccagacttcagtggcagagggtctgggacagacttcagtctcacatcagcagcgtacagtcagaagtacttggctagtttattactgtacaactatgtgtcagtgcctgacgttcgcccagggaccagagtgatagcgaggacactggngctgcacatctgtctcg

SEQ ID NO: 91495 - DNA, 505 bp, Homo sapiens
  misc_feature: GYAE6OF02IA8YG.5.57.F02.1.454.CMB.1.raw
  modified_base (242)..(242): a, c, t, g, unknown or other
  misc_feature (242)..(242): n is a, c, g, or t
  modified_base (394)..(394): a, c, t, g, unknown or other
  misc_feature (394)..(394): n is a, c, g, or t
  modified_base (464)..(464): a, c, t, g, unknown or other
  misc_feature (464)..(464): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggancaacttagcctaggtaaccaaacaaaaacctggccagcctcccaagactcctcatttactcgttcatccaccagggccactgatcgtcccaaaccagattcagtggcaggacgggtctgggacagacttcagtctcaccatcagcagcgtanagtctagaagcttggctagtttatacttgtacaataatgtgtcaggtgcctgaacgttcgccaggaccanagtgatatcgaggcaacgtgtcgctgcaccatctcgtcttc

SEQ ID NO: 91496 - DNA, 1009 bp, Homo sapiens
  misc_feature: GYAE6OF02JX78K.5.57.F02.1.454.CMB.1.raw
  modified_base (154)..(154): a, c, t, g, unknown or other
  misc_feature (154)..(154): n is a, c, g, or t
tcagatcagacacgcacgaccggtgctcgatttagctcgatatagttgggtttgggggaggaacgtgctcagttaggacccagacggaaccatggaagccccagcgcagcttctcttcctcctgctactctggctcccagataccgttgggganatcgtgatgacgcagtctccagccatcctgtctgtgtctaccgaggggacaggacgcccacccttctcccgtggccgaacggggtccccaaaggttcccgaaaggtaaaaccctaagtttttcgggggtaacgaccctaaaaaccgtttttaggacccgttacggggttaaaccccaaaaacctaaaaaaaaccccgttcggggaacccctaacgggacccccttacccccgaacggaacccttccccgttaacctaactttttaaacgttccggtttacctaacttcccctaaacccgaacgggggtacccctaaccgttacggtaacgttaccggtacccccctaaaacccgtaaacggtaaccttttacccgtaaacggtttacggggaaccctaaacgggggttaacgggggttaccgtttacgggggggaaaccccgtaacgggtaaacccgttttacccgtaacggggtttacccttaccgtaaaccccgtaacgttttacccgaacgggtaacccgtaacgggtacccggtttaaaccgtaacgggtttacccgtaacggtaaaaccgggttaaaccgttttcggggaaccctttaaacgggtttttaactttaacgtttacgggttaaaccctaaaaccgttaaagtttacggttaacgggtttacctaaagggtttccgggtaaccctttacggggtaaaacccggttttcccgggtaaccccgttaacggggtaaacccgtaacggtaacggtttaccgggtattaacggttaccggtaacggtaaccggtaacgttaacggttcgggtactaccgtcgaaccgttagccttacggtccgttacg

SEQ ID NO: 91497 - DNA, 531 bp, Homo sapiens
  misc_feature: GYAE6OF02GXFSL.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (394)..(394): a, c, t, g, unknown or other
  misc_feature (394)..(394): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagacattggancaacttagcctggtaccaacaaaaacctggaccagcctcccagactcctcatttatcgttcactccaccacgggccactgactcgtacccaacagacttcagtcgacaggagggtctgggacagacttcagtctcaccatcgagcaagcgtanagtctagaagtacttggactagtttattctagtacaactaatgtgtacagtcgcctacgaacgttcgcccagggtaccacgtgtagacttatcgaggacgtaactggtaggctagccaccgtatcgttagtcttacc

SEQ ID NO: 91498 - DNA, 495 bp, Homo sapiens
  misc_feature: GYAE6OF02GHY5N.5.57.F02.1.454.CMB.1.raw
  modified_base (453)..(453): a, c, t, g, unknown or other
  misc_feature (453)..(453): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacatgtgtcagtgcctcgaacgttcgccagggaccanagtggatatcgaggcgaactgtggctcgcaccatctgtcttc

SEQ ID NO: 91499 - DNA, 506 bp, Homo sapiens
  misc_feature: GYAE6OF02HHOJC.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccagggccactgatcgtcccaaccagattcagtggcagagggtctgggacaggacttcagtctcaccatcagcagcgtacagtctgaagacttggctagtttatctgtcaacatgtgtcagtgctcgaacgttcgcccgtaggaccagagtcgatatcgacggacgaacgtgtcggctgccaccgatcttcgtcttacg

SEQ ID NO: 91500 - DNA, 504 bp, Homo sapiens
  misc_feature: GYAE6OF02IC1IO.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (485)..(485): a, c, t, g, unknown or other
  misc_feature (485)..(485): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggancaacttgcctggtaccaacaaaaacctggaccagccctcccagacctcctctatttactcgttcatcccaccagggccactgactcgtacccaacagattacagtggcaggacgggtctgggacagacttcgagtctcaccatcagcagctacagtctagaagtcttggctagtttattactgtacaatatgtgtcagtcgctcgacgttcgccaggaccagagtgatagtcgaggcaagtgnggctgccactatctgtctc

SEQ ID NO: 91501 - DNA, 581 bp, Homo sapiens
  misc_feature: GYAE6OF02JAX03.5.57.F02.1.454.CMB.1.raw
  modified_base (363)..(363): a, c, t, g, unknown or other
  misc_feature (363)..(363): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagacgccaccctctcctgcagggccagtcagaacagttggtagcaacttagcctggtaaccaaacaaaaacctggaccaacgcctccagacctcctctatttactcgttacactccaccgaggccactgactcgtacccaacagtattacagtcggcaaggnggtctgggacagtacttacagtctacaccatcagcaagctaacagtctagaacgacgttggactaagttattactagtactaaactattgtaggtactaggtgtacctacggaaccgttccggacccgaacggacccgaagtacggtagacgttagtacgaacgggtacctaaggtgtcggactacggactaaccgagttaccgttgttacccttacg

SEQ ID NO: 91502 - DNA, 500 bp, Homo sapiens
  misc_feature: GYAE6OF02IR8CS.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
  modified_base (421)..(421): a, c, t, g, unknown or other
  misc_feature (421)..(421): n is a, c, g, or t
  modified_base (456)..(456): a, c, t, g, unknown or other
  misc_feature (456)..(456): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcccaccctctcctgcagggccagtcagaacattggagcaacttagcctggtaaccaacaaaaacctggccagcctcccagactcctcatttancgttcatccaccaggccactgatcgtcccaaccagattcagtggcagagggtctgggacagacttcagtctcaccatcagcagcgtacagtctgaagtcttggctagtttattactgtacaanaatgtgtcagtcgctgaacgttcgaccaggaccanagtggatagtcgaggcgaactggtgctgccaccatctgtctacg

SEQ ID NO: 91503 - DNA, 502 bp, Homo sapiens
  misc_feature: GYAE6OF02IK6GN.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (492)..(492): a, c, t, g, unknown or other
  misc_feature (492)..(492): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcccaccctctcctgcagggccagtcagaacattggancaacttagcctggtaccaacaaaaaacctggccagcctcccagactcctcatttatcgttcatccaccagggccactgatcgtcccaaccagattcagtggcagaggtctggacagacttcagtctcaccggatcagcagcgtacagtctgaaagcttggctagtttattactgtacaaacaatgtggtcagtggccctgaacgttcggaccagggaccacgagtgatagcgaggcacgtgtgctgcacntactgtcttc

SEQ ID NO: 91504 - DNA, 502 bp, Homo sapiens
  misc_feature: GYAE6OF02ISIVQ.5.57.F02.1.454.CMB.1.raw
  modified_base (201)..(201): a, c, t, g, unknown or other
  misc_feature (201)..(201): n is a, c, g, or t
  modified_base (430)..(430): a, c, t, g, unknown or other
  misc_feature (430)..(430): n is a, c, g, or t
  modified_base (468)..(468): a, c, t, g, unknown or other
  misc_feature (468)..(468): n is a, c, g, or t
  modified_base (493)..(493): a, c, t, g, unknown or other
  misc_feature (493)..(493): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaaacaaaaacctggaccagcctcccagactcctcatttatcgttcatccaccaggccactgatcgtcccaaccagattcagtggacaggagggtctgggacagacttcagtctcaccatcagcagctacagtctgaacgcttggctagtttattactgtacaataatgtgtnagtgcctacgacgttcgccagggaccacgagtgatacncgaaggccaagtgtcgctcgcaccntctgtcttc

SEQ ID NO: 91505 - DNA, 506 bp, Homo sapiens
  misc_feature: GYAE6OF02IWDS6.5.57.F02.1.454.CMB.1.raw
  modified_base (201)..(201): a, c, t, g, unknown or other
  misc_feature (201)..(201): n is a, c, g, or t
  modified_base (416)..(416): a, c, t, g, unknown or other
  misc_feature (416)..(416): n is a, c, g, or t
  modified_base (503)..(503): a, c, t, g, unknown or other
  misc_feature (503)..(503): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttgcctggtaccaacaaaaacctggaccagcctcccagactcctcatttatcgttcatccaccagggccactgatgtcccaacagattcagtggcagagggtctgggacagacttcagtcccacatcagcagcgtacagtctgaagtatggcagtttattactgtacaanaatgtgtcagtggctcgaacgttcggccacgggaccactagtggatatacgtaggacgactggtcggctggacaccatctgttcttntac

SEQ ID NO: 91506 - DNA, 877 bp, Homo sapiens
  misc_feature: GYAE6OF02FFG35.5.57.F02.1.454.CMB.1.raw
  modified_base (151)..(151): a, c, t, g, unknown or other
  misc_feature (151)..(151): n is a, c, g, or t
  modified_base (200)..(200): a, c, t, g, unknown or other
  misc_feature (200)..(200): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggganatcgtgatgacgcagtctccagccatcctgtctgtgtctccgagggganagacgccaccctctcctgcagggcccagtccagaactagttgggtacgctaaacgttagccctaggtaacccaaacaaaaaacccgttggaccaacgccccttacccaagaaccttcccttacacttttaactccgtttacaacttcccaaccacgggccaacgttcggaacttcggttaccccaaaccgtaggtaactttccgaaggttcggactaacgggtacggggttccgttagggggaacctaacgggtaaccctttaccgaaacggtttccccttacccgaaaccccgtaacgttacccgaacgggacccgtaaacgggtacccggtttaaaccgaacgggttttacccgttaaacgggtaaaaacggtttacccgttttacgggggaaccctttaaagggttttttttaaacctttaaaccgttacgggtttaaccctaaaaccgttaaagtttcgggtttacgggttaccgtaacgggttccgggttaccccgttaccgggttaaacccgggtttcccgggaccccgtaacgggggtaaccctaacggtaacggttacgggtacgttaacgtaccggaacggggtaccggtaaaaccgttcgggtaccgggtaccgttacggacccgtaacccgtaagtttcccgttacggtttaccctttaaccccgg

SEQ ID NO: 91507 - DNA, 538 bp, Homo sapiens
  misc_feature: GYAE6OF02G31M4.5.57.F02.1.454.CMB.1.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (296)..(296): a, c, t, g, unknown or other
  misc_feature (296)..(296): n is a, c, g, or t
  modified_base (383)..(383): a, c, t, g, unknown or other
  misc_feature (383)..(383): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacnttggancaacttagcctggtaccaacaaaaacctggccagcctcccagactcctcatttancgttcactccaccagggccactgatcgtcccaacagattcagtgcagagggtctgggacagacttcagtctcacatcagcagcgtangtctagaagacttggctagtttattactgtacaatagttgtggtcagtcgacctagaactgttccggacccagggaccacgtaggttggaacttacgtcgaagggtaccaacgttggtacggaccttacggacctaacccgtattccgtagttcc

SEQ ID NO: 91508 - DNA, 582 bp, Homo sapiens
  misc_feature: GYAE6OF02G25BX.5.57.F02.1.454.CMB.1.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
  modified_base (339)..(339): a, c, t, g, unknown or other
  misc_feature (339)..(339): n is a, c, g, or t
  modified_base (395)..(395): a, c, t, g, unknown or other
  misc_feature (395)..(395): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccagggganagacgccaccctctcctgcgagggccagtcagaacngttggtagcaacgttagcctggtaaccaaacaaaaacctggaccagcctcccagacctcctcatttactcgttcatccaccgaggccactgatcgtcccaacngtattcagtcgcaggaggtctgggacagacttcgagtctcaccatcagcagctacngtctagaagacgttgacttagtttactactagtacaaacgtaatgtcggtacaggttcgaccgttacgtaccggtttccggcccgtaacggggaccctaacgtagtcggaacttagtaccggaaggtaccgaaacgttcggtacggtactcggacctaaccgtacgtttcgttcgttaccgtttacc

SEQ ID NO: 91509 - DNA, 501 bp, Homo sapiens
  misc_feature: GYAE6OF02F7BGX.5.57.F02.1.454.CMB.1.raw
  modified_base (201)..(201): a, c, t, g, unknown or other
  misc_feature (201)..(201): n is a, c, g, or t
  modified_base (457)..(457): a, c, t, g, unknown or other
  misc_feature (457)..(457): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcattatcgttcatccaccaggccactgatcgtcccaaccagattcagtgcagagggtctgggacagacttcagtctcaccatcagcagcgtacagtctagaagacttggactagtttattactgtacaactatgtggtcagtgcctcgaacgttcgcccaggaccanagtgatatcgaggcgaacgtgtcgctcgcaccatctgtcttacg

SEQ ID NO: 91510 - DNA, 510 bp, Homo sapiens
  misc_feature: GYAE6OF02FN31S.5.57.F02.1.454.CMB.1.raw
  modified_base (201)..(201): a, c, t, g, unknown or other
  misc_feature (201)..(201): n is a, c, g, or t
  modified_base (389)..(389): a, c, t, g, unknown or other
  misc_feature (389)..(389): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccagggccactgatgtcccaacagattcagtggcagagggtctgggacagacttcagtctcaccatcagcagcgtacagtcngaagacttggctagtttattactgtacaacaatgtggtcagtggcctcgtaacgttcggcccagggaccacgagtggatatcgaggacgtaactgtcgctgcaccactcgttgtcttaccg

SEQ ID NO: 91511 - DNA, 551 bp, Homo sapiens
  misc_feature: GYAE6OF02INA8B.5.57.F02.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
  modified_base (350)..(350): a, c, t, g, unknown or other
  misc_feature (350)..(350): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggtagcaacttagcctggtaccaaacaaaacctggccagcctcccagactcctcatttancgttcatccaccagggccactgatcgtcccaacagattcagtgcagaggtcngggacagacttcagtcctcaccatcagcacggcgtacagtctagaacgtacttggacctaggttttaacttactgtaccaactaattgtacggtcaggtcggcctacgtaaccggttcggacccagggacccagagtggactagtcgagggtacgtaactggtacggtccgtggacctaccgattccgttagtccttaccg

SEQ ID NO: 91512 - DNA, 505 bp, Homo sapiens
  misc_feature: GYAE6OF02GG9UN.5.57.F02.1.454.CMB.1.raw
  modified_base (241)..(241): a, c, t, g, unknown or other
  misc_feature (241)..(241): n is a, c, g, or t
  modified_base (458)..(458): a, c, t, g, unknown or other
  misc_feature (458)..(458): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggancaacttagcctggtaccaacaaaaacctggccagcctcccagactcctcatttatcgttcatccaccaggccactgatgtcccaacagattcagtggcagagggtctgggacagacttcagtctcaccatcagcagcgtacagtctgaagacttggctagtttattactgttacaaacaatgtggtcagtgctcgaacgttcgacccagggacccanagtggactatcgaacggcgaactgtcggctgccaccatctgtcttac

SEQ ID NO: 91513 - DNA, 516 bp, Homo sapiens
  misc_feature: GYAE6OF02HX6V0.5.57.F02.1.454.CMB.1.raw
  modified_base (201)..(201): a, c, t, g, unknown or other
  misc_feature (201)..(201): n is a, c, g, or t
  modified_base (434)..(434): a, c, t, g, unknown or other
  misc_feature (434)..(434): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcaagaacattggagcaacttagcctggtaaccaaacaaaaacctggaccagcctcccagactcctcatttatcgttacactccaccgacggccactgactcgtacccaacagtacttcgagtggcgaggaggtcgtgggacacgtacttcacgtctacaccatcagcagctacagtctgaagtctggctagttattactgtacaanatgtgtgagtcgctacgacgtccgaccgacggacagagtgatctcgaggtacgaactggtcgctcgcacatcgtgtcttacg

SEQ ID NO: 91514 - DNA, 503 bp, Homo sapiens
  misc_feature: GYAE6OF02IFUI2.5.57.F02.1.454.CMB.1.raw
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (363)..(363): a, c, t, g, unknown or other
  misc_feature (363)..(363): n is a, c, g, or t
  modified_base (460)..(460): a, c, t, g, unknown or other
  misc_feature (460)..(460): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacnttggancaacttagcctggtaccaacaaaaacctggccagcctcccagactcctcatttatcgttcatccaccagggccactgatcgtcccaaccagattcagtgcagagggtctgggacagacttnagtctcaccatcagcagcgtacagtctagaagacttggctagtttattactgtacaataatgtagtcagtcgcctcgacgttcggcccaggaccagngtgatagtcgaggcgaacgtgtgcgtcgcaccatctgtcttac

SEQ ID NO: 91515 - DNA, 493 bp, Homo sapiens
  misc_feature: GYAE6OF02F6BQB.5.57.F02.1.454.CMB.1.raw
  modified_base (481)..(493): a, c, t, g, unknown or other
  misc_feature (481)..(493): n is a, c, g, or t
tcagatcagacacgcacgaccggtgctcgatttagctcgatatagttgggtttggggggaagaggaagactgacggtccccccaggagtccagagtgcgtcgcaagtattggcagtgtgaaatttgacaccttatatgcagactctgtgaggggccgcttcaccgtgtccagagacaactccaagaacgccgtctatttgcagatggacagcctgagagtcgacgacacgggcatctattattgtacggcggccgagcaatactctcttactttctggagtcagggagtcccggtcactgtctcctcacgcctccaccaacgggcccatcggtccttccccctcggccacccctcctccaagacgcacctcgtggggcacgacgccggccctgggctcgcctgggtccaagggtacctaccgttccccggtgttccgtgtacttctggacgcgggtctgggcgaacgggcgacagtagcannnnnnnnnnnnn

SEQ ID NO: 91516 - DNA, 538 bp, Homo sapiens
  misc_feature: GYAE6OF02JCPGM.5.57.F02.1.454.CMB.1.raw
  modified_base (201)..(201): a, c, t, g, unknown or other
  misc_feature (201)..(201): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
  modified_base (411)..(411): a, c, t, g, unknown or other
  misc_feature (411)..(411): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggcccagtcagaacattggtagcaacttagcctggtaccaacaaaaacctggaccagcctcccagacctcctacatttatcgttcactccaccaggccactgatcgtccaacagattcagtgcagaggtctggacagacttnagtctcacntcancagcgtanagtcngaanctgactagtttattactntactaacaatgtagtcaggtacgtcctacgtacgttcggccaagggaccaaccgagttacggagttactacgtacggtacgtaaacgtgtacggtcttacggcctaacgtactccgttataccttcg

SEQ ID NO: 91517 - DNA, 510 bp, Homo sapiens
  misc_feature: GYAE6OF02GP3WQ.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (331)..(331): a, c, t, g, unknown or other
  misc_feature (331)..(331): n is a, c, g, or t
  modified_base (430)..(430): a, c, t, g, unknown or other
  misc_feature (430)..(430): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtancaacttagcctggtaccaacaaaaacctggccagcctcccagactcctcatttatcgttcatccaccagggccactgatcgtcccaacngattcagtggcagagggtctgggacagacttcagtctcaccatcagcagcgtacagtctagaagtacttggctagtttatactgtacaacaatgtggtnagtgcctgaacgttcggacccaggacccagagtgatatcgaggaccgacgtgaggctagcctaccagtcctagtccttcg

SEQ ID NO: 91518 - DNA, 565 bp, Homo sapiens
  misc_feature: GYAE6OF02GY82W.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttagcctggtaccaacaaaaacctggaccagcctcccagactcctcatttatcgttcatccaccagggccactgatcgtacccaacagacttcagtggcagagggtctagggacagtacttcagtctcaccatcagcagcgtacagtctagaagtacttggactagtttattacgtgtacaactagtgtagtcaaggtcggtacctacggtaaccgtttcggacccgtaacggggacccaacgtacgtacggattacgtacgaacgggtccgtaaacgtggtcggactcggcctaaccgacgttccttaggtccttaccg

SEQ ID NO: 91519 - DNA, 509 bp, Homo sapiens
  misc_feature: GYAE6OF02G9C3W.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctccccagactcctcattatcgttcatccaccagggccactgatgtcccaaccagacttcagtggcagagggtctgggacagacttcagtctcaccatcagcagcgtacagtctgaagacttggcagtttattactgtacaataatgtggtcagtggcctcgaacgttccggcccagggacccacgagtggatagtcgaggacgaactggtgctgccaccatctgtcttccg

SEQ ID NO: 91520 - DNA, 528 bp, Homo sapiens
  misc_feature: GYAE6OF02H1MF1.5.57.F02.1.454.CMB.1.raw
  modified_base (441)..(441): a, c, t, g, unknown or other
  misc_feature (441)..(441): n is a, c, g, or t
  modified_base (519)..(519): a, c, t, g, unknown or other
  misc_feature (519)..(519): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaaacaaaaacctggccagcctcccagacctcctcattactcgttcatccaccagggccactgactcgtcccaacagacttcagtcggcaggacgggtctgggacaggacttcagtctcaccatccagcagcgtacagtctagaagtacttggactagtttatactagtacaaacatgtagtnagtgacctcgaacgttccgccagggaccacgtgtggatatcgaaggcgaactggtacgcctggaccaccgtatccgtntaccgttac

SEQ ID NO: 91521 - DNA, 616 bp, Homo sapiens
  misc_feature: GYAE6OF02JBAYB.5.57.F02.1.454.CMB.1.raw
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (288)..(288): a, c, t, g, unknown or other
  misc_feature (288)..(288): n is a, c, g, or t
tcagatcagacacgcacgaccggtgctcgatttagctcgatatagttgggtttgggggagggaacgtgctcagttaggacccagacggaaccatggaagccccagcgcagcttctcttcctcctgctactctggctcccagataccgttgggagatcgtgatgacgcagtctccagccatcctgtctgtgtctccagggganagagccaccctctcctgcagggccagtcagaacnttggancaactgctgtaccaacaaaactggccagcctccagactcctcattntcgtcactccacacggccactgactcgaccaaccagtacttcagtggacaggcgggtcagggacacgtacttcgagtctactaccataccgtagaccaacggcgtaaccacgtctagaacgtacgttggacctagttttaataaccgttgtaacgtaaacaacgttgtacggtacctaggttaccgtcgtacccggtaacgttcccggacccgtacggggaaccccaacggttacgtacggtattaacgtccggtaacggaccgtaaaccggtggttcgggtaccgtacgtaaccgtaccctagttacccgttacgtaccgtttaccg

SEQ ID NO: 91522 - DNA, 563 bp, Homo sapiens
  misc_feature: GYAE6OF02F7ML2.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagccaccctctcctgcagggccagtcagaacattggagcaacttgcctggtaaccaacaaaaaccgtggaccagcctacccagacctcctcatttatcgttcactccaccaggccactgactcgtcccaaccagacttcgagtggacagagggtctgggacagacttcagtctcaccatcagcagcgtacagtctagaagtcgttggactagtttatactgtacaactatgtagtctagtcggccgttacgaacggttccggacccgagggtacccacgtaaggtcggtatacgtacgaacgggacgtaacgttcgggtacgcgtacgccgaacctacgttcgttacgttccttacccg

SEQ ID NO: 91523 - DNA, 518 bp, Homo sapiens
  misc_feature: GYAE6OF02HII68.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttagcctggtaccaaacaaaaacctggccagcctccagactcctcatttactcgttcatccaccagggccactgatcgtacccaacagactcagtgcaggaggtcgtgggacagacttcacgtctcaccatcagcagcgtacagtctagaagtacttggctagtttattacgtgtacaacaatgtggtcaggtcgccgtgtaacgttccggaccagggacacgagtggatatcgaggtacgaacgtgtcggctcgcctaccatctagttctac

SEQ ID NO: 91524 - DNA, 514 bp, Homo sapiens
  misc_feature: GYAE6OF02HEK84.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttgcctggtaccaacaaaacctggaccagcctcccagacctcctctatttactcgttcactccaccgacgggccacgtgactcgtaccccaaccagtacttcagtgcagagggtcgtgggacagtacttcagtctcaccatcagcagcgtacagtctagaagtacttgactagtttattactgtacaatatgtgtcagtcgctacgacgttcgaccagggaccacgagtgatatcgaggtcgaacgtgtcgctcgacaccatctgtctc

SEQ ID NO: 91525 - DNA, 545 bp, Homo sapiens
  misc_feature: GYAE6OF02IREVM.5.57.F02.1.454.CMB.1.raw
  modified_base (242)..(242): a, c, t, g, unknown or other
  misc_feature (242)..(242): n is a, c, g, or t
  modified_base (477)..(477): a, c, t, g, unknown or other
  misc_feature (477)..(477): n is a, c, g, or t
tcagatcagacacgcacgaccggtgctcgatttagctcgatatagttgggtttggggaggactgctcagttaggacccagacggaaccatggaagccccagcgcagcttctcttccctcctgctactctggctcccagataccggttggggagatcgtgatgacgcagtctccagccatcctgtctgtgtctccgaggggagagagcccacctctcctgcagggccagtcagaacattggancaacttagcctggtaaccaacaaaaacctggccagccctcccagacctcctcatttatccgttcatcccaccgaggccactgactcgtacccaacagacttcaggttggacaggtagggtcgtagggacagtacttcagtctcaccatcagcagacgtacagtcagaagtacgtgactagtttattactgtacaatatgtggtcagtggctagaacgttcgccagggactaacgngtaggatacgtcgcggtacgaacgtggtacggacgttcgacctaccgaacgttcgttacgtcttaccg

SEQ ID NO: 91526 - DNA, 521 bp, Homo sapiens
  misc_feature: GYAE6OF02IGI5H.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcattatcgttcatccaccagggccactgatcgtacccaacagattcagtcgcagagggtctgggacagacttcagtctcaccatcagcagcgtacagtctagaagtacttggctagtttattactgtacaactagtgtggtcaggtggcctacgaaccgttcggacccgagggaccacgagtgatagtcgaaggcgaacgtgtacggctgcgaccagtcttcgtcttaccg

SEQ ID NO: 91527 - DNA, 547 bp, Homo sapiens
  misc_feature: GYAE6OF02GIU1R.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgccaccctntcctgcagggccagtcagaacnttggancaacttgcctggtaccaacaaaaacctggccagcctcccagactcctcatttatcgttcatccaccaggccactgatcgtacccaaccagattcagtcgcagagggtctgggacagactcagtctacaccatcagcagcgtacagtctagaacgtacttggctagttttattacgtgtactaaacattgtggtactaggtcggtccctacggtaacgttccggacccgtaacggaccgacgagtcggatacgtacgaacggaccgaacgtcgtaggcgtcgactaccatccgttcgtcttaccg

SEQ ID NO: 91528 - DNA, 527 bp, Homo sapiens
  misc_feature: GYAE6OF02G5V1T.5.57.F02.1.454.CMB.1.raw
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
  modified_base (353)..(353): a, c, t, g, unknown or other
  misc_feature (353)..(353): n is a, c, g, or t
  modified_base (372)..(372): a, c, t, g, unknown or other
  misc_feature (372)..(372): n is a, c, g, or t
  modified_base (428)..(428): a, c, t, g, unknown or other
  misc_feature (428)..(428): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagccaccctctcctgcagggccagtcagaacattggancaacttgcctggtaccaacaaaaacctggccagccctcccagactcctctatttatcgttcatcccaccgagggccactgactcgtacccaaccagacttcagtggcaggngggtctagggacagacttnagtctcacatcagcagctacagtcagaagcgttggactagtttattactgtacaanatgtgtcagtgcctgaacgttcgaccgaggaccacgagtacgatagtacgaggtaccgaacttggacggcgtcgaccgtacacgttctcgttcttaccg

SEQ ID NO: 91529 - DNA, 529 bp, Homo sapiens
  misc_feature: GYAE6OF02HSZQA.5.57.F02.1.454.CMB.1.raw
  modified_base (202)..(202): a, c, t, g, unknown or other
  misc_feature (202)..(202): n is a, c, g, or t
  modified_base (332)..(332): a, c, t, g, unknown or other
  misc_feature (332)..(332): n is a, c, g, or t
  modified_base (349)..(349): a, c, t, g, unknown or other
  misc_feature (349)..(349): n is a, c, g, or t
  modified_base (464)..(464): a, c, t, g, unknown or other
  misc_feature (464)..(464): n is a, c, g, or t
tcagatcagacacgcacgaccggtgctcgatttagctcgatatagttgggtttgggggaggaactgctaagttaggacccagacggaaccatggaagccccagcgcagcttctcttcctcctgctactctggctcccagataccgttggggagatcgtgatgacgcagtctccagccatcctgtctgtgtctccaggggganagagcccaccctctcctgcagggccagtcagaacattggtagcaacttagcctggtaccaacaaaaacctggaccagcctccagactctcatttatcgttcatccaccgaggccactgatcgtcccaacngattcagtgcagaggtntgggacagacttcagtctcacatcagcagctacagtctagaagtacttggctagtttatactgtacaaactatgtgtacagtggcctacgaacgttccggaccgagggaccctanaggtacgatacgtcaggcgaacgtaggtggacgtgtaccacctatcgttacgttccttatacccg

SEQ ID NO: 91530 - DNA, 525 bp, Homo sapiens
  misc_feature: GYAE6OF02H7IHH.5.57.F02.1.454.CMB.1.raw
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggtancaacttagcctggtaccaacaaaaacctggaccagccctcccagacctcctcatttatcgttcatcccaccagggccactgatcgtcccaacagattcagtggcagagggtctgggacagacttcagtctcaccatcagcagcgtacagtctagaagtacttggactagtttattactgtacaactagtgtggtcaggtcggcctcgaaccgttcggacccaagggccaacgagtgatagtcgaggacgaagtggtcgactcgacaccatcgtcgttctacg

SEQ ID NO: 91531 - DNA, 491 bp, Homo sapiens
  misc_feature: GYAE6OF02HUHJD.5.57.F02.1.454.CMB.1.raw
  modified_base (302)..(302): a, c, t, g, unknown or other
  misc_feature (302)..(302): n is a, c, g, or t
  modified_base (425)..(425): a, c, t, g, unknown or other
  misc_feature (425)..(425): n is a, c, g, or t
  modified_base (460)..(460): a, c, t, g, unknown or other
  misc_feature (460)..(460): n is a, c, g, or t
  modified_base (462)..(462): a, c, t, g, unknown or other
  misc_feature (462)..(462): n is a, c, g, or t
  modified_base (467)..(468): a, c, t, g, unknown or other
  misc_feature (467)..(468): n is a, c, g, or t
  modified_base (477)..(478): a, c, t, g, unknown or other
  misc_feature (477)..(478): n is a, c, g, or t
  modified_base (482)..(482): a, c, t, g, unknown or other
  misc_feature (482)..(482): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgccagggccagtcagaacattggtagcaacttagcctaggtaccaaacaaaaacctggaccagcctcccagactcctcatttancgttcatccaccagggccactgactcgtcccaaccagattacagtggcagagggtctgggacagacttcagtctacaccatcagcagcgtacagtctagaagtactggactagtttattactntacaacatgtgtcagtgcctgacgtcgccaggcangngatannggcatgtgnncacngtctgtctc

SEQ ID NO: 91532 - DNA, 497 bp, Homo sapiens
  misc_feature: GYAE6OF02FFQAX.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccaggccactgatgtcccaaccagattcagtggcagaggtctgggacagacttcagtctcaccatcagcagcgtacagtctgaagcttggcagtttatactgtacaacaatgtggtcagtggcctcgaacgttcggcccagggtaccacgagtgatatcgaggcgaactgtgctgccaccatctgtcttc

SEQ ID NO: 91533 - DNA, 564 bp, Homo sapiens
  misc_feature: GYAE6OF02HN4VL.5.57.F02.1.454.CMB.1.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagccaccctctcctgcagggccagtcagaacattggtancaacttagcctggtaccaaacaaaaacctggccagcctccagactcctcatttatcgttcactccaccagggccactgatcgtacccaaccagattcagtcgcagaggtctgggacagacttcagtctcacatcagcagtcgtacagtctagaagtacttggactagtttattactgtacaaactaatgtgtacagttcggaccctcgtaacggttccggacccgaacggggacccaacgtagtacggtatacgtacgaacggccgtaaacgtggtacgggtccgtcgaccgtaccctaagttccgtacgttcctttaccg

SEQ ID NO: 91534 - DNA, 547 bp, Homo sapiens
  misc_feature: GYAE6OF02F6N6P.5.57.F02.1.454.CMB.1.raw
  modified_base (201)..(201): a, c, t, g, unknown or other
  misc_feature (201)..(201): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggaccagcctcccagacctcctcatttatcgttcactcccaccagggccactgactcgtaccccaaccagacttcgagtcggacaggtagggtctaggggacagtacttacagtcncaccntcagcagcgtacngtctagaagtacttggactagtttatactgtacaaactagtgtagtcagtcgcctacggaacgttccgaccgacgggacctacgagtagactagtacgacgggacgtaacgtgcggtctcgaccaccgagtcctgtcccttac

SEQ ID NO: 91535 - DNA, 594 bp, Homo sapiens
  misc_feature: GYAE6OF02IDIII.5.57.F02.1.454.CMB.1.raw
  modified_base (152)..(152): a, c, t, g, unknown or other
  misc_feature (152)..(152): n is a, c, g, or t
  modified_base (241)..(241): a, c, t, g, unknown or other
  misc_feature (241)..(241): n is a, c, g, or t
  modified_base (400)..(400): a, c, t, g, unknown or other
  misc_feature (400)..(400): n is a, c, g, or t
  modified_base (433)..(433): a, c, t, g, unknown or other
  misc_feature (433)..(433): n is a, c, g, or t
  modified_base (450)..(450): a, c, t, g, unknown or other
  misc_feature (450)..(450): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttgggganatcgtgatgacgcagtctccagccatcctgtctgtgtctccaggggagagagccaccctctcctgcagggccagtcagaacattggtancaacttagcctaggtaccaaacaaaaacctggaccagccctacccagacctcctaccatttactccgttacactccacctagggccactacgatcgtcccaacagattcagtgcaggaggtctgggacagacttcgagtctacaccatcagcagctacngtctagaagacttggactaagttttactacgtntacaataagtgtcgtanaggtcgacctacgtaacgttccggacccgtagggaacccaacgtaggtggtactacgtaccggaacgggtaaccgacggttacggttacgggaccgtttacgggaccttaacccgtagtacccgtttcgttacccgtttacccg

SEQ ID NO: 91536 - DNA, 522 bp, Homo sapiens
  misc_feature: GYAE6OF02IVNJS.5.57.F02.1.454.CMB.1.raw
  modified_base (297)..(297): a, c, t, g, unknown or other
  misc_feature (297)..(297): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttagcctggtaccaacaaaaacctggccagcctcccagacctcctcatttancgttcatccaccagggccactgatcgtcccaaccagattcagtggcagagggtctgggacagtacttcagtctcaccatcagcagcctacagtctgaagcttggctagtttattactgtacaataatgtgtcaggtcgcctcgaacgttcggcccagggaccagagtggatacgtcgaggaccgaacgtggtcggtactgaccacctacgtctacggtcttaccg

SEQ ID NO: 91537 - DNA, 554 bp, Homo sapiens
  misc_feature: GYAE6OF02IARUG.5.57.F02.1.454.CMB.1.raw
  modified_base (437)..(437): a, c, t, g, unknown or other
  misc_feature (437)..(437): n is a, c, g, or t
  modified_base (451)..(451): a, c, t, g, unknown or other
  misc_feature (451)..(451): n is a, c, g, or t
tcagatcagacacgcacgaccggtgctcgatttagctcgatatagttgggtttgggggagggaacgtgctcagttaggacccagacggaaccatggaagccccagcgcagcttctcttcctcctgctactctggctcccagataccgttgggagatcgtgatgacgcagtctccagccatcctgtctgtgtctccccaggggagagagccaccctctcctgcagggccagtcagaacattggtagcaacttagcctggtaccaaacaaaaacctggaccacgcctacccagacctcctcatttactcgttcactccaccacggccactcgatcgtaccccaaaccagtaattccgaagtcggcagagggtcgtgggacaagacttcagtctcaccatcagcaagcgtacagtcagaagacttggcagtttatacttnactaacaatgtgtnaggtcgcctacgaacgttcgaccgcgggtaccaacgagtgatactcgaagggtaccgtaacgtagtacggcgtacgtaccgacctaagtctcggtactttccg

SEQ ID NO: 91538 - DNA, 572 bp, Homo sapiens
  misc_feature: GYAE6OF02IZWPN.5.57.F02.1.454.CMB.1.raw
  modified_base (201)..(201): a, c, t, g, unknown or other
  misc_feature (201)..(201): n is a, c, g, or t
  modified_base (398)..(398): a, c, t, g, unknown or other
  misc_feature (398)..(398): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggtagcaacttagcctggtaaccaacaaaaacctggaccagccctcccagacctcctctatttatcgttacataccaccacgggccactgatcgtacccaaccagattcagtgcagacgggtctgggacagacttcgagtccacacatcagcagcgtacngtctgaagtacttggctagtttattactgtacaactatgtggtctaggtcggtccgtacgtaaccggttccggacccgtaacgggacccaacgaggttcggattacgtacggaacggaccggtaaagtcggtacggaccgttcggaccaccgtagtaccgttcgttccgttacc

SEQ ID NO: 91539 - DNA, 538 bp, Homo sapiens
  misc_feature: GYAE6OF02FHVKD.5.57.F02.1.454.CMB.1.raw
  modified_base (199)..(199): a, c, t, g, unknown or other
  misc_feature (199)..(199): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttgggagatcgtgatgacgcagtctccagccatcctgtctgtgtctccagggganagagccaccctctcctgcagggccagtcagaacattggtagcaacttagcctggtaccaacaaaacctggccagcctcccagactcctcatttatcgttcatccacaggccactgatgtcccaaccagattcagtggcaggagggtctgggacaggacttcagtctcaccatcagcagcgtacagtctgaagtacttggctagtttacttactgtacaacaatgtggtcaggtgccctacgaaccgttcggccccaagggacccacgacgtggatacgtccgaagggtccgaactggtggaccttaggccctaacccgtattccgtagttcctttaccg

SEQ ID NO: 91540 - DNA, 663 bp, Homo sapiens
  misc_feature: GYAE6OF02G1Z74.5.57.F02.1.454.CMB.1.raw
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgcccaccctctcctgcgacgggccaggtcaagaactagttgggtagctaaacgttacgccgttacggtaaacccaaaaccaaaaaacccgtgggaccccaacgcccctaccccaagtaccttcctactacttttactccgtttacacttcccaaccgacgggacctactgactcgtaccccaacctaagtacttccgaggtcggacgaggtacgggttccgtaggggacctaaggtacttaccgacggttcctaccaacctatccgacgtcgacgtcgtaacagtacctagaacgtacgttcggacttagtttactacgtatacaatagtgtacggtacgtaggtcgaccgtacggtaacgtccggaccgacgggacacgtagtaggtatacgtcggaacggtcgtaacgtgggtcggactcggacctaaccgtacttcgttacgtaccgttaccg

SEQ ID NO: 91541 - DNA, 516 bp, Homo sapiens
  misc_feature: GYAE6OF02HCR1P.5.57.F02.1.454.CMB.1.raw
  modified_base (201)..(201): a, c, t, g, unknown or other
  misc_feature (201)..(201): n is a, c, g, or t
  modified_base (384)..(384): a, c, t, g, unknown or other
  misc_feature (384)..(384): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccaggccactgatcgtcccaaccagattcagtggcagagggtctgggacagacttcagtctcacatcagcagcgtanagtctagaagacttggctagtttattacgtgtacaactatgtggtcaggttggcctcgaacgtttccggacccgtagggacccaacgaggtggatagtcgaggtcgaactgtggctggcaccatctgtcttc

SEQ ID NO: 91542 - DNA, 620 bp, Homo sapiens
  misc_feature: GYAE6OF02IVW25.5.57.F02.1.454.CMB.1.raw
  modified_base (551)..(551): a, c, t, g, unknown or other
  misc_feature (551)..(551): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtcctccgaggggagagacgcccaccctctcctgcgagggccagtcaagaactagttggtacgactaacttacgccgtacggtaacccaaacaaaaaccgtcggccaacgccctacccagacctcctctatttactcgtacactcccaccgaggaccctactgtactaccgtacccaaccagtacttcgaggtgcgaggagggtcgagggacagtacttcagtcctaccacctatcagacacgtacgtacgacgtctaagaacgtacgttgggacttaagtttacttaacgtgtaacaatagtggttacgacgtagtcggtacctacggtaaccggtcggacccggaggtaacccacgtaggnggtactacgtacgacgggtaccgtacgtaggtcggtacctaggaccctcgtactcgtgttaccttaccg

SEQ ID NO: 91543 - DNA, 686 bp, Homo sapiens
  misc_feature: GYAE6OF02I0XNU.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggganagacgccacctctcctgcagggccagtcagaacnttggancaacttagcctaggtaccaacaaaaacctggaccagcctcccacgactcctactatttactcgttcactccaccaggccactagatcgaccctaacagtattacagtcggcaggacgggtcgtagggacaacggtcttacgagttcctacaccgtactacgtacgcgaacgtaccggtaaccgtaggtacctaggtaaacgtacgtttacgggacttaacggttttaacttaaccgtttagttaacccgaaaacttaacgtttgggttacggttaccgtagggttaccggaccgttaccggtaacggtttacccgggtacccgtaaccggggtaacccaaccgtacggtacggtacgtaagttaccgaacgggtaacgtaacccgttagggtaccgtgttaccggacctaacccggtagtaccgtttacggcgttttaacccg

SEQ ID NO: 91544 - DNA, 571 bp, Homo sapiens
  misc_feature: GYAE6OF02IGU36.5.57.F02.1.454.CMB.1.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (351)..(351): a, c, t, g, unknown or other
  misc_feature (351)..(351): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctctcctgcagggccagtcagaacattggancaacttgcctggtaccaaacaaaaacctggccagcctcccagacctcctctatttatcgttcactccaccgaggccactgatcgtcccaaccagtattcagtgcaggngggtctgggacagtacttcgatctcaccatcagcagacgtacagtctagaacgtcgttggctagtttacttactgtactaactaagtggtaggttacacggtcggtaccctacggtaaccggttccggacccgtaaggggaccctacgaggttaggacttacgtcgaacgggtaccgtaacgtgtacggcgtcggacctacctagtccttcgttaccttc

SEQ ID NO: 91545 - DNA, 499 bp, Homo sapiens
  misc_feature: GYAE6OF02GWKKU.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (423)..(423): a, c, t, g, unknown or other
  misc_feature (423)..(423): n is a, c, g, or t
  modified_base (465)..(465): a, c, t, g, unknown or other
  misc_feature (465)..(465): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctggtaccaaacaaaaacctggaccagcctcccagactcctcatttatcgttcatccaccaggccactgatcgtcccaaccagacttcagtgcagagggtctgggacagacttcagtctcaccatcagcagcgtacagtctagaagtacttggactagtttatactgtacaanatgtgtcagtgcctgaacgttcgccaggaccacgagtgatancgaggcgtaacgtgtgctgcaccatcgtgtctac

SEQ ID NO: 91546 - DNA, 515 bp, Homo sapiens
  misc_feature: GYAE6OF02HQQI9.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaaacaaaaacctggccagcctcccagactcctcatttatcgttcatccaccagggccactgatcgtacccaaccagattcagtgcagagggtctgggacagacttcagtctcaccatcagcagcgtacagtctagagacgttggactagtttatactgtacaactagtgtgtcaggttggcctcgaacgttcggcccgtagggaccacgagtgagtactcgaggacgagtgtgctcgacacctatcttgtcttacg

SEQ ID NO: 91547 - DNA, 612 bp, Homo sapiens
  misc_feature: GYAE6OF02IFY2E.5.57.F02.1.454.CMB.1.raw
  modified_base (200)..(200): a, c, t, g, unknown or other
  misc_feature (200)..(200): n is a, c, g, or t
  modified_base (240)..(240): a, c, t, g, unknown or other
  misc_feature (240)..(240): n is a, c, g, or t
  modified_base (352)..(352): a, c, t, g, unknown or other
  misc_feature (352)..(352): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctaggtaaccaacaaaaacctggaccagcctcccagactcctcatttatcgttcatccaccgaggccactcgatcgtacccaaaccagattcagtggacaggngggtctgggacaggacttcagtctcaccatcagcagcgtacagtctgaaacgtacttggactagttttaattactagtactaaactaagttggtaggtacagttcggtaccctacggtaaacggtttcccgggacccgtaacggggaccctaacgtaaggttacgggacgttaagttccgaaaggggtaccgtaaacggttcggttacggacccgttaggaccctaacccgtacgttccgttacggttaccctttaaccg

SEQ ID NO: 91548 - DNA, 466 bp, Homo sapiens
  misc_feature: GYAE6OF02JK6KC.5.57.F02.1.454.CMB.1.raw
  modified_base (454)..(466): a, c, t, g, unknown or other
  misc_feature (454)..(466): n is a, c, g, or t
tcagatcagacacgcacgaccggtgctcgatttagctcgatatagttgggtttgggggaagaggaagactgacggtcccccaggagtccagagtgcgtcgcaagtattggcagtgtgaaatttgacaccttatatgcagactctgtgaggggccgcttcaccgtgtccagagacaactccaagaacgccgtctatttgcagatggacagcctgagagtcgacgacacgggcatctattatgtacggcgccgagcaatactctcttactttctggagtcagggagtcccggtcactggtctcctcagcctccaccaaggcccatcggtcttcccccgtggccaccctcctccaacgtacgccacctctcgggggcacagccggccctcgggctcgcctggtccaaggctacgttcccgtgtcctgatctgacgcggctggcaggcgtccatacgnnnnnnnnnnnnn

SEQ ID NO: 91549 - DNA, 534 bp, Homo sapiens
  misc_feature: GYAE6OF02HC48W.5.57.F02.1.454.CMB.1.raw
  modified_base (249)..(249): a, c, t, g, unknown or other
  misc_feature (249)..(249): n is a, c, g, or t
  modified_base (335)..(335): a, c, t, g, unknown or other
  misc_feature (335)..(335): n is a, c, g, or t
  modified_base (418)..(418): a, c, t, g, unknown or other
  misc_feature (418)..(418): n is a, c, g, or t
  modified_base (434)..(434): a, c, t, g, unknown or other
  misc_feature (434)..(434): n is a, c, g, or t
  modified_base (458)..(458): a, c, t, g, unknown or other
  misc_feature (458)..(458): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
tcagatcagacacgcacgaccggtgctcgatttagctcgatatagttgggtttgggggaggaacgtgctcagttaggacccagacggaaccatggaagcccagcgcagcttctcttcctcctgctactctggctcccagataccgttggggagatcgtgatgacgcagtctccagccatcctgtctgtgtctccgaggggagagagccaccctctcctgcacgggccaaggtcaagaacattgggtacncaaacttagcctaggtacccaaacaaaaaacctggacccagcccctcccagacctcctacacttttatcgtttcacttcccaaccnggaccactgatcgtcccaaaccagacttcaaggtgcagagggtctgggacagacttgagtctacacccatcaagtcagcctanagtctagaatactggntagttattactagtacaaacatgngtcagtgacctgaaacttcgctacggacacagngatancgtagagactgtacgtgcgcaaccgatactcgtcttac

SEQ ID NO: 91550 - DNA, 576 bp, Homo sapiens
  misc_feature: GYAE6OF02INZKA.5.57.F02.1.454.CMB.1.raw
  modified_base (205)..(205): a, c, t, g, unknown or other
  misc_feature (205)..(205): n is a, c, g, or t
  modified_base (563)..(563): a, c, t, g, unknown or other
  misc_feature (563)..(563): n is a, c, g, or t
tcagatcagacacgcacgaccggtgctcgatttagctcgatatagttgggttggggagggaactgctcagttaggacccacgacggaaccaatggaagccccacgcgcagcttctcttcctcctgctactctggctcccagataccgttggggagatcgtgatgacgcagtctccagccatcctgtctgtgtctccaggggaganagcccaccctctctgcagggccagtcagaacattggtagcaacttagcctggtaaccaacaaaaacctaggccagcctcccagactcctcatttatcgttcatccaccgagggccactgactcgtcccaaccagattcagtggcgaggtacggtcgtagggacacgtacttcacgtctaccacactacagcgagacgtacgacgtactagaacgtacgttggactaagttttaacttacgtcgtacaactagttggtggtacgaggttcgtcccgtacgtaaccggtccggacccgaacgggtacaacgtagtagtactaatcggaaggaccgtatggtcgtgtaccgctacacgttnttccgtattaccg

SEQ ID NO: 91551 - DNA, 567 bp, Homo sapiens
  misc_feature: GYAE6OF02FF504.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaacaaaaacctggccagcctcccagactcctcatttatcgttcatccaccagggccactgatgtcccaaccagattcagtggcaggagggtctgggacagactcagtctcaccatcagcagcgtacagtctagaagtacttggactaagttttacttactagttacaaacaagttgtaggtactaggtcggcctacggtaaacggtttccgggacccgagggaacccacgtaaggtacggtatacgtcgaacgggaccgaaacgtcggtcggaccgttcgacctacccgtattccgtcggttcttaccg

SEQ ID NO: 91552 - DNA, 530 bp, Homo sapiens
  misc_feature: GYAE6OF02HUWNB.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctggtaccaaacaaaaacctggaccagcctcccagacctcctcatttatcgttcatccaccagggccatcgatcgtacccaacagtattcagtggcagagggtctgggacagacttcacgtctacaccatcagcagcgtacagtctagaaagtcttggactagtttattactgtacaactaatgtgtcaggtcgtacctacgaacgttcggacccaagggaccacgaggtgactatcgaggccgtaacgtgttacgctcgaccaccatcttgtccttacg

SEQ ID NO: 91553 - DNA, 508 bp, Homo sapiens
  misc_feature: GYAE6OF02FX6Y7.5.57.F02.1.454.CMB.1.raw
  modified_base (201)..(201): a, c, t, g, unknown or other
  misc_feature (201)..(201): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaaccaacaaaaacctggaccagcctcccagacctcctcatttatcgttcatccaccacgggccactgatcgtaccccaaccagtacttcagtggcaggagggtctgggacagacttcagtctcaccatcagcagcgtacagtctagaagtacgttggactagtttattactgtacaactaatgtgtcagtggcctcgaacgtcgaccaggccagngtgatntacgaggcgactgtgctgcaccatctcgtctc

SEQ ID NO: 91554 - DNA, 614 bp, Homo sapiens
  misc_feature: GYAE6OF02I8KJH.5.57.F02.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (500)..(500): a, c, t, g, unknown or other
  misc_feature (500)..(500): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgccaccctctcctgcagggccagtcagaacnttggtancaacttagcctggtaaccaaacaaaaacctggaccagcctacccgagacctacctactagtttaactcgttcaactccaaccgtacgggcctaactcggaacttccgtaccccaaacctagaactttcgaaggttcggacacggaagggtcctagggaacagtacttcgaagtcctacgaccatcagcgaacgcgtaaactgtactaggaaagtacgttggacttagttattactagtacaaatatgtgtactagnggtacctacgtaacgtccgtaccgcggtaaccacgtacggtgacgtatacggaacggactaacgtaggtacggacgtcggaccctaacctacgtacgttcgtaccgtttaaccg

SEQ ID NO: 91555 - DNA, 518 bp, Homo sapiens
  misc_feature: GYAE6OF02JC9FY.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (480)..(480): a, c, t, g, unknown or other
  misc_feature (480)..(480): n is a, c, g, or t
  modified_base (507)..(507): a, c, t, g, unknown or other
  misc_feature (507)..(507): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttgcctggtaccaacaaaaacctggaccagcctccagactcctcatttatcgttcactccaccgacgggccactgactcgtaccccaaccagtacttcagtcggcaggagggtctagggacagtacttcagtctcaccatcagcagcgtacagtctagaagtcttggctagtttattactgtacaatatgtgtcagtcgccgtacgacgttcgaccgaggaccacgagtgatacncgaggacgaacgtgtcgtctgcacctntctcgtcttcg

SEQ ID NO: 91556 - DNA, 501 bp, Homo sapiens
  misc_feature: GYAE6OF02F680Y.5.57.F02.1.454.CMB.1.raw
  modified_base (201)..(201): a, c, t, g, unknown or other
  misc_feature (201)..(201): n is a, c, g, or t
  modified_base (423)..(423): a, c, t, g, unknown or other
  misc_feature (423)..(423): n is a, c, g, or t
  modified_base (464)..(464): a, c, t, g, unknown or other
  misc_feature (464)..(464): n is a, c, g, or t
  modified_base (471)..(471): a, c, t, g, unknown or other
  misc_feature (471)..(471): n is a, c, g, or t
  modified_base (492)..(492): a, c, t, g, unknown or other
  misc_feature (492)..(492): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccagggccactgatgtccccaaccagacttcagtggcagagggtctgggacagacttcagtctcaccatcagcagcgtacagtctgaaagacttggctagtttattactgtacaanaatgtggtcagtggcctcgaacgttcgaccacggaccacgngtgatancgaggcaactgtgctgcaccntctgtcttc

SEQ ID NO: 91557 - DNA, 484 bp, Homo sapiens
  misc_feature: GYAE6OF02FNL9X.5.57.F02.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (425)..(425): a, c, t, g, unknown or other
  misc_feature (425)..(425): n is a, c, g, or t
  modified_base (447)..(447): a, c, t, g, unknown or other
  misc_feature (447)..(447): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctntcctgcagggccagtcagaacattggagcaacttagcctggtaccaacaaaaacctggccagcctcccagactcctcatttatcgttcatccaccaggccactgatgtcccaacagattcagtggacagagggtctgggacagactcagtctcaccatcagcagcgtacagtctgaagtcttggctagtttattactgtacaacaatgtgtnagtgcctgacgtcgccaggcangtgatatcgaggcgaactgtgctgcaccatctgtctc

SEQ ID NO: 91558 - DNA, 582 bp, Homo sapiens
  misc_feature: GYAE6OF02IQUAQ.5.57.F02.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (244)..(244): a, c, t, g, unknown or other
  misc_feature (244)..(244): n is a, c, g, or t
  modified_base (390)..(390): a, c, t, g, unknown or other
  misc_feature (390)..(390): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctntcctgcagggccagtcaagaacattggancaacttagcctggtaaccaaacaaaaacctggaccagccctaccagacctcctctatttactcgttcactaccaccaggccactgactcgtacccaacatacttcagtggcagacgggtctagggacacgtacttcagtctacacntcagcacgactacgagtctagaagtacgttgactagtttatacgtcgtacaaactaattggtagtactaggtcggtacctacggtaaccggttcgaccgtaacggaccgaacgacgttaggactacgtcgaacgggtacgtaacgttggtacggtccgtacgtaccgacctagtacgttcgttaccttaccg

SEQ ID NO: 91559 - DNA, 538 bp, Homo sapiens
  misc_feature: GYAE6OF02HOC67.5.57.F02.1.454.CMB.1.raw
  modified_base (241)..(241): a, c, t, g, unknown or other
  misc_feature (241)..(241): n is a, c, g, or t
  modified_base (369)..(369): a, c, t, g, unknown or other
  misc_feature (369)..(369): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggancaacttagcctggtaccaacaaaaacctggccagcctcccagactcctcatttatcgttcatccaccagggccactgatcgtacccaaccagattcagtggcagagggtctgggacagacttcagtcncaccatcagcagcgtacagtctagaacgtacgttggactagtttattactgtacaatatgtggtcagtcggcctacgtaacggttccggacccgacgggaccacgtagtggtactagtccgaaggaccgtaacgtggtacggctcgaccacctagtcctcgtccttacg

SEQ ID NO: 91560 - DNA, 610 bp, Homo sapiens
  misc_feature: GYAE6OF02IEETJ.5.57.F02.1.454.CMB.1.raw
  modified_base (201)..(201): a, c, t, g, unknown or other
  misc_feature (201)..(201): n is a, c, g, or t
  modified_base (243)..(243): a, c, t, g, unknown or other
  misc_feature (243)..(243): n is a, c, g, or t
  modified_base (452)..(452): a, c, t, g, unknown or other
  misc_feature (452)..(452): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagacgccaccctctcctgccagggccagtcagaacattggancaaacttacgcctaggtaccaaaccaaaaacctcggaccagccctcccagacctcctactatttactcgttcactccaccacgggccacgtgactcgtaccccaaacagtacttcagtcggcaggtagggtctgggactagactttcgacgtctacacctatcagcagcgtaacagtctagaagtacttggacttaagtttattacgtntacaaactagtgtcgtcaggtcggccctacggtaaccgttcggacccgtacggggaccctacgaaggtcggtaacttacgtaccggaacgggtaccgtaaacggtcggttacggccttacggacctacccgtaagtttcccgttcggttaccttaccg

SEQ ID NO: 91561 - DNA, 500 bp, Homo sapiens
  misc_feature: GYAE6OF02H3LCX.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaacaaaaaacctggccagcctcccagactcctcatttactcgttcatccaccaggccactgatgtcccaaccagattcagtgcagaggtctgggacagacttcagtctcaccatcagcagcgtacagtctgaagtcttggctagtttattactgtacaacatgtgtacagtcgcctacgaacgttcggccagggaccacgagtgatacgtcgaggcgtaactgtgctgcaccatctcgtctc

SEQ ID NO: 91562 - DNA, 616 bp, Homo sapiens
  misc_feature: GYAE6OF02HA83P.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctctcctgcagggccagtcagaacattggagcaacttagcctggtaaccaacaaaaacctggaccagccctcccagacctcctactatttactcgttcactccaccgacgggaccacgtgactcgtacccaaccagtattcaggtcggacaggtagggtcgtagggactacgtacttcgacgttcctaccgaccactcacggcacgcgtaacagtctaggaagtacgttggactaagtttattactagtacaataagttgtaggtacaggtcgcctacggtaaccggttccggacccgaaggggtaccccaagtacggtaggacttagtaccggtaacgggacccgtaacgttcggtacgggtcgtacggtaccgacccgttagttaccgttcgttaccgttaccg

SEQ ID NO: 91563 - DNA, 494 bp, Homo sapiens
  misc_feature: GYAE6OF02G9CH8.5.57.F02.1.454.CMB.1.raw
  modified_base (394)..(394): a, c, t, g, unknown or other
  misc_feature (394)..(394): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttagcctggtaccaacaaaaacctggccagcctccccagactcctcatttatcgttcatccaccagggccactgatgtcccaaccagattcagtggcagagggtctgggacagacttcagtctcaccatcagcagcgtacagtctgaanacttggctagtttattactgtcaacatgtgtcaggtgcctgaacgttcggcccaggaccacgagtgatagtcaggcgaactgtgctgcacatctgtcttc

SEQ ID NO: 91564 - DNA, 512 bp, Homo sapiens
  misc_feature: GYAE6OF02GXWXT.5.57.F02.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (507)..(507): a, c, t, g, unknown or other
  misc_feature (507)..(507): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctntcctgcagggccagtcagaacattggancaacttgcctggtaccaacaaaaacctggccagcctcccagactcctcatttatcgttcatccaccagggaccactgatcgtacccaaccagattcagtggcagagggtctgggacagactcagtcncaccntacagcagtcgtacagtctagaagtacttggctagtttattacgtgtacaacaatgtggtcagtggcctacgacgttcgacccagggaccacgagtcggatagtcgaaggcgaacgtgtcgctagcgacatctntctac

SEQ ID NO: 91565 - DNA, 509 bp, Homo sapiens
  misc_feature: GYAE6OF02IYQ91.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctctcctgcagggccagtcagaacattggancaacttgcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagcttggctagtttattactgtacaacaatgtggtcagtcgcctcgaacgttcggcccagggaccacgagtggatatcgaggcgaacgtggtggctcggcaccagtctcgttcttaccg

SEQ ID NO: 91566 - DNA, 493 bp, Homo sapiens
  misc_feature: GYAE6OF02FGJAP.5.57.F02.1.454.CMB.1.raw
  modified_base (201)..(201): a, c, t, g, unknown or other
  misc_feature (201)..(201): n is a, c, g, or t
  modified_base (409)..(409): a, c, t, g, unknown or other
  misc_feature (409)..(409): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaacaaaaacctggccagcctcccagactcctcatttatcgttcatccaccagggccactgatgtcccaaccagattcagtgcagagggtctgggacagactcagtctcaccatcagcagcgtacagtctgaagtacttggcagtttatacngtacaanatgngtcagtgcctcgaacgttcgccaggaccacgagtggatagtcgaggcgaactgtggctgcaccatctgtctac

SEQ ID NO: 91567 - DNA, 490 bp, Homo sapiens
  misc_feature: GYAE6OF02H56SG.5.57.F02.1.454.CMB.1.raw
  modified_base (201)..(201): a, c, t, g, unknown or other
  misc_feature (201)..(201): n is a, c, g, or t
  modified_base (380)..(380): a, c, t, g, unknown or other
  misc_feature (380)..(380): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaacaaaaacctggaccagcctcccagactcctcatttatcgttcatccaccaggccactgatgtcccaacagattcagtgcagaggtctgggacagacttcagtctcacatcagcagctacngtctgaagacttggctagtttatactgtacaacatgtgtcagtgcctcgaacgttcgaccagggaccacgagtgatatcgaggcaacgtgtgctgcaccatctgtctacg

SEQ ID NO: 91568 - DNA, 506 bp, Homo sapiens
  misc_feature: GYAE6OF02I6GBF.5.57.F02.1.454.CMB.1.raw
  modified_base (201)..(201): a, c, t, g, unknown or other
  misc_feature (201)..(201): n is a, c, g, or t
  modified_base (243)..(243): a, c, t, g, unknown or other
  misc_feature (243)..(243): n is a, c, g, or t
  modified_base (297)..(297): a, c, t, g, unknown or other
  misc_feature (297)..(297): n is a, c, g, or t
  modified_base (419)..(419): a, c, t, g, unknown or other
  misc_feature (419)..(419): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcaagaacattggtancaacttagcctggtaccaacaaaaacctggccagcctccagactcctcatttancgttcatccaccaggccactgatcgtacccaaccagattcagtggcagagggtctagggacagacttcagtctcaccatcagcagcgtacagtctagaagcttggctagtttatctgacaanatgtgtcagtgcctagaacgttcggaccctaggaccacagtagatatcgaggacgaactgtgcgtcgcaccagtcctagtccttacg

SEQ ID NO: 91569 - DNA, 535 bp, Homo sapiens
  misc_feature: GYAE6OF02JG3W6.5.57.F02.1.454.CMB.1.raw
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (301)..(301): a, c, t, g, unknown or other
  misc_feature (301)..(301): n is a, c, g, or t
  modified_base (366)..(366): a, c, t, g, unknown or other
  misc_feature (366)..(366): n is a, c, g, or t
  modified_base (383)..(383): a, c, t, g, unknown or other
  misc_feature (383)..(383): n is a, c, g, or t
tcagatcagacacgcacgaccggtgctcgatttagctcgatatagttgggtttgggggtaggaacgtgctcagttaggacccagacggaaccatggaagccccagcgcagcttctcttcctcctgctactctggctcccagataccgttggggagatcgtgatgacgcagtctccagccatcctgtctgtgtctccagggganagagcccaccctntcctgcagggccagtcagaacattggagcaacttagcctggtaccaacaaaaacctggaccagcctcccagactcctcatttacncgttcatccaccagggccactgaactcgtcccaacctagattcagtcggcagtaggtctgggacngacttcagtctacaccntacagcagcgtacagtctagaagacttggctagtttatactgtacaactatgtgtcagtgcctagaacgttcgaccgtacggacacgagtaggacttagcagggtacgaacgtcgtggtactaggtaccaccgtatcgttacggtcttaccg

SEQ ID NO: 91570 - DNA, 513 bp, Homo sapiens
  misc_feature: GYAE6OF02IAEOC.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (373)..(373): a, c, t, g, unknown or other
  misc_feature (373)..(373): n is a, c, g, or t
  modified_base (391)..(391): a, c, t, g, unknown or other
  misc_feature (391)..(391): n is a, c, g, or t
  modified_base (497)..(497): a, c, t, g, unknown or other
  misc_feature (497)..(497): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggancaacttgcctggtaaccaacaaaaacctggccagcctcccagactcctctattatcgttcactccaccagggccactgatcgtacccaaacagtacttcagtgcaggagggtctggacagacttcgagtcncaccatcagcagcgtacngtctagaacgtcttggactagtttatacgtgactaacgtatgtaggtcagtcgcctacgaacgttcgacccgaggaccagagtgatagtcgaggacgtaactgcgntgacaccatctgtctc

SEQ ID NO: 91571 - DNA, 549 bp, Homo sapiens
  misc_feature: GYAE6OF02FUBX7.5.57.F02.1.454.CMB.1.raw
  modified_base (201)..(201): a, c, t, g, unknown or other
  misc_feature (201)..(201): n is a, c, g, or t
  modified_base (295)..(295): a, c, t, g, unknown or other
  misc_feature (295)..(295): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttgcctggtaccaacaaaaacctggccagcctcccagactcctcatttancgttcactccaccagggcccactcgatcgtacccaaccagacttcagtggcagagggtctgggacaggacttcagtctcaccatcagcagcgtacagtctagaagtcttggctagtttattactgtacaacgtaattgtagtcaggtcggcctacgtaacgttccggacccgaacgggtacccacgagtgatacgtcgaaggtaccggaacgtggtcggacttcggacctaccgattccgttaggtccttaccg

SEQ ID NO: 91572 - DNA, 546 bp, Homo sapiens
  misc_feature: GYAE6OF02IGGKD.5.57.F02.1.454.CMB.1.raw
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggancaacttagcctggtaaccaacaaaaacctggaccagcctacccagacctcctcatttactcgttcactccaccagggccactgatcgtcccaacagattcagtggcagagggtctgggacagacttcagtctcacatcagcagcgtacagtctagaatacgttggctagtttatacgtgtaccaataatgtaggtcaggtcggcctagaaccgttcggacccaaggggacccaacgagtacggatacgtacggaaggaccgtaacgtggtcggtactcgacctaccgatccgttacgtcttacg

SEQ ID NO: 91573 - DNA, 533 bp, Homo sapiens
  misc_feature: GYAE6OF02F34O5.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctggtaaccaacaaaaacctggccagcctcccagacctcctctatttatcgttcatccaccagggccatgactcgtccccaacagattcagtcgcaggagggtctagggacagacttcagtctcaccatcagccagcgtacagtctagaagtcgttggactagtttatactgtacaactatgtagtcagtcgcctacgaacgtcgacccgaggaccacgagtacggatagtaccgaggtacgaacgtggtacggctacgccaaccgtcgtcgttcgtcttacc

SEQ ID NO: 91574 - DNA, 515 bp, Homo sapiens
  misc_feature: GYAE6OF02GGK27.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctctcctgcagggccagtcagaacattggancaacttgcctggtaccaacaaaaacctggccagcctccagactcctcatttatcgttcatccaccaggccactgatgtcccaacagattcagtggcagagggtctgggacaggacttcagtctcacatcagcagcgtacagtctagaagcttaggctagttttatactgtacaactaatgtagtctagtggcctacggaaccgttcggccgtagggaccacgaggtagatagtcgacggacgtaacgtgtcggctggcaccagtctcgtcttac

SEQ ID NO: 91575 - DNA, 584 bp, Homo sapiens
  misc_feature: GYAE6OF02H6KWO.5.57.F02.1.454.CMB.1.raw
tcagatcagacacgcacgaccggtgctcgatttagctcgatatagttgggtttggggaggaactgctcagttaggacccagacggaaccatggaagccccagcgcagcttctcttcctcctgctactctggctcccagataccgttgggggagatcgtgatgacgcagtctccagccatcctgtctgtgtctccgaggggagagacgcccaccctctcctgcagggccagtcaagaacattggtagcaacttagcctaggtaaccaaacaaaaacctggaccacgcctacccagacctcctactatttactcgttcactccacctacggccactgactcgtacccaacagacttcaggtcgcaggtagggtctagggacagtacttcgagtctccacatcagacagaccgtacgtagtctagaagtacgttggacttaagtttaacttacgttagtacaaactaagtgtacggtgtacggtcggacctacggtaaccggttccggaccgacggacacgtagtacggactagtacggacggtacgtacgtcggttgcgttcgacacctacgtcttacgtcttacc

SEQ ID NO: 91576 - DNA, 517 bp, Homo sapiens
  misc_feature: GYAE6OF02IZ3UX.5.57.F02.1.454.CMB.1.raw
  modified_base (390)..(390): a, c, t, g, unknown or other
  misc_feature (390)..(390): n is a, c, g, or t
tcagatcagacacgcacgaccggtgctcgatttagctcgatatagttgggtttggggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttagcctggtaaccaacaaaaacctggaccagccctcccagactcctcatttatcgttcatccaccagggccactgatcgtcccaacagattcagtggcagagggtctgggacagacttcagtctcaccatcagcacgcgtacngtctgaagtactggctagtttatactgtacaactaatgtgtcagtgcctgacgttcggcccgaggaccacgagtggatagtcgaggtacgacgtgtcggacgtcgacaccgtatcgttcgtcttacc

SEQ ID NO: 91577 - DNA, 540 bp, Homo sapiens
  misc_feature: GYAE6OF02GTVMY.5.57.F02.1.454.CMB.1.raw
  modified_base (241)..(241): a, c, t, g, unknown or other
  misc_feature (241)..(241): n is a, c, g, or t
  modified_base (357)..(357): a, c, t, g, unknown or other
  misc_feature (357)..(357): n is a, c, g, or t
  modified_base (391)..(391): a, c, t, g, unknown or other
  misc_feature (391)..(391): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggancaacttagcctggtaccaaacaaaaacctggaccagcctcccagactcctcatttatcgttcactccaccgaggccactgatcgtcccaaccagacttcagtggacaggagggtcngggacagacttcagtctcaccatcagcagcgtanagtctagaagtcttggactagtttattactgtacaaacatgtggtctagtcgccgtacgaacgttcggacccagggaccacgagtcggatacgtcgaagggaccgaacgtggtacggtcgtacgaccgacctacgtcttcgtcttaccg

SEQ ID NO: 91578 - DNA, 523 bp, Homo sapiens
  misc_feature: GYAE6OF02FUBG0.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggaccagcctcccagactcctcatttatcgttcatccaccagggccactgatcgtcccaaccagattcagtggcagagggtctgggacagacttcagtctcacatcagcagcgtacagtctagaagtcttggcagtttattactgtacaacaatgtaggttcagtggcctcgtaacgttcgcccgagggacccacgacgtggatacgtcgaggacgtaacgtgtacggcttagccaccgatccgtgttcttcg

SEQ ID NO: 91579 - DNA, 512 bp, Homo sapiens
  misc_feature: GYAE6OF02IAI3J.5.57.F02.1.454.CMB.1.raw
  modified_base (200)..(200): a, c, t, g, unknown or other
  misc_feature (200)..(200): n is a, c, g, or t
  modified_base (240)..(240): a, c, t, g, unknown or other
  misc_feature (240)..(240): n is a, c, g, or t
  modified_base (380)..(380): a, c, t, g, unknown or other
  misc_feature (380)..(380): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaattagcctggtaccaaacaaaaacctggccagcctcccagactcctcatttatcgttcatccacaggccactgatgtcccaacagattcagtgcagagggtctgggacagacttcagtctcaccatcagcagcgtacngtctagaagacttggctagtttatacttgtacaacaatgtgtctagtggcctcggtaacgttccggacccagggaccacgagtcggatagtcgaaggtcgaactggtgcgtcgcaccatcgttgtccttacg

SEQ ID NO: 91580 - DNA, 638 bp, Homo sapiens
  misc_feature: GYAE6OF02JMNRN.5.57.F02.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
  modified_base (246)..(246): a, c, t, g, unknown or other
  misc_feature (246)..(246): n is a, c, g, or t
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
  modified_base (317)..(317): a, c, t, g, unknown or other
  misc_feature (317)..(317): n is a, c, g, or t
  modified_base (411)..(411): a, c, t, g, unknown or other
  misc_feature (411)..(411): n is a, c, g, or t
  modified_base (571)..(571): a, c, t, g, unknown or other
  misc_feature (571)..(571): n is a, c, g, or t
tcagatcagacacgcacgaccggtgctcgatttagctcgatatagttgggtttgggggtagggaacgtgcgtcagttaggacccagacggaaccatggaagcccagcgcagcttctcttcctcctgctactctggctcccagactaccgttggggagatcgtgatgacgcagtctccagccatcctgtctgtcttcnccagggganagagccaccctntccgtgcagggccagtcagacattggancaatgctgtaccaacaaaactgaccagcctacccagactcnctattacncgtcatccacgacggccacgtnactacgtacccaaccgtagacttcgagtcggacaggtacggtcgtggacagtacttacacgtctacacctatcgacgcgaacgtccgtaaacgngtcgtacggaacgtaccgttagggaccctttaagggtttaatttaaccggtacgtttaaccaaaccgtaaagttcggtacgggtactaacgggtttacgcccgttaacgttaacccggttcgggtacccgtaaccggggtaccaaacggtcgttaacggngttaacgtacgttccgggaatacccggttagtcggaagtcgaccgtacgaacttctggttaccttcg

SEQ ID NO: 91581 - DNA, 498 bp, Homo sapiens
  misc_feature: GYAE6OF02F5NVU.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccagggccactgatgtcccaaccagattcagtgcagagggtctgggacagacttcagtctcaccatcagcagcgtacagtctgaagacttggctagtttattactgtcaacaatgtgtcagtgcctcgaacgttcgccaggaccacgagtgatagtcgaggacgtaactgtaggctgcaccatctgtcttc

SEQ ID NO: 91582 - DNA, 531 bp, Homo sapiens
  misc_feature: GYAE6OF02HIYJC.5.57.F02.1.454.CMB.1.raw
  modified_base (201)..(201): a, c, t, g, unknown or other
  misc_feature (201)..(201): n is a, c, g, or t
  modified_base (390)..(390): a, c, t, g, unknown or other
  misc_feature (390)..(390): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggagcaacttagcctaggtaaccaaacaaaaacctggaccagcctcccagactcctcattatcgttcatccaccaggccactgatcgtcccaacagattcagtggcaggaggtctgggacagacttcagtctacaccatcagcagcgtaacngtctagaagacttggactagtttatacgtgtacaactaatgtagtcagttggcctagaccgttcggccagggaccacgagtaggatatccgaaggcgtaaacgtgtacggctacggaccaccgtagtcgttcgtccttacg

SEQ ID NO: 91583 - DNA, 572 bp, Homo sapiens
  misc_feature: GYAE6OF02H1O83.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
  modified_base (248)..(248): a, c, t, g, unknown or other
  misc_feature (248)..(248): n is a, c, g, or t
  modified_base (297)..(297): a, c, t, g, unknown or other
  misc_feature (297)..(297): n is a, c, g, or t
  modified_base (376)..(376): a, c, t, g, unknown or other
  misc_feature (376)..(376): n is a, c, g, or t
  modified_base (556)..(556): a, c, t, g, unknown or other
  misc_feature (556)..(556): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagatacccgttgggganatcgtgatgacgcagtctccagccatccctgtcctgtgtctccagggganagacgcccaaccctctcctgccagggccagtcagaacattggancaacttgcctggtaccaacaaaaacctggccagcctacccagactcctnatttatcgttcatccaccaggccactgactcgtacccaacagacttcagttggcagaggtctgggacagacttcagtcncacatcacgcagcgtaacagtctagaagtacttggacctaggttttaacttacgtgttacgaaacgtaatggttagggtactaaggttcggcccttacgtaaaccgtttcggacccgtagggacccacgtaggtgtaagtctacgaacgggtcaacgttgtcggacgtacgccgtaaccngttacctgtcttaccg

SEQ ID NO: 91584 - DNA, 606 bp, Homo sapiens
  misc_feature: GYAE6OF02I79U6.5.57.F02.1.454.CMB.1.raw
  modified_base (365)..(365): a, c, t, g, unknown or other
  misc_feature (365)..(365): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagattgtgatgacgcagtctccagccatcctgtctgtgtctccaggggagagagccaccctctcctgcagggccagtcagaacattggtagcaacttagcctggtaccaacaaaaacctggaccagcctcccagacctcctcatttatcgttcatccacctaggccactgatcgtcccaaccagattcagtggcagaggtctgggacagacttnagtctcaccatcagcacgtcgtaacagtctagaaagtacgttggactagttttacttaactgtacaactaagttgtcggtcaggtcggtcctacggtaaccggttccggacccgtaacggggtaccctaacgtagggttacgtacgttaacgtaccggaaggggtacccgtaaacgttcgggtaccggtaaccgttcggccctaaacccgtacggtttcctttacgggttaccctttaccg

SEQ ID NO: 91585 - DNA, 497 bp, Homo sapiens
  misc_feature: GYAE6OF02F33G0.5.57.F02.1.454.CMB.1.raw
  modified_base (201)..(201): a, c, t, g, unknown or other
  misc_feature (201)..(201): n is a, c, g, or t
  modified_base (463)..(463): a, c, t, g, unknown or other
  misc_feature (463)..(463): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaaccaacaaaaacctggccagcctccagactcctcatttatcgttcatccaccaggccactgatcgtcccaaacagattcagtgcagagggtctgggacagacttcagtctcaccatcagcagcgtacagtctagaagtacgttgctagtttattactagtacaacatgtgtcagtgctcgaacgtcgccagacgggacagtgatancgaggcgacgtgtgcgtgcaccatctgtcttacc

SEQ ID NO: 91586 - DNA, 601 bp, Homo sapiens
  misc_feature: GYAE6OF02GTVGM.5.57.F02.1.454.CMB.1.raw
  modified_base (245)..(245): a, c, t, g, unknown or other
  misc_feature (245)..(245): n is a, c, g, or t
  modified_base (391)..(391): a, c, t, g, unknown or other
  misc_feature (391)..(391): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggggagagacgccacccttctcctgcagggccagtcagaacattggancaacttgcctggtaccaacaaaaacctggccagcctcccagactcctcatttatcgttcatccaccagggccactgatcgtacccaaccagattcagtggcaggagggtctgggacagacttcagtctcaccatcagcagcgtacngtcctagaacgtacgttggcctaagtttattacttagtacaaactagttggtaggtcaggtcggtcccttacggtaaccggtttccgggacccaacggggtaacccaacgtagggttagggacttacgtacgtaacggggaccgtaaacgttcgggtacgggtaccctaggaccctaacccgtagtttcccgttaggttcccttaacccg

SEQ ID NO: 91587 - DNA, 561 bp, Homo sapiens
  misc_feature: GYAE6OF02GU89P.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttgcctggtaccaaacaaaaacctggaccagcctcccagacctcctcatttatcgttcatccaccaggccactgatcgtacccaaccagacttcagtgcaggagggtctagggacagacttcagtctcaccatcgagcagcgtacagtctagaacgtcttagggctaagtttactactagtactaacaattgtaggtacaggtccggacctacggtaacgttccggacccgtaagggacccaacgagtgacgttagtaccggagggaccgtaacgtggtacgggctcggactacccgtattcgttcgttcttaccg

SEQ ID NO: 91588 - DNA, 559 bp, Homo sapiens
  misc_feature: GYAE6OF02FQMYS.5.57.F02.1.454.CMB.1.raw
  modified_base (153)..(153): a, c, t, g, unknown or other
  misc_feature (153)..(153): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccaggggagagagccaccctctcctgcagggccagtcagaacattggagcaacttagcctggtaaccaacaaaaacctggaccagcctcccagactcctcatttatcgttcactccaccacgggccactgactcgtaccccaaaccagtacttcgaggtcggacaggagggtcgtggggacagtacttcgagtctcacctatcagcagctacagtctagaagtacttggactagtttattactgttacaactatgtgtacgtagtcggcctcgtaacggttccggcccgaacgggaccaacgtacgtaggactagtcgaaggccgtaacgtggtcgacgtcgacctaccgtactcgttgtcttaccg

SEQ ID NO: 91589 - DNA, 682 bp, Homo sapiens
  misc_feature: GYAE6OF02JW2VZ.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccacctctcctgcagggccagtcagaacngttggancaacttgctgtaccaanaaaacctggccaagcctccagactcctctattactcgttcacgtccacgtacggccactgactcgtacccaaacagtacttacgaggtcgactaaggtacgggtctacggggaacacggtactttccgaagttccctaccgaacctacgttcgaacgaccgtaacggtaccggtaactaacggtacttaaggaaacggtacgttacggaccttaacggttttaacttaacgttacggttaactaaacgtaagttacggtacgttacgtaaggttcggtacccgttaccggtaaaccggttcccggaacccgtacgggtaaccgtaaccggtaaggttacggtacgttacttaacgggaccggtacggtaacgttgggttaccgcgttcggacgaaccgtacttacggttacgttcgttaccg

SEQ ID NO: 91590 - DNA, 497 bp, Homo sapiens
  misc_feature: GYAE6OF02FENM8.5.57.F02.1.454.CMB.1.raw
  modified_base (201)..(201): a, c, t, g, unknown or other
  misc_feature (201)..(201): n is a, c, g, or t
  modified_base (297)..(297): a, c, t, g, unknown or other
  misc_feature (297)..(297): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttancgttcatccacaggccactgatcgtcccaacagattcgagtgcagaggtctgggacagactcagtctcacatcagcagctacagtcagaagacttggctagtttatactgttacaacaatgtgtcagtgcctacgtaacgttcggacccaggaccacgagtagatagcgaggcaacgtgtcgctgcaccatctgtcttac

SEQ ID NO: 91591 - DNA, 712 bp, Homo sapiens
  misc_feature: GYAE6OF02H34FV.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctctcctgcagggccagtcagaacattggancaacttagcctggtacaaacaaaaacctggaccagcctcccagacctcctactatttactcgttcactccaccgtaggccactgtactcgtacccaaccagtacttacgaggtcggaccaaggacgggttcgtacggggaacaacggtacctttacgaaggttccctaccaacccgtattccgaagcgaacgtccgttaacacggttcctaaggaaaccgtacgtttagggaccttaagttttacttacgttacgtactaaacgtaagttcggtagggttacgtacggttacggtaccccgttacgggtaaacccggttttcccgggaccccgttaaacgggggaaccctaaccggacgggtttacgaacgttacgttaccggaaacgggttaccggtaaaccgttgggtaccgggacgttaccggacccgtaacccgtaacggtttccgttaccggttaccgtttacccg

SEQ ID NO: 91592 - DNA, 487 bp, Homo sapiens
  misc_feature: GYAE6OF02H4ODG.5.57.F02.1.454.CMB.1.raw
  modified_base (201)..(201): a, c, t, g, unknown or other
  misc_feature (201)..(201): n is a, c, g, or t
  modified_base (349)..(349): a, c, t, g, unknown or other
  misc_feature (349)..(349): n is a, c, g, or t
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
  modified_base (452)..(452): a, c, t, g, unknown or other
  misc_feature (452)..(452): n is a, c, g, or t
  modified_base (459)..(459): a, c, t, g, unknown or other
  misc_feature (459)..(459): n is a, c, g, or t
  modified_base (462)..(462): a, c, t, g, unknown or other
  misc_feature (462)..(462): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttgcctggtaccaacaaaaacctggccagcctcccagactctcattactcgttcatccaccagggccactgatcgtcccaacagacttcagtggcagaggtcngggacagacttcagtctcaccatcagcagcgtacagtctagaagcttggctagtttatactgtacaacatgngtnagtgcctgaacgttcgcccaggaccagngtgatancgnggcactgtgctgcaccatctgtctc

SEQ ID NO: 91593 - DNA, 634 bp, Homo sapiens
  misc_feature: GYAE6OF02H5YHP.5.57.F02.1.454.CMB.1.raw
  modified_base (201)..(201): a, c, t, g, unknown or other
  misc_feature (201)..(201): n is a, c, g, or t
  modified_base (427)..(427): a, c, t, g, unknown or other
  misc_feature (427)..(427): n is a, c, g, or t
  modified_base (626)..(626): a, c, t, g, unknown or other
  misc_feature (626)..(626): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgccaccctctcctgcagggccagtcagaacattggagcaacttacgcctaggtaaccaaacaaaaaacctggaccacgaccctacccaacgaccttcctactaacttttactcgttaccactacccaaccgaggtccacgtgactcgtaccccaaactagattcagtcggacaggaggtcgtagggacagtacttcaagtctcaaccatcagtcagcgtaanagtactagaagtacgttggacttagtttacttactacgtacaacgttaagtggtacggtactaggtacgtccgtacggtaaccggttccgggaaccgaacgggtaaccgtaacgtacggtaggtacttacgtaccggaacgggtaccgtaacgtacgggtacgtaccgttacgacgtaacccgttatacgtttaccgtnttaacccg

SEQ ID NO: 91594 - DNA, 534 bp, Homo sapiens
  misc_feature: GYAE6OF02GHSUF.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagctacagtctgaagtcttggctagtttattactgtacaactaatgtgtcagtcgcctagtaaccgttcggcccgaagggaccacgagtggatacgtacgacggacgtaaccgtggtacggacttcggacctacccgtatccgttcgttcttaccg

SEQ ID NO: 91595 - DNA, 565 bp, Homo sapiens
  misc_feature: GYAE6OF02ITMUY.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (493)..(493): a, c, t, g, unknown or other
  misc_feature (493)..(493): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcccaccctctcctgcagggccagtcagaacattggagcaacttgcctggtaaccaacaaaaacctggacccagccctcccagacctcctcatttactcgttcatcccaccagggccactgatcgtacccaaccagacttcagtggacagagggtctagggacagtacttcagtctacaccatcagcagtcgtaacagtctagaagtcgttaggctagtttattacgtgtacaactaagttcggtagtcagtcggcctacgtaacggttccgacccgaaggacccaagngtacggacttacgtaccgagggtacctaacggtcgtgggcctacggacctaccgtagtcttcggtcttaccg

SEQ ID NO: 91596 - DNA, 629 bp, Homo sapiens
  misc_feature: GYAE6OF02JFBF1.5.57.F02.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (593)..(593): a, c, t, g, unknown or other
  misc_feature (593)..(593): n is a, c, g, or t
tcagatcagacacgcacgaccggtgctcgatttagctcgatatagttgggtttgggggaggaacgtgctcagttaggacccagacggaaccatggaagccccagcgcagcttctcttcctcctgctactctggctcccagataccgttggggagatcgtgatgacgcagtctccagccatcctgtctgtgtcctccgagggganagagcccaacccgtctcctgcagggccagtccagaacngttggancaacttgcctggtaccaacaaaaacctggaccagcctacccagacctcctacatttactcgttcactccaccgacggccaacgtgtactcgtacccaaccagtacttcacgtggcaggaggtctagggacacgtacttcgagtcctacacctatcacgacacgacgttacaacgttcagaacgtacttagggacctagtttaacttactcgtttaaccaagtaaagttggtacggttactagggtaccgtaccgttacgtaaccggttaccgggaccgtaacgggacccaacgtaggttacggatttaacggccgtaacgggtacggaaccgttggtaccggtntaccgggtacaccgtacttcgttacggttcctacgg

SEQ ID NO: 91597 - DNA, 566 bp, Homo sapiens
  misc_feature: GYAE6OF02GDNQ5.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaaccaacaaaaacctggaccagcctcccagacctcctcatttatcgttcactccaccagggccactgatcgtacccaaccagtacttcagtggcaggagggtcgtgggacagtacttcagtctcacatacacgcagcgtacagtctagaagtacgttggctagtttacttactagtacaatatgtggtcaggtcgtcctacgtaaccggttcggacccgtaggacccaacgtggtacggatacgtacgaacgggtaccgtaacgtggtacggtcgtcggacctaacccgtatccgttacgtcctttaccg

SEQ ID NO: 91598 - DNA, 586 bp, Homo sapiens
  misc_feature: GYAE6OF02JZYSC.5.57.F02.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (402)..(402): a, c, t, g, unknown or other
  misc_feature (402)..(402): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgccaccctctcctgcagggccagtcagaacnttggancaacttgcctggtaccaacaaaaacctggaccagcctcccagacctcctacatttatcgttcactccaccgaggccactgatcgtaccccaacagtatcagtcgcaggacggtcgtagggacaggacttcgagtctcaccactcacgacagacgtaacngtacctaggaacgtacgttggactaagttttatacgttataccgtaaatagtaggtcgtacgagttcggtccgttacgtacggttccggacccgaacgggaccacgtagtcggtatacgtaccggaagggtaccaaggttcggacggtcgtacgtaccgacctactacgttcggttacttaccg

SEQ ID NO: 91599 - DNA, 499 bp, Homo sapiens
  misc_feature: GYAE6OF02GIXX5.5.57.F02.1.454.CMB.1.raw
  modified_base (152)..(152): a, c, t, g, unknown or other
  misc_feature (152)..(152): n is a, c, g, or t
  modified_base (200)..(200): a, c, t, g, unknown or other
  misc_feature (200)..(200): n is a, c, g, or t
  modified_base (349)..(349): a, c, t, g, unknown or other
  misc_feature (349)..(349): n is a, c, g, or t
  modified_base (415)..(415): a, c, t, g, unknown or other
  misc_feature (415)..(415): n is a, c, g, or t
  modified_base (456)..(456): a, c, t, g, unknown or other
  misc_feature (456)..(456): n is a, c, g, or t
  modified_base (465)..(465): a, c, t, g, unknown or other
  misc_feature (465)..(465): n is a, c, g, or t
  modified_base (482)..(482): a, c, t, g, unknown or other
  misc_feature (482)..(482): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccacctctcctgcagggccagtcagaacattggagcaacttagcctggtaccaacaaaacctggccagcctcccagacctcctcatttatcgttcatccaccagggccaactgatgtccccaacagattcagtggcagacgggtntgggacagacttcagtctcaccaatcagcagcgtacagtctagaagtacttggctagtttattacngtacaacaatgtgtcagtgcctgaacgttcgcccaggaccnagtggatancgaggcgaactgtcggntgcacctatctgtcttc

SEQ ID NO: 91600 - DNA, 530 bp, Homo sapiens
  misc_feature: GYAE6OF02GVA8M.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (424)..(424): a, c, t, g, unknown or other
  misc_feature (424)..(424): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctctcctgcagggccagtcagaacattggancaacttgcctggtaccaacaaaaacctggccagcctcccagactcctcatttactcgttcatccaccagggccactgactcgtcccaaccagacttcagtggcagagggtctgggacagacttcagtctcaccatcagcagcgtacagtctagtaagacttggctagtttattactgtacaanatgtggtacaggtggcctacgtaacgttcggacccgagggaccactaggtaggatagtcgaggaccgaacgtggtcggtcctgccacgtactcgttcgtacttacc

SEQ ID NO: 91601 - DNA, 558 bp, Homo sapiens
  misc_feature: GYAE6OF02GIHPJ.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaaccaacaaaaacctggaccagcctcccagactcctcatttatcgttcatccaccagggccactgatcgtacccaacagattcagtggcagagggtctgggacagacttcgagtctacaccatcagcagctacatctagaagacttggctagtttacttactagtacaactaattgtgtactaggtcggtccctaggtaaccggttcgacccgaagggacccaagacgtaggattagtaccgaagggtaccgtaacgttcggtaggtcttacggccaaccgtagtccgttacgttcttaccg

SEQ ID NO: 91602 - DNA, 559 bp, Homo sapiens
  misc_feature: GYAE6OF02H4FTM.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (408)..(408): a, c, t, g, unknown or other
  misc_feature (408)..(408): n is a, c, g, or t
  modified_base (418)..(418): a, c, t, g, unknown or other
  misc_feature (418)..(418): n is a, c, g, or t
  modified_base (461)..(461): a, c, t, g, unknown or other
  misc_feature (461)..(461): n is a, c, g, or t
  modified_base (501)..(501): a, c, t, g, unknown or other
  misc_feature (501)..(501): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctctcctgcagggccaggtcagaacattggtagctaacttacgccttaggtaaccaaacaaaaacctggaccacgccctcccagactcctctatttactccgttcacttcccaccgtagggcctactgactcgtaccccaacagacttcaggtcggcaggagggtctagggacaggacttcgagtcctcaccatcgancgagcgtacngtctagaagtctgactagtttatactgtactaacagtgtcgtnacgtggcctagacgttccggaccgtagggaccacgaggtnagttacacgacggtacgtacgtggtcgtactcgaccaccctagtctacgttcttaccg

SEQ ID NO: 91603 - DNA, 628 bp, Homo sapiens
  misc_feature: GYAE6OF02H2MT6.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgccaccctctcctgcagggccagtcagacattggagcaacttgcctaggtaccaaacaaaaacctggaccacgcctcccagactcctctattactcgttcactccaccacggccactgactcgtaccccaacgtagacttccaggtcgacaggacgggtcgtggggaaccagtacttgacgtctacacatcagctagcgtacagtctagaacgtacgttggaccttagtttacttagtacgtactaaactaagttcgtggtacgtaggttaccggtacccgtttacgggtaaaccggtttcccggacccggacggggtaacccaacgtacgggtacgtacgttacgttcggaacgggtaccgtaaggtcggtacggtccggttacgaccgtaacccgtaattccgttggttaccctttaacg

SEQ ID NO: 91604 - DNA, 740 bp, Homo sapiens
  misc_feature: GYAE6OF02IXX4B.5.57.F02.1.454.CMB.1.raw
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
  modified_base (245)..(245): a, c, t, g, unknown or other
  misc_feature (245)..(245): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcctaccctntcctgcagggccagtcagaacattggtancaacttagcctggtaaccaacaaaaacgtggaccaagcctacccgacgacctcctactactttactcgttacactccaaccacggtccacgtgaactcgtacccaaccagtacttacgagtacggaccaaggtacgggtcgtacggggacaacggtacttcgaacgttacctaccgtaaccgactaccgacgtaccgaacggtaccgtaacgtaacgtaccgttaggaaaaccggtacgtttacgggacttaacggtttttaacttaaccgttggttaaacctaaacgtaaaagtttcggtaacgggttactaagggttaccggtacccgttaaccgggtaaaaccggttttcccgggaaacccggtaaccggggaacccgttaaaccggaagggttaacggtaacgttacgtacggttaaacgggacgtaaacggttacgttacgggaccgttacggacccgaccgtaacggtacctttacggtacctttaacg

SEQ ID NO: 91605 - DNA, 634 bp, Homo sapiens
  misc_feature: GYAE6OF02HS19H.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgcccaccctctcctgccagggccagtcaagaacngttggtagctaacttagccttggtaaccaaacaaaaacctggaccacgccctacccagaccttcctctactttactcgttcactcccaccgaggccactgactcgtacccaaccgagtattcgaggtcggcaggagggtcgtgggacacggtacttcgaagtctaccacaatcgagcagactacagtctagtaacgacgttggacttagtttacttacgtacgtactaactaagttgttcggtacgtacggtcggtaccttacgggtaaccggttccggaacccgtacggggtaaccaacggtagtacggtatacgttaccgagggtacccgtaacgtcgggtaccggcgttacggaccgtaaccgttagtttaccttacggttcctttaccg

SEQ ID NO: 91606 - DNA, 498 bp, Homo sapiens
  misc_feature: GYAE6OF02JBMMB.5.57.F02.1.454.CMB.1.raw
  modified_base (422)..(422): a, c, t, g, unknown or other
  misc_feature (422)..(422): n is a, c, g, or t
  modified_base (458)..(458): a, c, t, g, unknown or other
  misc_feature (458)..(458): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (489)..(489): a, c, t, g, unknown or other
  misc_feature (489)..(489): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtacccaacaaaaacctggccagcctccccagactcctcatttatcgttcatccacacgggccactgactgtcccaacagattcagtggcagaggtctgggacagactcagtctcaccatcagcagcgtacagtctagaagtacttggctagtttattactgtacaanaatgtgtcagtgcctagaacgtcgaccacgggaccncagtgatancgnggacgatcgtgctgcaccntctgtctcg

SEQ ID NO: 91607 - DNA, 589 bp, Homo sapiens
  misc_feature: GYAE6OF02GWCB0.5.57.F02.1.454.CMB.1.raw
  modified_base (356)..(356): a, c, t, g, unknown or other
  misc_feature (356)..(356): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagccaccctctcctgcagggccagtcagaacattggtagcaacttagcctggtaaccaacaaaaacctggaccagcctcccagacctcctctatttactcgttcactccaccacgggccactgatcgtacccaacagacttcagtggcaggnggtcgtagggacacggtacttcagttctacacctatcagcacgcgtacagtctagaagtcttgactagtttattacgtgtacaactaatcggtagtcgtacggtcgtcctacggtaaccggttccggacccgaacggggacccaacgtacggtaggacttaacgtcgaacgggtccggtaacgtggtacgggacgttacggacctaaccgtacgttcgttacgttaccttccg

SEQ ID NO: 91608 - DNA, 549 bp, Homo sapiens
  misc_feature: GYAE6OF02H8F0O.5.57.F02.1.454.CMB.1.raw
  modified_base (343)..(343): a, c, t, g, unknown or other
  misc_feature (343)..(343): n is a, c, g, or t
  modified_base (430)..(430): a, c, t, g, unknown or other
  misc_feature (430)..(430): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccacctctcctgcagggccagtcagaacattggagcaacttagcctggtaccaaacaaaaacctggaccagcctcccagactcctcatttatcgttcatccaccaggccactgatgtcccaacagattcagtggcagngggtctgggacagacttcagtctcaccatcagcagcgtaacagtctagaatacttggctagtttatactgtacaactagtgtcggtnagtcggtcctacgtaacggttccggacccgtacgggacctacgagtaggattacgtcgaaggtaccgtaaacgtggtacggcttcggaccctaccgtattaccgttcggtcctttaccg

SEQ ID NO: 91609 - DNA, 565 bp, Homo sapiens
  misc_feature: GYAE6OF02F6RVE.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaaccaaacaaaaacctggaccacgccctcccagacctcctcatttactcgttcactccaccgagggccactgactcgtacccaaccagacttcagtggacaggagggtctgggacagacttcagtctcacctatcgagcagtccgtaacagtctagaacgtcttggactagtttatactgtacaactatgtaggtctaggtcggtcctacgtaacgttccggacccagggaccacgagtacggatacgacgaagggaccgtaacgtcggtacggcctcggacctaccgtagtccgttacgttcttaccg

SEQ ID NO: 91610 - DNA, 523 bp, Homo sapiens
  misc_feature: GYAE6OF02F9ENT.5.57.F02.1.454.CMB.1.raw
  modified_base (387)..(387): a, c, t, g, unknown or other
  misc_feature (387)..(387): n is a, c, g, or t
  modified_base (492)..(492): a, c, t, g, unknown or other
  misc_feature (492)..(492): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggaccagcctcccagactcctcatttatcgttcatccaccagggccactgatgtcccaaccagattcagtggcagagggtctgggacagacttcagtctcaccatcagcagcgtacngtctgaagcttggctagtttattactgtacaactaatgtgtcagtcggtcctcgaacgttcggacccgtagggacccagagtgatagtacgaggacgtaactggnggtcctggacctaccatcgttacgtcttacc

SEQ ID NO: 91611 - DNA, 532 bp, Homo sapiens
  misc_feature: GYAE6OF02H9ECA.5.57.F02.1.454.CMB.1.raw
  modified_base (200)..(200): a, c, t, g, unknown or other
  misc_feature (200)..(200): n is a, c, g, or t
  modified_base (240)..(240): a, c, t, g, unknown or other
  misc_feature (240)..(240): n is a, c, g, or t
  modified_base (354)..(354): a, c, t, g, unknown or other
  misc_feature (354)..(354): n is a, c, g, or t
  modified_base (372)..(372): a, c, t, g, unknown or other
  misc_feature (372)..(372): n is a, c, g, or t
  modified_base (396)..(396): a, c, t, g, unknown or other
  misc_feature (396)..(396): n is a, c, g, or t
  modified_base (527)..(527): a, c, t, g, unknown or other
  misc_feature (527)..(527): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctaggtaaccaaacaaaaaacctggaccagcctcccagactcctcatttactcgttcactccaccaggccactgactcgcccaaaccagtacttcagtcgcaggngggtctgggacagacttnagtctacacatcagcagcgtaacngtctagaagtacttggctagtttacttacgtgtacaaactaagtgtggtcaggtcggcctacggacgttcgaccgaggaccacgagtgatagtacgaggacctagcgttgctcgaccacctagtcttcgtnttacc

SEQ ID NO: 91612 - DNA, 568 bp, Homo sapiens
  misc_feature: GYAE6OF02HJKGO.5.57.F02.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctctcctgcagggccagtcagaacnttggancaacttgcctggtaccaacaaaaaacctggaccagccctccagactcctcatttatcgttcatccaccagggccactgatcgtcccaaccagattcagtcgcagagggtctgggacagacttcagtctcacatcagcagcgtacagtctagaaagacttggactagtttaattacgtgtacaaataagtgtaggtactaggtcggtccctacgtaacgttccggacccgaacgggacccaacgacggtggactaagtccgaaggtaccgtaacgtggtcgggtacctggtaccgaacctagttccgttacggttacctttacccg

SEQ ID NO: 91613 - DNA, 508 bp, Homo sapiens
  misc_feature: GYAE6OF02F5G8Z.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcatccaccagggccactgatgtcccaacagattcagtggcagaggtctgggacagacttcagtctcacatcagcagcgtacagtctagaagacttggctagtttattactgtacaactatgtgtcagtcgcctcgaacgttcggacccagggaccagagtagatacgtcgaggcgaacgtgtcggctgccgaccagtctgtcttacg

SEQ ID NO: 91614 - DNA, 508 bp, Homo sapiens
  misc_feature: GYAE6OF02HSXC4.5.57.F02.1.454.CMB.1.raw
  modified_base (242)..(242): a, c, t, g, unknown or other
  misc_feature (242)..(242): n is a, c, g, or t
  modified_base (498)..(498): a, c, t, g, unknown or other
  misc_feature (498)..(498): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtancaacttagcctggtaccaaacaaaaacctggaccagcctcccagactcctcatttatcgttcatccaccaggccactgactcgtaccccaacagattcagtggcagagggtctgggacagacttcagtctcaccatcagcagcgtacagtctgaagacttggctagtttattactgtacaacatgtgtcaggtgcctagaccgttcgacccagggaccacgagtgatatcgaggacgtaacgtgtcggctgcaccntctgtcttcg

SEQ ID NO: 91615 - DNA, 586 bp, Homo sapiens
  misc_feature: GYAE6OF02H2MEQ.5.57.F02.1.454.CMB.1.raw
  modified_base (153)..(153): a, c, t, g, unknown or other
  misc_feature (153)..(153): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccaggggagagagccaccctctcctgcagggccagtcagaacattggagcaacttgcctggtaccaaacaaaaacctggaccagcctccagacctcctacatttactcgttcactccaccgacggccactgactcgtacccaaccagtacttcagtcgacaggagggtctgggacagacttcagtctcaccatcagcagtcgtaacagtctagaaacgacttggactagtttacttacgttgtacaaagtaattggtggttactaggtcggtcctaccgtaacggttccggacccgagggaaccaacgacgttcgggattaacgtcgaacgggtaccgtaacgtggttacggccgttacggacaacccgtaagttccgttacggtcctttaccg

SEQ ID NO: 91616 - DNA, 534 bp, Homo sapiens
  misc_feature: GYAE6OF02JD2JZ.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (380)..(380): a, c, t, g, unknown or other
  misc_feature (380)..(380): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtancaacttagcctggtaccaacaaaaacctggccagcctcccagacctcctctatttatcgttcatccaccgagggccactgactcgtacccaacagtattcagtggcaggagggtctgggacagacttgacgtctcacntcagcagctacagtcagaatcttgactagtttactatgtacaacattgtagtcaggtcgacctacgtaacgtcggaccgacgggaccacgagtcgattacgcggaggtacgaacgtggtcggactcggaccaccgtatccgttgtaccttaccg

SEQ ID NO: 91617 - DNA, 546 bp, Homo sapiens
  misc_feature: GYAE6OF02FPSUA.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (363)..(363): a, c, t, g, unknown or other
  misc_feature (363)..(363): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttgcctggtaccaacaaaaacctggccagcctcccagactcctcatttatcgttcatccaccaggccactgatcgtcccaacagattcagtcgcagaggtctgggacagactcagtcncaccgatcagcagcgtacagtctgaagtcttggactagtttatactgtacaactaatgtaggtcagtggcctaggtaaccgttcggaccgacggaccacgagtacggtatacgtcggaaggaccggtaaccttggttacggccttcgggacctaaccgtagttccgttacggttcctttaccg

SEQ ID NO: 91618 - DNA, 653 bp, Homo sapiens
  misc_feature: GYAE6OF02I4MJ3.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
  modified_base (254)..(254): a, c, t, g, unknown or other
  misc_feature (254)..(254): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccggttgggganatcgtgatgacgcagtctccagccatcctgtctgtcgtctccgagggganacgacgcccaccctctccgtgcgacgggccagtcaagaactagtttggacncaacttcgccgtaggtaaccaaacaaaaacctcggaccaacgcctacccgacgactcctctattactcgttcactaccaccgacggtccactacgtactacgtaccccaacgtacgtacttcgtacgtacggacgaacggtaacgggtcgtacgggacacggtacttacgagtactaccgacacgtcaacgcgaacgtcgtaacacgttactaggtaaacgtacgtttcggacgttaacgtttagttaccgttatacaagtaattacggtggttacagttccggactacgtaacgtccggacgtacgggaaccacgtagtacgtacgtagtacggtacggaccgtaacggttacgtacggacttacgaccgtaccttacgtcgttacgtactttaccgg

SEQ ID NO: 91619 - DNA, 534 bp, Homo sapiens
  misc_feature: GYAE6OF02H8NKQ.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaaccaacaaaaacctggaccagccctcccagacctcctctatttactcgttcatcccaccagggccactgactcgtcccaaccagacttcagtggcaggagggtctgggacagacttcagtctcaccatcagcagcgtacagtctagaagtacttggctagtttattactgtacaacattgtaggtcagtcggtcctacgaacggtttccggacccgtaagggacccaacgtagtggatacgtcgaggtaccgaactggtgctgcaccatctgtctac

SEQ ID NO: 91620 - DNA, 516 bp, Homo sapiens
  misc_feature: GYAE6OF02GYTWN.5.57.F02.1.454.CMB.1.raw
  modified_base (405)..(405): a, c, t, g, unknown or other
  misc_feature (405)..(405): n is a, c, g, or t
  modified_base (501)..(501): a, c, t, g, unknown or other
  misc_feature (501)..(501): n is a, c, g, or t
  modified_base (506)..(506): a, c, t, g, unknown or other
  misc_feature (506)..(506): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggtagcaacttgcctggtaccaaacaaaaacctggaccagccctcccagacctcctcatttatccgttcatccaccagggccactgatcgtccccaaccagattcagtgcagagggtcgtgggacaggacttcagttctcaccatcagcagctaacagtctaggaanacgttggctagttttattactgtacaacatgtgtcagtggctcgaacgttcggcccagggacccagagtggatatcgaggacgtacgtggtgcgtncaccntcttgtcttc

SEQ ID NO: 91621 - DNA, 527 bp, Homo sapiens
  misc_feature: GYAE6OF02IU3EF.5.57.F02.1.454.CMB.1.raw
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
  modified_base (520)..(520): a, c, t, g, unknown or other
  misc_feature (520)..(520): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagccaccctctcctgcagggccagtcagaacattggtagcaacttagcctggtaccaaacaaaaacctggccagcctcccagactcctcatttatcgttcatccaccagggccactgatcgtcccaaaccagattcagtggcagaggtctggacngacttcagtctcacntcagcagctacagtctgaatacttggactagtttatacgtgtacaataatgtaggtcagttgcctcgaacgttccggccgagggacccacgagtcgatcgtacgaggcctaacgtcgtcggcttaggccaacctagttcttcggtntttaccg

SEQ ID NO: 91622 - DNA, 559 bp, Homo sapiens
  misc_feature: GYAE6OF02IGJPF.5.57.F02.1.454.CMB.1.raw
  modified_base (242)..(242): a, c, t, g, unknown or other
  misc_feature (242)..(242): n is a, c, g, or t
  modified_base (384)..(384): a, c, t, g, unknown or other
  misc_feature (384)..(384): n is a, c, g, or t
  modified_base (400)..(400): a, c, t, g, unknown or other
  misc_feature (400)..(400): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtancaacttagcctggtaaccaacaaaaacctggaccagcctcccagactcctctatttactcgttcatccaccagggccactgactcgtcccaaccagtacttcagtgcagagggtctgggacagacttcagtctcaccatcancagctacagtcagaanacttggctagtttattactgtacaaactagtgtaggtactaggtcggtacctacgtaaccggtttcgacccgaacgggaacccaagtacggtggtatacgtacgaacgggtacgtaactggtacggctggacctacctacgtcttaccggtacttaccg

SEQ ID NO: 91623 - DNA, 522 bp, Homo sapiens
  misc_feature: GYAE6OF02GYRQ9.5.57.F02.1.454.CMB.1.raw
  modified_base (214)..(214): a, c, t, g, unknown or other
  misc_feature (214)..(214): n is a, c, g, or t
  modified_base (483)..(483): a, c, t, g, unknown or other
  misc_feature (483)..(483): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagccaccctntcctgcagggccagtcagaacattggagcaacttgcctggtaaccaaacaaaaacctggaccagcctcccagacctcctactatttatcgttcactccaccagggccactgatcgtcccaaccagattcagtgacaggaggtctgggacagacttcagtctcacatcagcagcgtacagtctagaaacgtcttggactagtttactactgtacaacaattgtaggtcagtcgacctacgaaccgttcgaccagggaccagagtgactanacgaggcgaacgtgcggactgacacctatcttgtcttac

SEQ ID NO: 91624 - DNA, 540 bp, Homo sapiens
  misc_feature: GYAE6OF02H96Z6.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttactcgttcatccaccaggccactgatcgtcccaaccagattcagtcggcagagggtctgggacagacttcgagtctcaccatcgagcagcgtacagtctgaagcttggctagtttattactgtacaactagtgtaggtcaggttcggcctacggtaacgttccgggacccacgggaccacgaggttgagtacgtacgaggacgtaacgtggtacggctggaccacctatcttacgttcttaccg

SEQ ID NO: 91625 - DNA, 654 bp, Homo sapiens
  misc_feature: GYAE6OF02G1MXX.5.57.F02.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagtccatcctgtctgtgtctccgagggganagagcccaccctctcctgcagggccagtcacgaacattggtancaacttgcctggtaccaacaaaacctggaccagccctcccagacctcctacactttacgtcgttacactacccgacgacggacctactgactccgtacccaacgtagtacttcgagtcgacgaggtacggtcgtacggacacgtacttacgtacgtcctaccaacctactacgacgacgacgtaccgtaagtacgttacgaggaacgttacgttcggacgtttagtttacttacgtacgtaacaaacgttagtggttacggtacgtacggtcggtacccgtaccggtaacggttcccgaccggtaccgggacctaacgtaggttacgtacgtacgtacggacgggtaaccgttagttcggtcgtaccgtcggtaacccgtaccttacgttcgttacgttccttaacccg

SEQ ID NO: 91626 - DNA, 685 bp, Homo sapiens
  misc_feature: GYAE6OF02H60E6.5.57.F02.1.454.CMB.1.raw
  modified_base (152)..(152): a, c, t, g, unknown or other
  misc_feature (152)..(152): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagacgccaccctctcctgcagggccagtcaagaacattggtagcaaacttagcctaggtaaccaaacaaaaaacctggaccacgcctaccaagacctcctactatttactcgttacactccaaccgacggaccactgatcgtacccaacagtacttacgagtaggcaggacgggtcgtagggaacagactttcgaagttcctacgaaccctataccgacggacacggtaccggttaaactaggttaccgttaaggaaacggttaccgttagggacttaaggttttaacttaacgttagttacaaacgttaagttcggtaggttacgtaacggttacggacccgttacggtaaaccggtttccgggaccccgtaacggggtaccaaccgtaggtacggtaacgttaacgtaccggaacggacggtaacgtacgggtacgtaccggttcgaccgaacccgttaatccgtttacgtaccgtttaccg

SEQ ID NO: 91627 - DNA, 573 bp, Homo sapiens
  misc_feature: GYAE6OF02GW1U0.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttgcctggtaccaacaaaaacctggccagcctcccagactcctcatttatcgttcactccaccagggccactgactcgtacccaaccagattcagtggacaggagggtctgggacagacttcagtctcaccatcagcagcgtacagtctagaagtacttggactagtttattactgtacaaactaatggtacggttcaagggttcgcccgttacgaaccggtttccgggacccgtaaggggtaacccaagaggtacggtatacgtacgaagggaccgtaaacgtggttacggtcgtacggtccgaacctatccgttagtccttaccg

SEQ ID NO: 91628 - DNA, 603 bp, Homo sapiens
  misc_feature: GYAE6OF02H28Q1.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacatttggagcaacttagcctggtaccaaacaaaaacctggaccagcctccagactcctcattatcttcatccaccaggccactgatcgtccaaccagacttcagtcgcagagggtctgggacagtacttcagtctacacgatcagcagcgtacagtctagaacgtacgttggctagtttacttactagtacaaactaatggtaggtacaggttggtacccttcggtaaaccgtttccgggacccgtaacgggtacccgaaacgtacggttgggtaacttacgttacgaaacgggtcccggtaaacgtcgggttacggaccgttaggtacccgtaacctaacggtttcccgttacggttaccttttacccg

SEQ ID NO: 91629 - DNA, 527 bp, Homo sapiens
  misc_feature: GYAE6OF02H0JXK.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggancaacttagcctaggtaccaacaaaaacctggaccagcctcccagacctcctcatttatcgttcatccaccaggccactgatcgtacccaacagattcaagttcgcagagggtctgggacagacttcagtctcaccatcagcagctacagtctgaagtactggctagtttatactgtacaactaagtgtgtcagtgacctcgaacgttccgcctagggacccacgagttgatactcgacggtacgtaacgtgtacggctcgaccgacctaagtcgtacgttcttcg

SEQ ID NO: 91630 - DNA, 536 bp, Homo sapiens
  misc_feature: GYAE6OF02F0C36.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcagggccagtcagaacattggancaacttgcctggtaccaacaaaaacctggaccagcctcccagacctcctcatttatcgttcatccaccagggccactgatcgtacccaaccagattcagtcggcagacgggtctgggacagacttgagtctacaccatcagcagcgtacagtctagaagtcttggctagtttattacgtgtacaactatgtgtcagtcgctacgtacgttcggacccgaggacccagacgtagatacgtacgaaggacctaacgtggtacggccgtgaccacctatccgtagttccttaccg

SEQ ID NO: 91631 - DNA, 741 bp, Homo sapiens
  misc_feature: GYAE6OF02IYKXQ.5.57.F02.1.454.CMB.1.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgcccaccctctcctgcagggccagtcagaacagttggancaacttagcctggtaaccaaacaaaaacctggaccagccctacccagactcctctatttatcgttcactccaccacggccactgactcgtacccaacagtacttcgagtcggcgaaggtacggggtacgtacggggaacaacggtaccttacgtacgttaccctacccgtaacccgtaacgtaccgaacggaccgtaacggtaccggttaaccgtaacggttccgttaggaaacggttaccgtttaggggacctttaaggtttttaacttaacgtttacgtaaccgtaaaacgtaagtttcgggttacgggttaccgtaaggggttaccggtacccgtttaaccggtaaacccgggtttcccggaaccccggtaaacggggtaacccgaacgtaacgggttacgtaacgttaacgttccggaaacgggtaccggtaacgttcgggtacggtccgttaccgaccgacccttacgtaccgttcgttacccttacccg

SEQ ID NO: 91632 - DNA, 600 bp, Homo sapiens
  misc_feature: GYAE6OF02GPKKY.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctctcctgcagggccagtcagaacattggancaacttgcctggtaccaacaaaaacctggccagcctcccagacctcctctatttatcgttcactccaccagggccacgtgatcgtacccaaccagacttcaggtggacaggagggtctagggacagacttcagtctcaccatcagcagcgtacagtctagaacgtacttggactagttttatacttgtacaactatgtaggtcaggtcggaccgtacgtaacggtttccggacccgtagggaccctacgtaggttacgggacttacggtaccggtaaggggtaccgtaaacggttcgggttacgggacctttacgggaccctaacccgtaagtttccgtttccggttaccgtttacccg

SEQ ID NO: 91633 - DNA, 851 bp, Homo sapiens
  misc_feature: GYAE6OF02GRCJK.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctcgaggggagagacgcccaccctcctccgtgcgacgggccagtcaagaactagttgggtaagacctaaacgttacgaccgttacggtaaacccaaaaccgtaaaaaacccgtcggacccaaccgcccctaccccgaacgacccttccctactaacttttaactccgttaccacctaccccaaccggacgggacccacgtgactccgtaacccaaccgagtacttcgaggtcggacgtaagggtacgggttcgtacggggaactaacggtacctttacgaacgttcctaacccaaccgtacgttaccgaaggtaccgaacggtacccgttaaacgtaacggtttaccgttaaaggaaacggttacgtttacgggtaaccgttttaaacggtttttaaccgtttaacgttaccggttaaacctaaaacggtttacggtttacggtttacgggtacccgttaaacggggttccgggttacccgttaaaccggggttaacccggtttcccgggggaaccccgaaacgggggtaacccccaagggtaacgggttacggtaacttaccgtaaccggggtaaccgggtaacccggtaacggttgggtaccggtacgttcccgggaaccctaaccgttaccttcggtttaccgttacccgtttaaccg

SEQ ID NO: 91634 - DNA, 518 bp, Homo sapiens
  misc_feature: GYAE6OF02GSLG1.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaacaaaaacctggccagcctcccagactcctcatttatcgttcatccaccagggccactgatgtcccaaccagattcagtggcaggagggtctgggacagacttcagtctcaccatcagcagcgtacagtctagaagtacttggctaagtttacttactgtacaaactaatgtggtcaggtcggcctcgaacgttcggcccagggacccagagtggatacgtcgaggcgaacgtgtcggctgcaccgtatcgtgtcttac

SEQ ID NO: 91635 - DNA, 577 bp, Homo sapiens
  misc_feature: GYAE6OF02GMLL8.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtancaacttagcctggtaccaaacaaaaacctggaccagccctacccagacctcctcatttatcgttcactccaccgagggccactgactcgtaccccaaccagtacttcgagtcggacaggacgggtctagggacagtaccttcgacgtctacaccatcagcagcgtacagtctagaagtacgttggactagtttattacgtgtacaaactatggtggtacaggttcggaccctacggtaaccggtttccggacccgtaacgggacccaacgtacgtagatacgtacgaaggaccgtaacgttggtcggctcggccaccgtactcgttgtccttacg

SEQ ID NO: 91636 - DNA, 492 bp, Homo sapiens
  misc_feature: GYAE6OF02HP4AT.5.57.F02.1.454.CMB.1.raw
  modified_base (244)..(244): a, c, t, g, unknown or other
  misc_feature (244)..(244): n is a, c, g, or t
  modified_base (301)..(301): a, c, t, g, unknown or other
  misc_feature (301)..(301): n is a, c, g, or t
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
  modified_base (488)..(488): a, c, t, g, unknown or other
  misc_feature (488)..(488): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagcccaccctctcctgcagggccagtcagaacattggtancaacttagcctggtaccaaacaaaaacctggaccagcctcccagactcctcatttancgttcactccaccaggccactgatcgtcccaacagtattcagtggcaggaggtctgggacagacttcagtcncaccatcagcagctagnctagaagacttgactagtttattactgtacaatatgtgtcagtggtcctgacgtcgccaggcagagngatatcgnggacactgngctgccacgatctntctc

SEQ ID NO: 91637 - DNA, 558 bp, Homo sapiens
  misc_feature: GYAE6OF02GEOE8.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (437)..(437): a, c, t, g, unknown or other
  misc_feature (437)..(437): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctctcctgcagggccagtcagaacattggancaacttgcctggtaccaacaaaaacctggccagcctcccagactcctcatttatcgttcactccaccagggccactgatcgtcccaaccagattcagtcggcaggagggtctgggacagtacttcagtctcaccactcacgcagcgtacagtactagaagacgttggctagtttattactgttacaatatgtggtnagtcgcctcgtaacggttccgacccgagggacccaacgtacggtaggtacgtacgtcgaacggtccgtaacgttgggtacggtccgtcggtaccgaaccctagtccgttcgttctttaccg

SEQ ID NO: 91638 - DNA, 589 bp, Homo sapiens
  misc_feature: GYAE6OF02JXYII.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (567)..(567): a, c, t, g, unknown or other
  misc_feature (567)..(567): n is a, c, g, or t
  modified_base (577)..(577): a, c, t, g, unknown or other
  misc_feature (577)..(577): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcccaccctctcctgcagggccagtcagaacattggancaacttgcctggtaccaacaaaaacctggccagcctccagactcctctattactcgttcactaccaccgtagggcccacgtgtactcgtacccaaccgagattcagtcgacaggaggtctgggacaggacttcagtctacacatcagcagctacagtctagaacgtcttggcctaagtttactacgttgtactaaacgtactaggtcgtacgaggttcggcccgttacgtaaccggttccggaccgtaacgggtacccacgtacggtaggtactaacgtccgaaggtacccgtaagtacggttacggtcctacggaccaaccgtnttaccggttnttaccgttaccg

SEQ ID NO: 91639 - DNA, 528 bp, Homo sapiens
  misc_feature: GYAE6OF02I61XD.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (395)..(395): a, c, t, g, unknown or other
  misc_feature (395)..(395): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcccaccctctcctgcagggccagtcagaacnttggancaacttgcctggtaccaacaaaaacctggccagcctcccagactcctcatttatcgttcatccaccagggccactgatcgtcccaaccagattcagtggcagagggtctgggacagacttcagtctcaccatcagcagcgtacagtctagaanacgttggactagtttattactgtacaactaatgtagtcagtcggcctcgaacgttcggacccgagggaccagagtgatagtaccgaggccgtaacgtggtcgtcgtacgaccaccgtatccttgtccttaccg

SEQ ID NO: 91640 - DNA, 553 bp, Homo sapiens
  misc_feature: GYAE6OF02GCZI0.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaaccaacaaaaacctggaccagcctcccagactcctcattatcgttcatccaccaggccatgactcgtcccaaccagattcgagtggcagaggtctgggacagactcagtctcacatcagcagcgtacagtctagaagacttggacctagtttattactgtacaaactaagtgtgtcagttcggcctcggaacgttccggaccgacgggacctaacgagttaggacttagtacgtaacgggaccgtaaccgtggttcggaccgttcgaccgtaacccgattccgttagttccttacg

SEQ ID NO: 91641 - DNA, 635 bp, Homo sapiens
  misc_feature: GYAE6OF02G1HII.5.57.F02.1.454.CMB.1.raw
  modified_base (203)..(203): a, c, t, g, unknown or other
  misc_feature (203)..(203): n is a, c, g, or t
  modified_base (557)..(557): a, c, t, g, unknown or other
  misc_feature (557)..(557): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtcgtctccgagggganagacgccaccctctcctgcgagggccagtcaagaactagttaggacgacaacttcgccttacggtaaccaaacgaaaaaccgtggacccacgccctacccacgaccttcctactatttactcgtcactccaccgacggccactgactcgtacccaacgagtacttacgagtcggacgaggtacgggtcgtaggggacagtaccttacgacgtccacaccatacgacgcgacgcgtactagtctagaacgtctaggacttagttattacgtacgtaacaactaagtgttacggtacgtacggtccggtacccgtaacggtaccggttacccgggaaccgtacgggacctaacggngttacggtactacggttaccgaagggtaaccgtacggtcggtacgcgttacgcctaccgtagtccgttattaccgtac

SEQ ID NO: 91642 - DNA, 544 bp, Homo sapiens
  misc_feature: GYAE6OF02IMWEG.5.57.F02.1.454.CMB.1.raw
  modified_base (202)..(202): a, c, t, g, unknown or other
  misc_feature (202)..(202): n is a, c, g, or t
  modified_base (295)..(295): a, c, t, g, unknown or other
  misc_feature (295)..(295): n is a, c, g, or t
  modified_base (406)..(406): a, c, t, g, unknown or other
  misc_feature (406)..(406): n is a, c, g, or t
tcagatcagacacgcacgaccggtgctcgatttagctcgatatagttgggtttgggggaggaacgtgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgccagggcccagtccagaacatttggagcaacttagcctggtaaccaacaaaaacctggaccagcctccagactccncatttatcgttcaatccaccacggccatcgatgtccccaaccagtacttcagtggcacgagggtctgggacaggacttcaagtcctacaccattcagcagcgtaacagtcngaaagcttaggctatttattactagtcaaactaatgtcgttcagtcgactgaccgtttcggccacggtacaccgtagtaggactaagcacggacggaaccttaggtaggcgtcgacgacctacggtctgttccttacg

SEQ ID NO: 91643 - DNA, 512 bp, Homo sapiens
  misc_feature: GYAE6OF02HFY25.5.57.F02.1.454.CMB.1.raw
  modified_base (236)..(236): a, c, t, g, unknown or other
  misc_feature (236)..(236): n is a, c, g, or t
  modified_base (465)..(465): a, c, t, g, unknown or other
  misc_feature (465)..(465): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacnttggagcaacttagcctggtaccaacaaaaacctggaccagcctcccagacctcctcatttatcgttcatccaccagggccactgatcgtcccaaccagactcagtggcagagggtctgggacagacttcagtctacaccatcagcagcgtacagtctgaacgacttggactagtttattacttgtacaataatgtgtcagtcgcctacgacgttcgcccgaggaccangtaggatagtcgaaggcacgtgtcggactcgctaccatctgttctac

SEQ ID NO: 91644 - DNA, 764 bp, Homo sapiens
  misc_feature: GYAE6OF02JXN19.5.57.F02.1.454.CMB.1.raw
  modified_base (433)..(433): a, c, t, g, unknown or other
  misc_feature (433)..(433): n is a, c, g, or t
  modified_base (563)..(563): a, c, t, g, unknown or other
  misc_feature (563)..(563): n is a, c, g, or t
  modified_base (691)..(691): a, c, t, g, unknown or other
  misc_feature (691)..(691): n is a, c, g, or t
tcagatcagacacgcacgaccggtgctcgatttagctcgatatagttgggtttgggggtagggaacgtgcgtcagttaggacccagacggaaccatggaagccccagcgcagcttctcttcctcctcgctactcgtcggtcctcccagtactaccgggttggggagtactcggtgagtcgacgtcgtagtcctacgacgtcctactctgtctggtcgttccgaccgggagggagaggtccgacccctaccgttcctcgttacggccgggtacgggtccgtaacgtaccgaacgtaacggttaggtttcgggaacgaacctaaaccggttcggtacccgttaaccggtaaaacctaaaaacccggtaaaaaccggcggtacccggacccgtacccgttaacccaaccggtaccctaccctacttagtttaaccncgttaccaacctccgaaaccgtcggtacccagtaccggtatacccggaaccaaccgtagtaacgtcgacggtacgacggtaaggtcggtacgtacggaactaacggtcttctacgtccttacgaccctanaccgtaggctacgtacctagaggttaccaaggtaacctagtccggtacttaacgttattaccgtacgaacaacggttgtcgtcggtactagggtcaaccgtaccgtacggaccggtccgaggtaaacncgttgtaagctagtacggcggtacctaagtgggtactacggtcaaccaccgttagtaccgtcgttcctaaccg

SEQ ID NO: 91645 - DNA, 732 bp, Homo sapiens
  misc_feature: GYAE6OF02HB70Y.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtcctccgaggggagagacgcccaccctctcctgcacgggccagtcaagaacagttggtagcaacttgcctacggtaaccaaacaaaacctggaccacgcctacccgagacctcctactactttatccgttacactaccaccgacggcctacgtgactccgtacccaacgagacttcgagtcggacaggaggtcgagggacagacttacgagtcctacgacctacgacgtaccgacgacgtacgtaacgtacgtacgtaacggtaacgttacggttacgtacgttttaagtttacttacgttaacgtaaaccttaagttaacgttcggttaacggtacggtacgggttacccggttaccggttaaccgggttaacccggttaccccgggaaccggtaaaccgggtaaccctaacgggtacgggtaagttacgttaaccggtaacgggaacgggtaacccgggttaaggttaccgggttacggtaccggtaccgtaacccgaccggtttacgtttaccggtttacggtttaccctttaacccgg

SEQ ID NO: 91646 - DNA, 558 bp, Homo sapiens
  misc_feature: GYAE6OF02GF7AU.5.57.F02.1.454.CMB.1.raw
  modified_base (201)..(201): a, c, t, g, unknown or other
  misc_feature (201)..(201): n is a, c, g, or t
  modified_base (361)..(361): a, c, t, g, unknown or other
  misc_feature (361)..(361): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttgcctggtaccaacaaaaacctggccagcctcccagactcctcatttatcgttcatccaccagggccactgatcgtcccaacagattcagtggcagagggtctgggacagacttnagtctcaccatcagcagcgtacagtctagaagtacttggacttagtttacttactgttacaactagtgtggtcgaggtcggtaccgtacgtaaccggttcggacccgaacgggtacccaacgtaggtaggtatacgtacgaagggtaccgtaacgtggtcggactcggacctaaccgtagtccgttgtacttacccg

SEQ ID NO: 91647 - DNA, 512 bp, Homo sapiens
  misc_feature: GYAE6OF02G15UR.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (398)..(398): a, c, t, g, unknown or other
  misc_feature (398)..(398): n is a, c, g, or t
  modified_base (463)..(463): a, c, t, g, unknown or other
  misc_feature (463)..(463): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtancaacttgcctggtaccaacaaaaacctggccagcctcccagactcctcatttatcgttcactccaccagggccactgactcgtacccaaccagacttcagtggcagagggtctgggacagacttcagtctcaccatcagcagctacagtctagaancgttggctagtttattacgtgtacaatatgtagtcagtcgctacgacgttcgaccgaggaccagngtggatacgcgacggactaacgtgtcggctggccacgtatcgtgttctc

SEQ ID NO: 91648 - DNA, 505 bp, Homo sapiens
  misc_feature: GYAE6OF02ISXLN.5.57.F02.1.454.CMB.1.raw
  modified_base (400)..(400): a, c, t, g, unknown or other
  misc_feature (400)..(400): n is a, c, g, or t
  modified_base (465)..(465): a, c, t, g, unknown or other
  misc_feature (465)..(465): n is a, c, g, or t
  modified_base (475)..(475): a, c, t, g, unknown or other
  misc_feature (475)..(475): n is a, c, g, or t
  modified_base (486)..(486): a, c, t, g, unknown or other
  misc_feature (486)..(486): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtccagaacagttggtagcaacttagcctggtaacccaacaaaaacctggaccagcctcccagactcctcatttatcgttcatccaccaggccactgatcgtacccaaccagacttcagtcggcagacgggtctagggacagtacttcagtctcacatcagcagctacagtcngaagcttggctagtttatactgtacaacatgtgtcagtcgctcgaacgttcgaccgaggaccagngtgatatcgnggacaacgtgngtctgcaccatctgtctac

SEQ ID NO: 91649 - DNA, 584 bp, Homo sapiens
  misc_feature: GYAE6OF02HE7TT.5.57.F02.1.454.CMB.1.raw
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggtancaacttagcctaggtaccaacaaaacctggccagcctcccagacctcctactatttactcgttacactcccaccacgggccactgactcgtacccaaccagtacttacagtcggcaggacgggtcgtagggacagtacttcacgtctacacctatcagcacgcgtacagtctagaacgtacttggactagtttattacgtgtacaacgtaatgtacggtactaggtcggtccgtacgtaaccggtttccggacccgtaaggacccaacgtagtacggtatacggtacgaagggtacctaacgttggtcggcgtcggcaaccgtatccgttcgtcgttaccg

SEQ ID NO: 91650 - DNA, 780 bp, Homo sapiens
  misc_feature: GYAE6OF02HZCX6.5.57.F02.1.454.CMB.1.raw
  modified_base (151)..(151): a, c, t, g, unknown or other
  misc_feature (151)..(151): n is a, c, g, or t
  modified_base (186)..(186): a, c, t, g, unknown or other
  misc_feature (186)..(186): n is a, c, g, or t
  modified_base (200)..(200): a, c, t, g, unknown or other
  misc_feature (200)..(200): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctccagataccgttgggganatcgtgatgacgcagtctccagccatcctgtctgngtctccgagggganagagcccacctctcctaggccaggggccagtcaagaactgtttcggaagcctaaacgtttcgccgtacggtaaccaaaacctaaaaaccgtcggaccacgacccttacccgaacgtaccgtaccctattaactttactaccgttactactaccaaccgacggtacccagtacgtactaccgtacccctaaaaccgagtacgttaccgaacgggttcgacggtaacggtaacgggttaccggtaaggggtaaccctaacggtaacctttccgtaagttaccgtaccgtaacacgtacgtaccgtacgaacgtacgttaaacccgtagttacggttaagaaacgggttacgttacggggactttaaacggttttaacgttaaccgttagtaaaccgttaaactaaggttcggttacgggttaaccgtacggtttaccgggacgttaacccggtaagggtttacccgacccgtaacgggggaaccctaaacgaaccggttagggaacttacggtccgtaacggtaagtaacccgtaggtacgtcccgtgtaacccgacttaacggctttagtacccgttaacg

SEQ ID NO: 91651 - DNA, 619 bp, Homo sapiens
  misc_feature: GYAE6OF02G4SMO.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggagcaacttagcctggtaccaacaaaaacctggccagcctcccagacctcctcatttatcgttcatccaccagggccactgatcgtcccaaccagattcagtggcagagggtctgggacagtacttcagtctcaccatcagcacgcgtacagtctagaacgtacgttggctagtttattactgtacaactatgtaggtcaggtcggtaccgttaccggtaaccggtttaccggccccggtaacgggacccgtaacgtacgggttacgggtaacttacggtaccggtaacgggaccggttaaaccgttcgggttacgggtccgttacgggtaacccgaaccccgttaacggtttccgtttcggttacccgtttttaccccg

SEQ ID NO: 91652 - DNA, 670 bp, Homo sapiens
  misc_feature: GYAE6OF02GF3D0.5.57.F02.1.454.CMB.1.raw
tcagatcagacacgcacgaccggtgctcgatttagctcgatatagttgggtttggggggaggaacgtgcctcagttaggacccgagtaccggaaccattcggaagtccccgagcgcagcttctcttacctcctgctactctcggctcccgagtagtaccgttggggagatcggttgtattgacgctagtactccagccatcctgtctagtgtctccagggagagagccaccgtctcctgcagggccagtcagactacttggtagactaactacgccttggtaaccaaacaaaaacctggaccagacctacccagacctcctactacgttacgtcgttacactccgaaccgagggcctacgtgagtcgtacccaaccgtagtactacagtgacgagacggtctagggtactaggtaccttacgacttccgtacgaacccgacgtaccaaccgtaccgaacgtaccgtaacgtacttaccgtacgaaacgtaacgttcggtaactacgttttaacttacgttacgtacaacgtaagtacgtacgtctaacggttacgaccgtacgtaaccggtccgtacccgaccgggtaccaacgtagtacggtatacgtcgaaggtaccgtaactgtacggtacctacgtcctaacctcgtacgtaccgtacgttaaccg

SEQ ID NO: 91653 - DNA, 502 bp, Homo sapiens
  misc_feature: GYAE6OF02HLGVH.5.57.F02.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctntcctgcagggccagtcagaacattggancaacttagcctggtaccaacaaaaacctggaccagcctcccagactcctcatttatcgttcatccaccagggccactgatcgtacccaaccagacttcagtggcagagggtctgggacagacttcagtctcaccatcagcagcgtacagtctagaacgacttggctaagtttattactgtacaacatgtgcagtgcctcgaacgttccgaccagggaccacgagtgatactgaggacgactgtggctgcacatctgtcttc

SEQ ID NO: 91654 - DNA, 505 bp, Homo sapiens
  misc_feature: GYAE6OF02GV847.5.57.F02.1.454.CMB.1.raw
  modified_base (201)..(201): a, c, t, g, unknown or other
  misc_feature (201)..(201): n is a, c, g, or t
  modified_base (299)..(299): a, c, t, g, unknown or other
  misc_feature (299)..(299): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggtagcaacttagcctggtaccaacaaaaacctggaccagcctcccagactcctcatttancgttcatccaccaggccactgatgtcccaaccagattcagtggcagagggtctgggacagacttcagtctcaccatcagcagcgtacagtctagaagacttggctagtttattactgtacaacaatgtggtcagtgcctcgaacgttcgcccagggaccacgagtggatagcgaggacgaacgtgtggctgcaccatctgtcttcc

SEQ ID NO: 91655 - DNA, 578 bp, Homo sapiens
  misc_feature: GYAE6OF02JB453.5.57.F02.1.454.CMB.1.raw
  modified_base (418)..(418): a, c, t, g, unknown or other
  misc_feature (418)..(418): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaaccaacaaaaacctggaccagccctaccccagacctcctactatttactccgttcactcccaccgagggcccactgactcgtacccaaccgagtacttcagtcggacaggagggtctaggggacacgtacttcgagtctacacctatcagcaacgccgtanacgtctagaactacgttaggacttaggtttacttatcgtactaaacagttgtgtcgagtcggtcctacggtaacgttccggaccgacggaccagaggtgactacgtacgacggactaacgtggttcgacgttacgaccgtacctagtcgttcgttctacc

SEQ ID NO: 91656 - DNA, 784 bp, Homo sapiens
  misc_feature: GYAE6OF02IMDC3.5.57.F02.1.454.CMB.1.raw
  modified_base (151)..(151): a, c, t, g, unknown or other
  misc_feature (151)..(151): n is a, c, g, or t
  modified_base (190)..(190): a, c, t, g, unknown or other
  misc_feature (190)..(190): n is a, c, g, or t
  modified_base (200)..(200): a, c, t, g, unknown or other
  misc_feature (200)..(200): n is a, c, g, or t
  modified_base (251)..(251): a, c, t, g, unknown or other
  misc_feature (251)..(251): n is a, c, g, or t
tcagatcagacacgcacgaccggtgctcgatttagctcgatatagttgggtttggggaggaacgtgctcagttaggacccagacggaaccatggaagccccagcgcagcttctcttcctctgctactctggctccagactccgttgggganatcgtgatgacgcagtctccagccatcctgtctgtctcnccgagggganagcgcccacctctccgtgccgacgggccaagtcaacgaactagtttgggancctaaacgttcgcctaggtaaccaaacgtaaaaaccgtcggaccacgaccctaccgacgtacctcctacctaacgtttactaccgtttaccacttacccgaccgtacggtacctaaccttacggtacctacgttaaccccgaacctaacggttacttaccgacgttacgggacaacggtacggggttccgtacgggaacgaacggtacctttacgaacgttcctaccgaccgtaacgttccgaacgtacgaacggtaccgtaaaccgtacgtaccgttaggaaacgttacgttggaaccgtttagtttaaacgttcgtacgtaaccgtaaagttaactgggttacggttacctagggttaccgtacccgttaaacggtacccggttaaccggtacccggtaaccgggtaaacgtaaccgacggttacggaacgttacgttaccggaagggtacccggtaacttaaccggggtacctacgggttaaccggtaccgaaccccgttacggttacccgttacgtacctttaacccgg

SEQ ID NO: 91657 - DNA, 505 bp, Homo sapiens
  misc_feature: GYAE6OF02GKREY.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttgcctggtaccaacaaaaacctggccagcctcccagactcctcatttatcgttcatccaccagggccactgatcgtcccaaccagacttcagtggcagagggtctgggacagacttcagtctcaccatcagcagcgtacagtctagaagacttggctagtttattactgtacaacatgtgtcagtcgcctagaacgttcggaccaggaccagagtagatatcgacggcaacgtggtacgctgccaccatctgtcttacg

SEQ ID NO: 91658 - DNA, 551 bp, Homo sapiens
  misc_feature: GYAE6OF02IDAAY.5.57.F02.1.454.CMB.1.raw
  modified_base (201)..(201): a, c, t, g, unknown or other
  misc_feature (201)..(201): n is a, c, g, or t
  modified_base (451)..(451): a, c, t, g, unknown or other
  misc_feature (451)..(451): n is a, c, g, or t
  modified_base (540)..(540): a, c, t, g, unknown or other
  misc_feature (540)..(540): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctaggtaaccaaacaaaaacctggaccagcctcccagactcctcatttactcgttcactccaccaggccactgatcgtaccccaacagtacttcgagtggacaggacgggtctgggacaggtaccttacgagttcctccacctatcagcacggcctaacgagtctaggaacgtcgttaggctaagttttatactgtacaanagttgtggtcaggtcggccctacggaaccgttcggcccgaagggacccagtaggtgatacgtcgaggacgtaacgtgcggctcgccacnttctcgtcttc

SEQ ID NO: 91659 - DNA, 514 bp, Homo sapiens
  misc_feature: GYAE6OF02IG8O4.5.57.F02.1.454.CMB.1.raw
  modified_base (201)..(201): a, c, t, g, unknown or other
  misc_feature (201)..(201): n is a, c, g, or t
  modified_base (243)..(243): a, c, t, g, unknown or other
  misc_feature (243)..(243): n is a, c, g, or t
  modified_base (353)..(353): a, c, t, g, unknown or other
  misc_feature (353)..(353): n is a, c, g, or t
  modified_base (434)..(434): a, c, t, g, unknown or other
  misc_feature (434)..(434): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggtancaacttgcctggtaaccaacaaaaacctggccagcctcccagactcctcatttactcgttcatccaccagggccactgatcgtcccaaccagattcagtgcaggaggtcnggacagacttcgatctcaccatcagcagtcgtactagtctagtaaagcttggctagtttattactgtacaacagttgtgtnaggtcgccgtcgaacgttcgacccaagggaccacgagtagatagcgaggcaacgtgtacgctcgcaccatcgtcgtctcc

SEQ ID NO: 91660 - DNA, 570 bp, Homo sapiens
  misc_feature: GYAE6OF02HYDUI.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgccaccctctcctgccagggccagtcagaacattggagcaacttagcctaggtaccaaacaaaaacctggaccagccctcccagacctcctctaatttactcgttcactccaaccacgggaccactagatcgtacccaaccagtacttcaggttcggcaggacgggtctagggacagtaccttcgagtctcaccatacagcacgcgtaacagtctagaagcttggtactagtttatacgtagtacaactatggtacgtcaggttcggcctacgtaacgttccggaccgtacgggacaacgaggtacgatactacgacggtcgaacgtggtacgcgtacgccgacctacgttcgtacgtcgttac

SEQ ID NO: 91661 - DNA, 743 bp, Homo sapiens
  misc_feature: GYAE6OF02G0ZW9.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagacgcccaccctctccgtgcgagggccagtcaagaactagttggagctaacgttacgccgtaggtaacccaaaactaaaaaaccgtcggacccaacgccctacccgaacgacctcccgtactaacttttactccgttacactaccctaaccgacgggcctacgtgactcgtaacccaaccagtacttcgagtgacgaggtaggtcgtagggacagtacgttcgacgttccaccaacctactcgaacgcgaacggtaccgttaacgacgttacgtaggtaaacgtacggtttacggtaaccttaagttttaacgttaaccgttcggttaaactaaaacgtaagtttcggacggttacgtaggttacccggtaccgtttaaccggtaaccgggtttcccgaacccggtaaacgggtacccaaacgtacgggttaaggtacttaaccggtacgggtaaccggtaacggtaaacgtttcggggtacgtccgtaaccggtacccggtaaccctaacggtttcccgtttacgttcccgtttaacccg

SEQ ID NO: 91662 - DNA, 516 bp, Homo sapiens
  misc_feature: GYAE6OF02HHX7I.5.57.F02.1.454.CMB.1.raw
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacnttggancaacttgcctggtaccaacaaaaacctggaccagcctcccagacctcctcatttatcgttcatccaccagggccactgactcgtacccaaccagattcagtggcagagggtctgggacagacttcagtctcaccatcagcagcgtacagtctagaacgacgttggctagtttattactgtacaacatgtgtcagtcgctacgacgttcgccgaggaccagagtgatagtcgaggacgactggtcgcgtacgaccactactacgttgtcttaccg

SEQ ID NO: 91663 - DNA, 714 bp, Homo sapiens
  misc_feature: GYAE6OF02ISMTA.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggggatagtcgtagtagtacgacgacgtagtcctacacgactactctgtcgtgttcgtccgtacggagggagagaccgaccctacccttcctcgcgacggaccggaccgtacgtacgaacgaacttaggttacggacgaccttaacgtacgtcgtaccgaaaccaaaaccgtaaaccgccgaccaccgtccccaccgacgtacctcctactttattactcttacacctaccgacggaccggactacgtagtactaccctaacccaacgtatactacgaggtcgacgagggtcggtacggaggacgtacgttactacgtacttaccaccactactacgacacgacgttaccagttcgtagtaagtaacgttcgtacgtacgtttagtttaactacggttacaaaccgtaatacggttcgggtcgtaagtcggttaccgtacccgtttaaaccgggtcccggttacccggaacgggtaccgaaccctaggttacgggtatacgtaccgaacgggtcgaacgttacggttgaccgtgtacccaccgtaccgttatcgttacttctaccg

SEQ ID NO: 91664 - DNA, 598 bp, Homo sapiens
  misc_feature: GYAE6OF02IIGU2.5.57.F02.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagngccaccctctcctgcagggccagtcagaacattggancaacttagcctggtaaccaacaaaaacctggaccagccctcccagacctcctctatttactcgttcactcccaccgacgggccactgactcgtccccaaaccagacttcagtcggcaggagggtcgtgggacagacttcacgtctcaccatcagcagcgtacagtctagaagtacttggacttagtttattactcgttacaaactagtggtaggtctaggtacggtccttaccgtaacggtttccgggacccgtacgggacccctacgtaggttcggactacgtaccggacggtaccggaaccgttcggtacggccgtacggacccgaccgtagttccgttccgttacctttacccg

SEQ ID NO: 91665 - DNA, 565 bp, Homo sapiens
  misc_feature: GYAE6OF02IN9AU.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (406)..(406): a, c, t, g, unknown or other
  misc_feature (406)..(406): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcccaccctctcctgcagggccagtcagaacattggancaacttagcctggtaaccaaacaaaaacctggccagcctcccagactcctactatttatcgttcatcccaccgaggaccactgactcgtacccaacagacttcagtcgacaggtaggtctgggacaggtacttacagtctacacctatacagcagtacgtaacngtactagaaacgtacgttggactagttttaactctagtacaataagttgtagtacaggtcgtacctacgtaacgttccggacccgtaagggaccaacgtaggtacgatagtacgaggaccgtaagtgtacggtctacgacctaccagtctcgtcttacg

SEQ ID NO: 91666 - DNA, 525 bp, Homo sapiens
  misc_feature: GYAE6OF02IOMGV.5.57.F02.1.454.CMB.1.raw
  modified_base (386)..(386): a, c, t, g, unknown or other
  misc_feature (386)..(386): n is a, c, g, or t
  modified_base (417)..(417): a, c, t, g, unknown or other
  misc_feature (417)..(417): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggtagcaacttagcctggtaaccaacaaaaacctggccagcctcccagactcctcatttatcgttcatccaccaggccactgatcgtacccaacagattcagtgcaggagggtctgggacagacttcagtctcacatcagcagcgtanagtctagaagtacttgactagtttattactntacaatatgtagtcagtgcctacgacgttcgaccgacggaccacgagtggatacgtacgaggaccgtaacgtggtggcgtcgactacctagtccttaggtccttaccg

SEQ ID NO: 91667 - DNA, 547 bp, Homo sapiens
  misc_feature: GYAE6OF02FXPEL.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcattatcgttcatccaccaggccactgatgtcccaacagattcagtgcagagggtctgggacagacttcagtctccacatacagcagcgtacacgtctgaagacttggacagtttattactgtacaacaagtgtggtacagtggcctacgtaacggttccggtcccaagggtacccgacgagtcggtatacgtacgacggaccgtaacgtcggtacggtccgtcggtaccgaaccctagtccttacggtccttaccg

SEQ ID NO: 91668 - DNA, 518 bp, Homo sapiens
  misc_feature: GYAE6OF02IR20D.5.57.F02.1.454.CMB.1.raw
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (356)..(356): a, c, t, g, unknown or other
  misc_feature (356)..(356): n is a, c, g, or t
  modified_base (498)..(498): a, c, t, g, unknown or other
  misc_feature (498)..(498): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagcccaccctctcctgcagggccagtcagaacnttggancaacttgcctggtaccaacaaaaacctggccagcctccagactcctcatttatcgttcactccaccaggccactgactcgtacccaaccagtacttcagtggacagagggtcngggacagacttcagtctcaccatcagcagacgtacagtctagaacgtacttggactagtttatactgtacaactatgtgtacagtcgcctagtaaccgtcgccagggaccacgagtggatagtcgaaggcgaacgtgtacgntcgacaccatctgtcttacg

SEQ ID NO: 91669 - DNA, 540 bp, Homo sapiens
  misc_feature: GYAE6OF02GH22S.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
  modified_base (396)..(396): a, c, t, g, unknown or other
  misc_feature (396)..(396): n is a, c, g, or t
  modified_base (431)..(431): a, c, t, g, unknown or other
  misc_feature (431)..(431): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtcctccagggganagacgcccaccctctcctgccagggccagtcagaacattggancaacttgcctggtaccaacaaaaacctggaccagcctcccagactcctcatttactcgttcatcccaccacgggccactgatcgtacccaacagacttcagtggacaggagggtctgggacagtactcagtctcaccatcagcagcgtangtcagaagacgttggactagtttatactgtacaanatgtgtacagtcgcgtcgaacgttccggaccgacggaccacgagtcggtatacgtcgagggacctaacgtggtacggcgtacgccgtacctagtccgttagtcttaccg

SEQ ID NO: 91670 - DNA, 550 bp, Homo sapiens
  misc_feature: GYAE6OF02IYOVN.5.57.F02.1.454.CMB.1.raw
  modified_base (410)..(410): a, c, t, g, unknown or other
  misc_feature (410)..(410): n is a, c, g, or t
  modified_base (439)..(439): a, c, t, g, unknown or other
  misc_feature (439)..(439): n is a, c, g, or t
  modified_base (537)..(537): a, c, t, g, unknown or other
  misc_feature (537)..(537): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggagcaacttagcctggtaaccaacaaaaacctggaccacgcctcccagacctcctactatttatcgttcactccaccgacggccactgactcgtacccaaccagtattccagtcggaccgaaggtacgggtctgggacagtactcagtctcacctatccagcagccgtacngtctagagtactggctagtttattacgtntaacaactaagtgtggtcaggtcgtacctacgtaacggttcgacccgtaggacctagagtcgatgtacgacggtacctaagtggtgcgtacgccaacntaccgtgtcttac

SEQ ID NO: 91671 - DNA, 518 bp, Homo sapiens
  misc_feature: GYAE6OF02FL4VS.5.57.F02.1.454.CMB.1.raw
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
  modified_base (371)..(371): a, c, t, g, unknown or other
  misc_feature (371)..(371): n is a, c, g, or t
  modified_base (432)..(432): a, c, t, g, unknown or other
  misc_feature (432)..(432): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctctcctgcagggccagtcagacattggancaacttgcctggtaccaacaaaaacctggccagcctcccagactcctcatttatcgttcatccaccaggccactgatgtccccaacagattcagtgcagagggtcagggacagacttcagtctcaccancagcagcgtacagtctagagtacttggactagtttattcgtgttacaaactaatgtaggtntagtgcctcgaacgttccggcccgaagggacccagaggtgatagtcgaacggcgtaacgtggtgcgtcgcaccgatctgtcttacg

SEQ ID NO: 91672 - DNA, 606 bp, Homo sapiens
  misc_feature: GYAE6OF02GBL3S.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtancaacttgcctggtaaccaacaaaaacctggaccagccctcccagacctcctactatttactcgttcactcccaaccacgggccactgatcgtacccaaccagtacttcagtggcaggagggtctgggaacagtacttcgacgtctacaccatcacgcacgtccgtaacagttctaaggaacgtacgttggacttaagttttacttacgtgttacaaacgtagttcgtaggtcaggttcggaccctacggtaaccggttccggaacccggaacgggtacccaagtacggttaggactacgtacggagggtaaccgtacggtcggtcggacgtcgaccgtaccgtagttccgttacttccttaccg

SEQ ID NO: 91673 - DNA, 527 bp, Homo sapiens
  misc_feature: GYAE6OF02F46M8.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (390)..(390): a, c, t, g, unknown or other
  misc_feature (390)..(390): n is a, c, g, or t
  modified_base (440)..(440): a, c, t, g, unknown or other
  misc_feature (440)..(440): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccacctctcctgcagggccagtcagaacattggagcaacttagcctggtaccaacaaaaacctggccagcctcccagactcctcatttatcgttcatccaccagggccactgactcgtacccaacagattcagtcggcaggtaggtctgggacagacttcagtctcaccatcacgcaagccgtanacgtctagaagtacttggactaggtttaattactgtacaatagtgtggtnaggtcggcctacgaacgttccgaccgaggaccagacgtagatactcgaggacgtaacgtgtggtctacggcaccactcgtgtcttac

SEQ ID NO: 91674 - DNA, 511 bp, Homo sapiens
  misc_feature: GYAE6OF02G8F90.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacattggancaacttgcctggtaccaacaaaaacctggccagcctcccagactcctcatttatcgttcatccacagggccactgatcgtcccaaccagattcagtggcagagggtctgggacagacttcagtctcaccgatcagcagcgtacagtctgaagcttggctagtttattactgtacaacatgngtnagtgcctcgaacgttcgccaggaccacgagtcgatactcgaggccgtaacgtggtggtcgtagctaccatcctggttccttaccg

SEQ ID NO: 91675 - DNA, 577 bp, Homo sapiens
  misc_feature: GYAE6OF02JJ7CK.5.57.F02.1.454.CMB.1.raw
  modified_base (202)..(202): a, c, t, g, unknown or other
  misc_feature (202)..(202): n is a, c, g, or t
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
  modified_base (377)..(377): a, c, t, g, unknown or other
  misc_feature (377)..(377): n is a, c, g, or t
  modified_base (420)..(420): a, c, t, g, unknown or other
  misc_feature (420)..(420): n is a, c, g, or t
  modified_base (571)..(571): a, c, t, g, unknown or other
  misc_feature (571)..(571): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctctccngcagggccagtcagaacnttggagcaaacttgcctggtaacccaaacaaaaaccgtggaccagcctaccccagacctctacatttatccgttcaacttccaaccagggccctatcgatcgtaccccaaacagtaattccgagtggacaagacgggtcngggaacagtccttacagtcctcaacctatcagcagcgttaacngtctagagtacttgggactatttagtactgtacaatattgtaggttcagggttcgccgtacgtaacggtaccggcctagggacccaagtcgttaggatacgacgtaacggaccgtaacgtgtacggcgtacgacctaccatcgttaccttnttaccg

SEQ ID NO: 91676 - DNA, 659 bp, Homo sapiens
  misc_feature: GYAE6OF02I4DRC.5.57.F02.1.454.CMB.1.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctctcctgcagggccagtcagaacattggancaacttgcctggtaaccaaacaaaaacctggaccagcctcccagactcctctatttatcgttcactccaccgaggccactgactcgtacccaacagtacttcagtggcaggtacgggtctgggaacagtacttcgacgttcctaccaacctattaccgagaccaacgtaccgttaacacggttctaggaaacgtacgttaggaccttaaggttttaacttaactgttaaccaaacgtaagttcggtaggtacgtaacggttcggtacccgtacgggtaaccgtttccccggggacccgtaacggggtacccacgtaacgggttacggtacttaaccgtacgacgggtaccggtaaacggttggtacgggaccttacggtaccctaacccgtattccggttaccgtttcttaacccg

SEQ ID NO: 91677 - DNA, 512 bp, Homo sapiens
  misc_feature: GYAE6OF02FR7M1.5.57.F02.1.454.CMB.1.raw
  modified_base (202)..(202): a, c, t, g, unknown or other
  misc_feature (202)..(202): n is a, c, g, or t
  modified_base (434)..(434): a, c, t, g, unknown or other
  misc_feature (434)..(434): n is a, c, g, or t
  modified_base (474)..(474): a, c, t, g, unknown or other
  misc_feature (474)..(474): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctctcctgcagggccagtcagaacattggtagcaacttgcctggtaccaaacaaaaacctggccagcctacccagactccctcactttatcgttcatccaccagggccactgatcgtacccaaccagattcagtggcaggagggtctgggacagactcagtctcaccatcagcagcgtacagtctagaagcgttggctagtttattactgtacaactattgngtcagtggccgtacgacgtccgccgtaggaccagagtgantcgaggcaacgtgtgcgtgctaccgagtctgtcttacc

SEQ ID NO: 91678 - DNA, 757 bp, Homo sapiens
  misc_feature: GYAE6OF02IAIWJ.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgccaccctctcctgcagggccagtcagaacagttggagccaattagcctaggtaccaaacaaaaacctggaccacgcctccagacctcctctatttactccgtttcactcccaccgacgggcctacgtgactcgtaccccaaaccgagtacttccgaagttcggactaagggtacggggtcgtacgggaacctacggtaaccgtttcgaacggttccttacccgaaccctaacgttaccgaacggtccgtaacggtacccggttaaccgtaacggttccgtaaggtaaaccgtacgtttacgggtacctttaaggttttaacgttaccgtagttaacctaaaacgttaagttcggttacgggtacgtaacgggttaccgggtacccgttaccgggttaaccggtttaccccgggacccgtaaccggggtaaaccctaccggtaacggttacggtacgttaacgtaccggtaacggggtaccgttaacggtcgggttacggccgttacggaccctacccgtaacgtttcccgttacgtttccctttaacccgg

SEQ ID NO: 91679 - DNA, 540 bp, Homo sapiens
  misc_feature: GYAE6OF02JY6KY.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (528)..(528): a, c, t, g, unknown or other
  misc_feature (528)..(528): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcagggccagtcagaacnttggtanctaacttgcctggtaaccaaacaaaaacctggaccagccctacccagacctcctactatttactcgttcactaccaccgacgggcctactgactcgtacccaacagtacttcagtgacagaggtctgggactagtactcagtctacacatcagcagcgtacagtctagaactacgttggactagtttatactagtacaactatgtacgatagtcgactacgacgttccgccgaggaccacgtagtgatacgtacgacggactacgtggcgtcgtcgacacgtntcgtgtcctacg

SEQ ID NO: 91680 - DNA, 499 bp, Homo sapiens
  misc_feature: GYAE6OF02GU8EE.5.57.F02.1.454.CMB.1.raw
  modified_base (201)..(201): a, c, t, g, unknown or other
  misc_feature (201)..(201): n is a, c, g, or t
  modified_base (297)..(297): a, c, t, g, unknown or other
  misc_feature (297)..(297): n is a, c, g, or t
  modified_base (411)..(411): a, c, t, g, unknown or other
  misc_feature (411)..(411): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttancgttcatccaccaggccactgatgtcccaaccagattcagtgcagagggtctgggacagacttcagtctcaccatcagcagcgtacagtcagaagacttggcagtttattaacngtacaacatgtgtcagtgcctcgaacgttcggcccagggaccacgagtggatactcgaaggcgaactgtgctgcaccatctgtcttac

SEQ ID NO: 91681 - DNA, 502 bp, Homo sapiens
  misc_feature: GYAE6OF02GS0JB.5.57.F02.1.454.CMB.1.raw
  modified_base (201)..(201): a, c, t, g, unknown or other
  misc_feature (201)..(201): n is a, c, g, or t
  modified_base (425)..(425): a, c, t, g, unknown or other
  misc_feature (425)..(425): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggaccagcctcccagactcctcatttatcgttcatccaccagggccactgatcgtacccaaccagattcagtgcagagggtctgggacagtactcagtctacaccatcagcagcgtacagtctgaagtacttggctagtttacttactgtacaanatgtgtcagtcgctcgacgttcggccagggaccagagtgatagtcgaggacgactgtgcctgcaccgatctgtcttc

SEQ ID NO: 91682 - DNA, 572 bp, Homo sapiens
  misc_feature: GYAE6OF02IO6S0.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (556)..(556): a, c, t, g, unknown or other
  misc_feature (556)..(556): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtancaacttgcctggtaaccaacaaaaacctggaccagcctacccagactcctcatttatcgttacactccaccacggccactacgactcgtaccccaaaccagtattccaggtcggcaaggacgggtctagggaacagacttcagttctacacctatccagcacgacgtacagtctagaacgtacgttggacctagtttacttacttgtacaaatatggtagttacaggtcgacttcggaacgttccgacccgtagggacccagtagtacggactaacgtcgaggaccgaagtcggacggtactcggaccaccgtntacgtcgttacttacg

SEQ ID NO: 91683 - DNA, 576 bp, Homo sapiens
  misc_feature: GYAE6OF02FYRRL.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagccaccctctcctgcagggccagtcagaacngttggtanctaacttagcctaggtaccaaacaaaaacctggaccacgcctcccagactcctacatttatcgttcactccaccgacgggccactgactcgtacccaacagactcagtgacaggaggtcgtagggacagacttcagtctacacactcagcacgcgtacacgtcgtagaacgtacgttggacttaagttttacttactcgttaacaaacgtatggtcggtactaggtacgtcctacggtaaccggttccggacccgtacgggacccagtaggtacgactaagtcgtacggacgtacgtggtcgtactcggcctaccgtagtcgtcgtcttacc

SEQ ID NO: 91684 - DNA, 591 bp, Homo sapiens
  misc_feature: GYAE6OF02IN54E.5.57.F02.1.454.CMB.1.raw
  modified_base (387)..(387): a, c, t, g, unknown or other
  misc_feature (387)..(387): n is a, c, g, or t
  modified_base (405)..(405): a, c, t, g, unknown or other
  misc_feature (405)..(405): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggagcaacttgcctggtaaccaacaaaaacctggccagccctccccagacctcctactatttactcgttcactcccaccgacgggccacgtgactcgtacccaaccagacttcagtggacaggacgggtctgggacagacttcacgtcncacatcagcacgcgtacngtcagagacttggacctagtttattacttagtacctaataagtggtcggtacaggttcggtccgttacgtacggttccgcccgtaacgggacctaacgaggtacggtaacttacgtacggacgggaccgttaacgttcggtacggtaccgtcgtacctaacccgacttccgttcgttaccttaccg

SEQ ID NO: 91685 - DNA, 506 bp, Homo sapiens
  misc_feature: GYAE6OF02F2QZW.5.57.F02.1.454.CMB.1.raw
  modified_base (201)..(201): a, c, t, g, unknown or other
  misc_feature (201)..(201): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaacaaaaacctggaccagcctcccagactcctcatttatcgttcatccaccaggccactgatgtcccaacagattcagtgcagagggtctgggacagactcagtctcacatcagcagctacngtcngaagacttgactagtttatactgtacaatatgtgtcagtcgcctacgaacgttccggaccgacggaccacgagtggatagtcgaggacgaacgtggtcgcgtgccacctagtcttgtcttac

SEQ ID NO: 91686 - DNA, 546 bp, Homo sapiens
  misc_feature: GYAE6OF02HDLP8.5.57.F02.1.454.CMB.1.raw
  modified_base (152)..(152): a, c, t, g, unknown or other
  misc_feature (152)..(152): n is a, c, g, or t
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctntcctgcagggccagtcagaacattggancaattagcctggtaccaacaaaaacctggccagcctcccagactcctcattatcgttcatccaccagggccactgactcgtcccaaccagattcagtggcaggaggtctggacagacttcagtctcactatcagcagcgtacagtctagaagtacttggactagtttatacgttgtaccaagtaatgtacggttcaggtcggcctcgaacggtttccgaccgtacggaccgacagtcggatacgtacgaacggtaccgaaactggtcggtaccgtcgacctaccgtaactcgttacgtctttaccg

SEQ ID NO: 91687 - DNA, 546 bp, Homo sapiens
  misc_feature: GYAE6OF02IHEMG.5.57.F02.1.454.CMB.1.raw
  modified_base (202)..(202): a, c, t, g, unknown or other
  misc_feature (202)..(202): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
tcagatcagacacgcacgaccggtgctcgatttagctcgatatagttgggtttgggggaggaactgctcagttaggacccagacggaaccatggaagccccagcgcagcttctcttccctcctgctactctggctcccagataccgttggggagatcgtgatgacgcagtctccagccatcctgtctgtgtctccagggganagagccaccctctcctgcagggccagtcagaacattggtagcaaacttagcctggtaaccaaacaaaaacctggccagcctacccagacctcctcatttatcttcatccaccaggccatgatcgcccaaccagattcagtggcagagggtctgggacagacttcagtctcaccancancagctacagtctagaagtacgtggactagtttattactgtacaacaagttgtaggtcaggtacggccctaggaaccgttccgacccgaggtaacccgaacaacgggttggacttacgtacgaggtaccgaacgtggtcgcgtcgaccaccgatcgttgtccttacg

SEQ ID NO: 91688 - DNA, 749 bp, Homo sapiens
  misc_feature: GYAE6OF02H4GC2.5.57.F02.1.454.CMB.1.raw
  modified_base (147)..(147): a, c, t, g, unknown or other
  misc_feature (147)..(147): n is a, c, g, or t
  modified_base (165)..(165): a, c, t, g, unknown or other
  misc_feature (165)..(165): n is a, c, g, or t
  modified_base (195)..(195): a, c, t, g, unknown or other
  misc_feature (195)..(195): n is a, c, g, or t
  modified_base (686)..(686): a, c, t, g, unknown or other
  misc_feature (686)..(686): n is a, c, g, or t
  modified_base (741)..(741): a, c, t, g, unknown or other
  misc_feature (741)..(741): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctgctccagatccgtggganatcgtgatgacgcagtcncagccatcctgtctgtctctccgagggganactacgccctaccctctccgtgccgacgggccagtccgaagaacctggttcgggtaagcctaaacgtttcgccgtacggtaaccaaaaccgaaaaacctcggaccacgcccgtacccaacgacctcctacactttagtccttacactacccaccgtacggccctaactcgtatccgtacccaaacgacgtacttacgacggtacgtaccggaaaggtccgggttacgtaccggggaaactacggtaaaccttccgtaacgtacccgttacccgaacccgtaattacccgtaagaccgtacggtacccgtttaaacgtcgtaacggtgtaaaccgtacggtttcgggtaacttaaggttttaaccttacgttactaaacctaaagttaacggtggttacggtacgtacggtacggtacccgtaccgggtaaaccgtttccgggaaccgaccggggtaaactaaccgtaacggggtcaacgttacgtaacggnggtaaccgtaaccggtgtaccggtactacggactaccggtactacggtttccggntttaaccg

SEQ ID NO: 91689 - DNA, 591 bp, Homo sapiens
  misc_feature: GYAE6OF02HNNYB.5.57.F02.1.454.CMB.1.raw
  modified_base (404)..(404): a, c, t, g, unknown or other
  misc_feature (404)..(404): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccaggtcagaacattggtagcaaacttagcctggtaaccaacaaaaacctggaccagcctcccagactcctcatttatcgttcactccaccgaggccactgatcgtcccaacagattcagtggcagacggtctgggaacagacttcagtctacacctatcagcagcgtacagtctaggaanacgttggcttaagtttattacgttagtactaacaatgtaggtcaggttggccgtacgtaacgttccgggacccagggaaccccagtaagtcggatacgttaccggaacgggaccgtaaacggttacggttcgggtaccttacgggaccctaaacccgttacgtttaccgtccggttaccctttaccg

SEQ ID NO: 91690 - DNA, 596 bp, Homo sapiens
  misc_feature: GYAE6OF02I64Q4.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaacaaaaacctggccagcctcccagacctcctcatttactcgttcactccaccagggccactgatcgtacccaaccagacttcgagtcggcaggagggtctagggacagacttcagtctaccgacactacgagcagcgtacagtcctagaacgtacttggactagtttacttactagttacaaactaattggtagtcgaggtcggtcccgtacggtaaccgttccggacccgtaaggggaccctaaccggagttacggacttacgtacggtaacgggtaccgtaacgttgggtcggtacgtcggtacctaacccgtagttccgttagttccttaaccg

SEQ ID NO: 91691 - DNA, 514 bp, Homo sapiens
  misc_feature: GYAE6OF02IV7RX.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (335)..(335): a, c, t, g, unknown or other
  misc_feature (335)..(335): n is a, c, g, or t
  modified_base (433)..(433): a, c, t, g, unknown or other
  misc_feature (433)..(433): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctctcctgccagggccagtcagaacnttggancaacttagcctggtaccaacaaaaacctggccagcctcccagactcctcatttatcgttcatccaccacgggccactgactcgtacccaaccngattcagtgcagaggtctgggacagacttcagtctcacatcagcagcgtacagtctgaagtacttggactagtttattactgtacaactatgtgtacngtcgcgtacgacgttcgccagggaccaacgagtacgatagtcgaggacgaactgtcgcgtgacctacctatcttcgcttcc

SEQ ID NO: 91692 - DNA, 518 bp, Homo sapiens
  misc_feature: GYAE6OF02IJX3K.5.57.F02.1.454.CMB.1.raw
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (355)..(355): a, c, t, g, unknown or other
  misc_feature (355)..(355): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (481)..(481): a, c, t, g, unknown or other
  misc_feature (481)..(481): n is a, c, g, or t
  modified_base (512)..(512): a, c, t, g, unknown or other
  misc_feature (512)..(512): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcaagaacnttggancaacttgcctggtaccaaacaaaaacctggaccagcctcccagactcctctatttatcgttcatccaccagggccactgatcgtcccaaccagattcagtggacagagggtcngggacagacttcagtctcaccatcagcagcgtacagtctagaagtacttggacctagttttaacttactgtcaaactatggtaggtctagtggacctcgaacgttcggcccaggacccaangnganatcgaaggcgaatgtgctgacctacatcgtntctacg

SEQ ID NO: 91693 - DNA, 683 bp, Homo sapiens
  misc_feature: GYAE6OF02JPOSG.5.57.F02.1.454.CMB.1.raw
  modified_base (281)..(281): a, c, t, g, unknown or other
  misc_feature (281)..(281): n is a, c, g, or t
tcagatcagacacgcacgaccggtgctcgatttagctcgatatagttgggtttgggggaggaactgctcagttaggacccagaccggaaccatggaagccccagcgcagcttctcttcctcctgctactctggctcccagataccgttgggagatcgtgatgacgcagtctccagccatcctgtctgtgtctccagggacgagagccaccctctcctgcacgggtaccgacgtacgacgaacgtagttacggtacgtacgtaactacgtccgtacgtaccnaaaccgtaaaaaccgtaaccggtaccgacgtacccgtacccgtaccgtaccgtaccgtaccgtacttaacgttacgttaccgtactaccctaccgtacggaccgtacgtacgtacgtacgtacccgtaacccgtaacgtacgttacgtacgtacggtacgacggacggtacgtacggtacgacgtacgtacgtacgtacgtacgtaccgtactacgacgacgacgacgtacgtacgtacgtacgtaacgtacgtacgtacgtacgttacgttacgttacgtacgtactaagtagtagtacgtacgtacgtccgtacgtacgtaccgtaccgtacgtaccgtacgtacgtacgtacgtacgtacgtacgtacgtacgtacgtacggtacgtacgtacgtaccg

SEQ ID NO: 91694 - DNA, 521 bp, Homo sapiens
  misc_feature: GYAE6OF02FTWGZ.5.57.F02.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (235)..(235): a, c, t, g, unknown or other
  misc_feature (235)..(235): n is a, c, g, or t
  modified_base (297)..(297): a, c, t, g, unknown or other
  misc_feature (297)..(297): n is a, c, g, or t
  modified_base (472)..(472): a, c, t, g, unknown or other
  misc_feature (472)..(472): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctntcctgcagggccagtcagaacnttggtagcaacttagcctggtaccaacaaaaacctggccagcctcccagactcctcatttancgttcatccaccagggccactgatcgtccccaacagattcagtggcagagggtctgggacagacttcagtctcaccatcagcagcgtacagtctgaagcttggctagtttattactgtacaacatgtagtcagtcggcctcgaacgttcgacccaggaccagacgtggacttacncgaggtaccgtaactggtcggctcggccaccgtatccgttgtcttaccg

SEQ ID NO: 91695 - DNA, 553 bp, Homo sapiens
  misc_feature: GYAE6OF02G5W6L.5.57.F02.1.454.CMB.1.raw
  modified_base (244)..(244): a, c, t, g, unknown or other
  misc_feature (244)..(244): n is a, c, g, or t
  modified_base (409)..(409): a, c, t, g, unknown or other
  misc_feature (409)..(409): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgcccaccctctcctgcagggccagtcagaacattggancaacttagcctggtaccaaacaaaaacctggcccagccctcccagacctccctacatttatccgttcactcccaccgagggcccactgatcgtacccaaccagattcagtggccaggagggtctgggacagacttcgagtctcaccatcagcagtcgtacagtcngaagcttggactagtttattacgtgtacaaactatgtggtcagtcggcctacgtaacgttccggcccgaagggaccacgagtacggatacgtccgagggtacgtaacgtggtcggcgtacgtcaacctagtcgttcgtcttacc

SEQ ID NO: 91696 - DNA, 787 bp, Homo sapiens
  misc_feature: GYAE6OF02J2WP5.5.57.F02.1.454.CMB.1.raw
  modified_base (151)..(151): a, c, t, g, unknown or other
  misc_feature (151)..(151): n is a, c, g, or t
  modified_base (201)..(201): a, c, t, g, unknown or other
  misc_feature (201)..(201): n is a, c, g, or t
  modified_base (259)..(259): a, c, t, g, unknown or other
  misc_feature (259)..(259): n is a, c, g, or t
  modified_base (736)..(736): a, c, t, g, unknown or other
  misc_feature (736)..(736): n is a, c, g, or t
tcagatcagacacgcacgaccggtgctcgatttagctcgatatagttgggtttgggggaggaactgctcagttaggacccagacggaaccatggaagccccagcgcagcttctctcctctgctactctggctcccagataccgttgggganatcgtgatgacgcagtctccagccatcctgtctgtcgtctccgagggganagacgcccaccctctcctgccgacgggccaggtacaacgtaacctagttacgggtacnctaaaccgttacggcccgttacggtaaacccaaaaccgtaaaaacccgttcgggacccctaaccggtcccctaccccgaaggtacccttaccccgttactaactttttaacgccggtttaaccaccttcccgaacccggtaccggggtaccccaacggttcgtaaccgttaccgtaaccccctaaaccgtaacggttaacttccgaaccggtccggtaccgtaacggggtacgggtttaccgacggggtaaaccctaggttaaacccttcggtaaacggttccctacccgtaaccgtacgtaccgtacgaacccgtagtaacccggttactacggtaacgtacggaaacgttcgttacggtactaacggtttaacttcgtacgtaacaactagttcggagtcgtagtccgtcgttaacgtaccggtccggaccgcggtaaccagtacgtcgtacgcgtacggacggtaccgtaacgnggttaaccgccgttacgaccaaccgttcgttaccgttactacccgtttacg

SEQ ID NO: 91697 - DNA, 779 bp, Homo sapiens
  misc_feature: GYAE6OF02HFHXC.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttggggaggaactgctcagttaggacccagacggaacccatggaagccccagcgcagcttctcttcctcctgctactctggctcccagataccgttggggagatcgtgatgacgcagtctccagccatcctgtctgtgtctccagggganagagccaccctctcctgcagggccagtccagaacattggtagcaacgttagccttaggtaacccaaacaaaaacctggaccagccctcccagacctcctcattttatccgttcactcccaccgacgggccctacgtcgactcggtaccccaaaccagtaactttccgacggttacggaccgaagggacggggttaccgtagggggaaccaaggtaccgtttacgaacggttacctacccaaaccctaacgtttccgaacggtacctaacgggccgttaaaccgacggttacctaggtaaacgtacgtttagggacctttaaggttttaactttaaccgttacgttaaccgaaaaccgttagtttacggtacgggtttaccaacgggtttccggggtacccgtttacggggttaaaaccccgggttttcccggggaacccccgttaaacgggggtaacccctaacggtaacggttagggacttaacggttaccggaacgggtaccgtaaacgttcgggttaacgggtccgttacggacccgtaaccgttaaccgttcccgtttacgttccgtttaaccg

SEQ ID NO: 91698 - DNA, 591 bp, Homo sapiens
  misc_feature: GYAE6OF02IB66S.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccggttggggagatcgtgatgacgcagtctccagccatcctgtctgtgtctccagggganagagccacctctcctgcagggccagtcagaacattggtagcaacttagccttaggtaccaaacaaaaaacctggaccacgcctacccaacgactcctcatttactcgttcactccaccacgggccactgactcgtacccaaccagacttcagtcggcaggacgggtcgtggacagacttcagtctacaccatcagcagcgtacagtctagaagacgttaggctaagttttacttacgttgtactaaactaagtcgtaggtcaaggttcgccttacgaacgtttccggaccgtaacggggaccacgtagtcggatagtccgaagggtccgtaaacgtcgggtaggtccgttaggaccctaacccggtacttacgttccggttaccttaccg

SEQ ID NO: 91699 - DNA, 758 bp, Homo sapiens
  misc_feature: GYAE6OF02IYTQH.5.57.F02.1.454.CMB.1.raw
  modified_base (153)..(153): a, c, t, g, unknown or other
  misc_feature (153)..(153): n is a, c, g, or t
  modified_base (171)..(171): a, c, t, g, unknown or other
  misc_feature (171)..(171): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtcnccagccatcctgtctgtcgtctccgagggganagacgcccacccttctcctgcgaacggggcccaggtaccaagaacctagtttcggggtaacgcctaaaccgtttacgcccgttacgggtaaacccaaaacgtaaaaacccgtggacccaacggacccctacccgaacgtacctacccttactaacttttaactccgtttaccacttacccgaacccgtacgggaccctacgtacggtaactacccgttaccccaaaccgtagtaacttaccgtacggtacggaccgtaacgggtacgggtacgttacggggaactaacggtaccttacgacgtcccttaccgacctacgtacgacgaccgaacgtacgtaactaggtctaacggaacgtaccgttaggacttaacgtttaataacttacggtaacaaaggtattacggtacggtactagggtaccgtcgtaccggtaaaccgttccgggtaaccgacgggtaaccaaccgtagggttacgtacgtaacgtcggtaaccgggaactacggtaggttcgacgttactaccggtactacgtaccttgtaccttaccgg

SEQ ID NO: 91700 - DNA, 575 bp, Homo sapiens
  misc_feature: GYAE6OF02IRYI8.5.57.F02.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccaccctctcctgcagggccagtcagaacattggtancaacttagcctggtaaccaaacaaaaacctggaccagccctcccagacctcctactatttatccgttacactcccaccgacgggccaactgactcgtacccaacagtacttcagtggcaggacgggtctagggacagtactcgagtctcacatacagcagcgtacgagtctagaagtcttggactagtttattactagtacaagtaagtgtagtctaggtcgccgtacgtaaccgttccggacccgtagggaccctaacgaggtacgtatacgtcgaacgggtaccgaacgtggtacggtctacgccaccgtagtccgttcgttcttacg

SEQ ID NO: 91701 - DNA, 664 bp, Homo sapiens
  misc_feature: GYAE6OF02H00VK.5.57.F02.1.454.CMB.1.raw
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (248)..(248): a, c, t, g, unknown or other
  misc_feature (248)..(248): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagataccgttggggagatcgtgatgacgcagtctccagccatcctgtctgtgtctccaggggganagagccctaccctctccngacacgggccagtcaagaacatttggganctaaattagcctggtaaccaaacaaaaacctggaccacgcctcccagacctcctcatttatcgttacactaccaccgtaggacctactgactacgtaccccaaacctagacttctaagtggcctaagacggggtctaggggacacgactttcgaacgttcaccgaccatcagcagcgtaacagtcagaacgtacgttaggctaaggttttacttacgtctactaaactaacgttagtacgggtttacgaggttaccgggcctacggaaacggtttccgacccgtacggggacctaaaccggtagaccggttaagtaacgtttaccggaacggtacccggtaagtacccgggttaggggtaccgttaccgtaccgggtaacctaaacccggtttcgtttaccggtaccgttttaccg

SEQ ID NO: 91702 - DNA, 498 bp, Homo sapiens
  misc_feature: GYAE6OF02I056P.5.57.F02.1.454.CMB.1.raw
  modified_base (357)..(357): a, c, t, g, unknown or other
  misc_feature (357)..(357): n is a, c, g, or t
  modified_base (437)..(437): a, c, t, g, unknown or other
  misc_feature (437)..(437): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
  modified_base (496)..(496): a, c, t, g, unknown or other
  misc_feature (496)..(496): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagccaccctctcctgcagggccagtcagaacattggagcaacttgcctggtaaccaacaaaaacctggccacgcctacccagactcctactatttatcgttcactccaccaggccactgatcgtacccaacagattcagtggcaggacggtcngggacagacttcagtctcacatcagcagcgtacagtctagaagtacttggactagtttattactgtacaatatgtgtacngtcgctgacgtcgaccaggccagngtagntatacgagcgactgtcgctgcacatctgtntc

SEQ ID NO: 91703 - DNA, 568 bp, Homo sapiens
  misc_feature: GYAE6OF02HG322.5.57.F02.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (235)..(235): a, c, t, g, unknown or other
  misc_feature (235)..(235): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttggggtaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccacctntcctgcagggccagtcagaacnttggtancaacttgcctggtaaccaaacaaaaacctggaccagcctacccagacctcctcatttatcgttcactccaccaggccactgatcgtacccaacagacttcagtcgcagagggtctagggacagaccttgacgtctcaccatcagcagcgtaacagtctagaagacttggactagttttactactgtacaaactattcggtgtacgaggttcgacccgtacgaacgtttcccggacccgaacgggaacccacgtagtacgtagtacgtacgtaacggcgtaacgtcggtaggactcggacctaccacgttacttcggttacttaccg

SEQ ID NO: 91704 - DNA, 694 bp, Homo sapiens
  misc_feature: GYAE6OF02IVBIV.5.57.F02.1.454.CMB.1.raw
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccacctctcctgcaggccagtcagaacnttggagcaactagcctggtaccaacaaaaacctgccagcctcccagactcctcagtttatcgttacatccaccaggcccatcgactcgtaccccaacagacttacagtcggctagacgggtctagggaacagtaacttcgagtactacgacctatccgagcgtaacgtcgttaacgagtacccttaggaaaacgtaccgtttacggacgttaacgttttaaacgttaccgttaacggttaccctaaaacttaaaacgtttcgggtaacgggttaaccgaaacgggtttcggttaccccgttaacgggtaaaccgttttcccggggtaaacccgtaaccgggggtaaacccaaacccggtaacgttaggtaaaccgttacgttaccgaaacgggtaccgtaaacggtaacctcggggtaaccttggacccgtaacccgaagtcctttacggtacctttaccg

SEQ ID NO: 91705 - DNA, 679 bp, Homo sapiens
  misc_feature: GYAE6OF02GH5Q4.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagcccaccctctcctgcagggccagtcagaacagttggagcaacttgcctggtaccaacaaaaacctggccagcctcccagactctcattatcgtcatccaccaggccactgactcgtacccaaccgagacttccgaagtcggaccaggacgggttcgtagggaaccaggtaacttcaacggttcctaccaacccgtataccaggtcctaagggtcccgtaactaggttaccgtaaggaaacgttaccgttagggaccgtaagtttttacgtaacttcgttaaccctaaacgtaaagttcgtacgggtttactaacggtcgggttacccgtacggtaaccggtttcggacccggtaacggaacccgtaaccgagttacggtaacgtacttaccgggaaggtaccgtaaacccgttaggtacggtacccgaggtacccaacccgttaacgtccggttaccgttccgtttaacccgg

SEQ ID NO: 91706 - DNA, 576 bp, Homo sapiens
  misc_feature: GYAE6OF02HPBR0.5.57.F02.1.454.CMB.1.raw
  modified_base (244)..(244): a, c, t, g, unknown or other
  misc_feature (244)..(244): n is a, c, g, or t
  modified_base (412)..(412): a, c, t, g, unknown or other
  misc_feature (412)..(412): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagcccaccctctcctgcagggccagtcagaacattggtancaaacttagcctaggtaaccaaacaaaaaccgtggaccacgccctcccggactcctctaatttactcgttcactccaccgacggccactgatcgtacccaacagtacttcgagtggacaggacgggtcgtagggacagtacttcacgtctacacactcagcagctacngtacagaacgtacgtacgcttaagtttatacttgtacaactaagtgtacggtactaggtcgtacctacgtaacggttccggaccgtacgggaaccacgaggtagactacgacgacggtacgaacgtggtcgtcgtgaccacgtacgttctcggttactctaccg

SEQ ID NO: 91707 - DNA, 600 bp, Homo sapiens
  misc_feature: GYAE6OF02IKYLZ.5.57.F02.1.454.CMB.1.raw
  modified_base (183)..(183): a, c, t, g, unknown or other
  misc_feature (183)..(183): n is a, c, g, or t
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (301)..(301): a, c, t, g, unknown or other
  misc_feature (301)..(301): n is a, c, g, or t
  modified_base (402)..(402): a, c, t, g, unknown or other
  misc_feature (402)..(402): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctccagataccgttgggagatcgtgatgacgcagtctccagccatcctgtcngtgtctccagggganagagcccacctntcctgcaggccagtcagaacnttggancaacttnctgtacaacaaaactgcagcctaccagactcctactattactcgtacactccaaccnggacctactagactcgtacccaacagtacttaccagtacgctaaggcggtcgtacggggacaggtacttcgagtactcaaccgatcgacgacagcgtaacngtacgtagaacgtacttcgggacttacgtttactacgttagtaacctaacgtaagttggtacggtttacgaacggttccggtccttaacggtaaaccggtttccgtaaccgtacgggtaccgaaccgtacggtagacgtactacggaggtacgtacgtacggttgtaccgtcgaccgacctaggtcttcgtattaccg

SEQ ID NO: 91708 - DNA, 569 bp, Homo sapiens
  misc_feature: GYAE6OF02IZIPA.5.57.F02.1.454.CMB.1.raw
  modified_base (153)..(153): a, c, t, g, unknown or other
  misc_feature (153)..(153): n is a, c, g, or t
  modified_base (200)..(200): a, c, t, g, unknown or other
  misc_feature (200)..(200): n is a, c, g, or t
  modified_base (204)..(204): a, c, t, g, unknown or other
  misc_feature (204)..(204): n is a, c, g, or t
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
  modified_base (341)..(341): a, c, t, g, unknown or other
  misc_feature (341)..(341): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctcagggganaganccaccctntcctgcagggccagtcagaacattggancaacttagcctggtaccaacaaaaacctggaccagcctcccagactcctcatttactcgttcatcccaccagggccaactgactgtacccaaccagacttnagtggaccaggtagggtctgggacacgacttcagtctcaccgatcaagcagtcgtacagtctgaaagcttggcagtttatactagtctaacaatgtggtacaggttcgacctcggaaacgttcggacccgtagggaccctaacgacgtacggtatacgttaccgaaggtaccgtaacgtcggtacggaccgttgaccggtaccctaagtccttggttcgtttaacccg

SEQ ID NO: 91709 - DNA, 680 bp, Homo sapiens
  misc_feature: GYAE6OF02JVEWL.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcccacccgtctccgtgcgacggggccagtcaggaactattggtagcaacttagcctggtaaccaacaaaacctggaccagcctccagacctcctcatttactcgttcatccacacggccacgtgactcgtacccaacacgacttacaggtacggtacaggtacgggtactaggggaactagtacctttacacgttacctaccgtaccctattacacgtccgaacgcgttaaaccagtctaggaacgtacttacgggtactaaggttttacttactacgttaaccaagttaaacgtcggtttacggtacgtaacggtggtacccgttaacggaaccgtttccggtaacccgtaacgggacccgtaacgtacgggttaacggacgttaacgtaccggtaacgggtaagttaaccggtaggtaccgggtcgtacgttacccggtaaccgtacctttacggttccgtacctttaaccgg

SEQ ID NO: 91710 - DNA, 783 bp, Homo sapiens
  misc_feature: GYAE6OF02G3BW8.5.57.F02.1.454.CMB.1.raw
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgccaccctctcctgcacgggccagtcagaactagttggtagcaacttagcctaggtaaccaaacaaaaacctggaccacgcctacccagacctcctctatttactcgttacactccaccgacgggccacgtgactcgtacccaaaccgtagtacttccgaggtcggtaccgaaggtacggggttacgtacgggggaactaacggtacctttacggtaacgtttcctacccgaacccgtacttaccgacgtaccgaacggtaccgtaaccgtaaggttaccgtaaggtaaaacggttaccgtttacgggacctttaacggtttttaacgtttaaccgttacggttaaccctaaacgtaaacgtttcgggttacgggtttacgtaacggggttaccggtaccccgttaaccggggttaacccgggttacccgggaccccggttaaacccgggggtaccctaaaccggtagggttaccgggtacttaacggtaccggtaacgggtaccggtaaccggttcggtacggtccgttacggtaccctaaccgtacgttaccgttccggttacctttaacccgg

SEQ ID NO: 91711 - DNA, 706 bp, Homo sapiens
  misc_feature: GYAE6OF02FENO5.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (255)..(255): a, c, t, g, unknown or other
  misc_feature (255)..(255): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganacgacgccaccctctcccgtagccagggcccaggtccagaactattgggtacnctaaacgttcgcctaggtaacccaaactaaaaacccgtggacccacgcccctacccacgtaccttccctactacttttaactccgttccaacttaccccgaaccgacgggcctacgtcgtactacgttaccccaaaccgtagtacttcgaaggttcggacgagggtacgggtcgtacggggaactacggtaccttacgacgttacctaccaacctaatcgaacgtaccgtaagccgtaaccaacggttccgtaaggaaacgtacgtttacggacttaagttttaacttactcgttacaaacgtagttcggttacggtacgtaggtacggtacccgttacggtaaccggtttccggacccgaacgggtaccgaacgtaggtacgtagtacgtacgacggtacgtaaccggtcggtcggtactcgtaccgaacctagtccgtagttccttacc

SEQ ID NO: 91712 - DNA, 644 bp, Homo sapiens
  misc_feature: GYAE6OF02JZCV6.5.57.F02.1.454.CMB.1.raw
  modified_base (457)..(457): a, c, t, g, unknown or other
  misc_feature (457)..(457): n is a, c, g, or t
  modified_base (587)..(587): a, c, t, g, unknown or other
  misc_feature (587)..(587): n is a, c, g, or t
  modified_base (628)..(628): a, c, t, g, unknown or other
  misc_feature (628)..(628): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgaggggagagacgccaccctctcctgcgacgggccagtcaagaacctagttggtaacgctaacgttacgccgtaggtaacccaaaccaaaaaccgtcggacccacggcccctacccgaagtaccctcctacctattttactccgttaccactacccaccgacgggaccctacgtacgactaccgtacccaaccagtacttacgtaggtcgacgaggtaggtccgtagggacagtacttacacgtctaccactatacgagacncgtactacgagtcagtaacgtcgtcggacttagttaacttacgtacgtaacaacgtagttcggttaggactacggtcgaccgttacggtaaccgtccgggaaccgtacggaaccgacgtacgtacggtanacgtacgacgggtcgtacgtagggtcgctacgtaccacgtntaccgtgttccttacg

SEQ ID NO: 91713 - DNA, 495 bp, Homo sapiens
  misc_feature: GYAE6OF02JMBLC.5.57.F02.1.454.CMB.1.raw
  modified_base (381)..(381): a, c, t, g, unknown or other
  misc_feature (381)..(381): n is a, c, g, or t
  modified_base (424)..(424): a, c, t, g, unknown or other
  misc_feature (424)..(424): n is a, c, g, or t
  modified_base (451)..(451): a, c, t, g, unknown or other
  misc_feature (451)..(451): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttagcctggtaccaacaaaaacctggccagcctcccagactcctcatttatcgttcatccaccaggccactgactgtcccaacagattcagtgcagaggtctggacagacttcagtctcaccatcagcagcgtacngtctgaagtcttggactagtttatactgtacaataatgtgtcngtcgcctacgacgtcgccgaggaccanagtgatagcgaggacaacgtgtcgtactcgcacatcgtactctc

SEQ ID NO: 91714 - DNA, 581 bp, Homo sapiens
  misc_feature: GYAE6OF02HLH2G.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (367)..(367): a, c, t, g, unknown or other
  misc_feature (367)..(367): n is a, c, g, or t
  modified_base (402)..(402): a, c, t, g, unknown or other
  misc_feature (402)..(402): n is a, c, g, or t
  modified_base (464)..(464): a, c, t, g, unknown or other
  misc_feature (464)..(464): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagacgcccaccctctcctgcagggccagtcaagaacnttggancaaacttgcctggtaaccaaacaaaaacctggccaagccctccagacctcctctatttatcgttacatcccaccgtaggccactgactcgtacccaacagtattccaggtcgcagacgggtcngggacagaccttgagtctcacatcagcagcgtacngtctaggaacgtacttgggacttagttttaactacttgtaacctaaataagttgtacggtanaggttcggaccctacggtaaccgttcggacccgaaggaccacgtagcgtattacgcggtaacggcgtaacgttaggtcggtactacgacccgaactagtcccgttgttaccttaccg

SEQ ID NO: 91715 - DNA, 595 bp, Homo sapiens
  misc_feature: GYAE6OF02ISH8O.5.57.F02.1.454.CMB.1.raw
  modified_base (201)..(201): a, c, t, g, unknown or other
  misc_feature (201)..(201): n is a, c, g, or t
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagataccgttggggagatcgtgatgacgcagtctccagccatcctgtctgtgtctccgagggganagacgcccaccctcggtctgcagggccagtcaagacattggancaaacttgcctaggtaaccaaacaaaactggccagcctccacgactcctactatttactcgttacactccaccacggccacgtgactcgtacccaactgtacttacagtcgacgtagaggtcgtggacagtcttacacgtctacacactacgagcacgtacgtacacggttacagaaacgtacgttggaccttagtttactacgtacgtaacaaacgtaagttgtacgttacaggtcgtacccgtacggtaaccgttcgaacccgtacgggtaccaacgtcggtacgacgttactacggaacggaccgttagtacgtcggtactcgacaccgtagtccgttagcctttacg

SEQ ID NO: 91716 - DNA, 595 bp, Homo sapiens
  misc_feature: GYAE6OF02HPNRC.5.57.F02.1.454.CMB.1.raw
  modified_base (244)..(244): a, c, t, g, unknown or other
  misc_feature (244)..(244): n is a, c, g, or t
  modified_base (474)..(474): a, c, t, g, unknown or other
  misc_feature (474)..(474): n is a, c, g, or t
  modified_base (485)..(485): a, c, t, g, unknown or other
  misc_feature (485)..(485): n is a, c, g, or t
tcagatcagacacgcacgaccggtgctcgatttagctcgatatagttgggtttggggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagcccaccctctcctgcagggccagtcagaacattggancaacttagcctaggtaaccaaacaaaaacctggccacgccctcccagacctcctctatttactcgttcactccaccgagggccactgactcgtacccaacctagacttcaggtggcaggaggggttctggggaactaggtacttcgagttcctacaaccctatccgacgcaacggtcgtaactcggtactaggaacgtacgttggacttagtttattacttgtactaaanagttgtggtancggttcggccgtacgtaccggtccggacccgacgggaccaacgtaggtggtactgtacggacggtaccgtaacgtggtacggctacgccaccgtactcttagtccgttac

SEQ ID NO: 91717 - DNA, 586 bp, Homo sapiens
  misc_feature: GYAE6OF02HXQUY.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (362)..(362): a, c, t, g, unknown or other
  misc_feature (362)..(362): n is a, c, g, or t
  modified_base (383)..(383): a, c, t, g, unknown or other
  misc_feature (383)..(383): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagccaccctctcctgcagggccagtcagaacnttggancaacttagcctggtaccaaacaaaaacctggaccagcctcccagactcctcatttatcgttcatccacaggccactgactcgtccaacagacttcagtgcagaggtctgggacagacttnagtctcacatcagcagctacngtactgaagtacttggctaagtttattactcgtacaaactaattggtaggtacagtcggacctacgtaacgttcggacccctaaggggacccaacgtacggtagggtactacgttaccgaacgggtaccggaaacgttcgggtacggtaccgttacggacccgttaaccgtaaccgtttaccgtttcgtacccgttttacccg

SEQ ID NO: 91718 - DNA, 566 bp, Homo sapiens
  misc_feature: GYAE6OF02GIBRF.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagccaccctctcctgcagggccagtcagaacattggtagcaacttagcctggtaccaacaaaaacctggccagcctcccagactcctcatttatcgttcatccaccagggccactgactcgtacccaaccagattcgagtcggcaggagggtctagggacagtacttcgagtctacaccatcagcagccgtacagtctagaagtcttggctagtttacttactgtacaactatgtggtacaggtcggcctacggtaacggttccgggacccaagggtacccacgtagtggactacgtacgaacgggacgtaacgtgggttacggacgtacgaccgacccgttattccgttggttccttaccg

SEQ ID NO: 91719 - DNA, 611 bp, Homo sapiens
  misc_feature: GYAE6OF02JIQEZ.5.57.F02.1.454.CMB.1.raw
  modified_base (204)..(204): a, c, t, g, unknown or other
  misc_feature (204)..(204): n is a, c, g, or t
  modified_base (219)..(219): a, c, t, g, unknown or other
  misc_feature (219)..(219): n is a, c, g, or t
  modified_base (245)..(245): a, c, t, g, unknown or other
  misc_feature (245)..(245): n is a, c, g, or t
  modified_base (342)..(342): a, c, t, g, unknown or other
  misc_feature (342)..(342): n is a, c, g, or t
  modified_base (588)..(588): a, c, t, g, unknown or other
  misc_feature (588)..(588): n is a, c, g, or t
  modified_base (605)..(605): a, c, t, g, unknown or other
  misc_feature (605)..(605): n is a, c, g, or t
tcagatcagacacgcacgaccggtgctcgatttagctcgatatagttgggtttgggggtagggaacgtgctcagttaggacccagacggaaccatggaagccccagcgcagcttctcttcctcctgctactctggctcccagataccgttggggagatcgtgatgacgcagtctccagccatcctgtctgtgtctccagggganaggagccacccttcncctgcagggccagtcagacattggancaacttagcctaggtaccaacaaaaacctggaccagcctacccagacctcctcactttatcgttcatccaccacggccactgatcgtacccaaaccncgtattcacggtcggcaggtacgggtcaggggtacaacggtacttacgagttacctaccgaaccctagtaccacggctaacggcgtacaagtctagaaacgtacgttggaccgtaggttttaacttactcggttaacaactaagtttgtacggttacgagttcggacctacgggtaacgttccggacccgacggaccaacgacgtggtactagcgaggtaccgtaagtcggacggtacgtgaaccnctaacggttctacgttnttaccg

SEQ ID NO: 91720 - DNA, 535 bp, Homo sapiens
  misc_feature: GYAE6OF02FLMLQ.5.57.F02.1.454.CMB.1.raw
  modified_base (433)..(433): a, c, t, g, unknown or other
  misc_feature (433)..(433): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggaccagcctcccagactcctcatttatcgtcactccaccagggccactgatcgtacccaaccagtattcaggtggcaggagggtctagggacagtacttcgagtctcaccatcagcagcgtacagtctagaagtacgttggctagtttattacgtgtacaanaatgtggtcaggtcgctacgtacgttcggaccgaggaccagacgtggatacgtacgacggacgtaacgtggtcggctcggacaccgtatcgtcgtcttaccg

SEQ ID NO: 91721 - DNA, 660 bp, Homo sapiens
  misc_feature: GYAE6OF02GYQN3.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgcagggccagtcagaacnttggancaacttgcctggtaccaacaaaaacctggccagccctcccagacctcctctatttatcgttcactcccgaccacgggcccactgactcgtccccaaaccagacttcaggttggcaggtagggtcgtagggacaggtacttcgagttcctacacctatacagcacgccgtacaggtctagtaaacgtacgttggacttaaggttttacttacgttgtaaccaaacgtaagttcggtacggtacgtaaggttcggacccgtttaccggtaaccgggtttccggaccccgtaaggggtacccctaacgtagggtacggtaacttacgtaccgggaacgggtaacccggtaacgtttcgggtacgggtcctaccggtaccgtaaccccgttaacgttccgtttaccggttcctttacccgg

SEQ ID NO: 91722 - DNA, 550 bp, Homo sapiens
  misc_feature: GYAE6OF02I7GB2.5.57.F02.1.454.CMB.1.raw
  modified_base (154)..(154): a, c, t, g, unknown or other
  misc_feature (154)..(154): n is a, c, g, or t
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
tcagatcagacacgcacgaccggtgctcgatttagctcgatataggttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcccaccctctcctgcagggccagtcagaacattggancaacttagcctggtaccaacaaaaacctggaccagccctacccagacctcctctatttatcgttcactccaccagggccactgatcgtaccccaaccagtacttcaggtcggcaggacgggtctgggacagtacttcagtctcacatcagcagcgtacagtctagaacgtacttggctagtttattactgtacaactaatgtggtcaggtcggtacctacggtacggttccggcccgaagggaccacgaggtagacgtagtcgaggtaccgaagtggacgtcgacgccacgattctcgttcttaccg

SEQ ID NO: 91723 - DNA, 497 bp, Homo sapiens
  misc_feature: GYAE6OF02GJ8PI.5.57.F02.1.454.CMB.1.raw
  modified_base (360)..(360): a, c, t, g, unknown or other
  misc_feature (360)..(360): n is a, c, g, or t
  modified_base (388)..(388): a, c, t, g, unknown or other
  misc_feature (388)..(388): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
  modified_base (455)..(455): a, c, t, g, unknown or other
  misc_feature (455)..(455): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaaacaaaaacctggccagcctcccagactcctcatttatcgttcatccaccagggccactgatcgtacccaaccagattcagtggcagagggtctgggacngacttcagtctcacatcagcagcgtacngtctagaagacttggctagtttattactgtacaanatgtgtnagtgctgacgttcggccaggacacngtgatactcgaggcaagtcgtgctcgcaccagtctgtcttac

SEQ ID NO: 91724 - DNA, 559 bp, Homo sapiens
  misc_feature: GYAE6OF02JEWFH.5.57.F02.1.454.CMB.1.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
  modified_base (300)..(300): a, c, t, g, unknown or other
  misc_feature (300)..(300): n is a, c, g, or t
  modified_base (447)..(447): a, c, t, g, unknown or other
  misc_feature (447)..(447): n is a, c, g, or t
  modified_base (501)..(501): a, c, t, g, unknown or other
  misc_feature (501)..(501): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagccaccctntccngcagggccagtcagaacattggaagcaacttagcctaggtaaccaacaaaaacctggaccagcctccagactcctcatttancgttcactccaccgaggccactgatcgtaccaacagtacttcagtcgacaggaggtctgggacagtacttcagtctacgacctatcgagcaacgcgtaacagtctaggaacgtcgtaggacttagttattacgtattacaactagtntacggtctagcgtaccagtaacgttcggacccagggaaaccacgtagacgattnaccggtacggacgtacgtcggtaggcctacgacaccgttaacgccttgtacttaccgg

SEQ ID NO: 91725 - DNA, 521 bp, Homo sapiens
  misc_feature: GYAE6OF02HFHRH.5.57.F02.1.454.CMB.1.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctctcctgcagggccagtcagaacattgganctaacttgcctggtaccaacaaaaaacctggccagcctcccagactcctcatttatcgttcatccaccagggccactgatcgtcccaaccagattcagtcggcagagggtctgggacagacttcagtctcacatcagcagcgtanagtcngaancttggctagtttattactgtacaataatgtgtcagtgcctcgaacgttcggcccgagggaccacgtagtaggatatcgaaggaccggtaacgtcggtggctggccaccgtatcgtgtcttaccg

SEQ ID NO: 91726 - DNA, 545 bp, Homo sapiens
  misc_feature: GYAE6OF02GK62X.5.57.F02.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (241)..(241): a, c, t, g, unknown or other
  misc_feature (241)..(241): n is a, c, g, or t
  modified_base (394)..(394): a, c, t, g, unknown or other
  misc_feature (394)..(394): n is a, c, g, or t
  modified_base (453)..(453): a, c, t, g, unknown or other
  misc_feature (453)..(453): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccacctntcctgcagggccagtcagaacattggtancaacttgcctggtaacccaaacaaaaacctggaccaagccctcccagaccttcctctatttactcgttcactccaccgacgggccatgatcgtaccccaaaccagtactttcgagttcggactaggagggttcagggacaggtacttcagtcncacatcagcagctacagtcagaatacttggctagtttactactgtacaatatgtggtangtgacctacggaacgttccggacccagggacccaagtcggtcgatactcgaaggtaccgaacgttggcgctacgccactatcgttctcttac

SEQ ID NO: 91727 - DNA, 711 bp, Homo sapiens
  misc_feature: GYAE6OF02FL9FQ.5.57.F02.1.454.CMB.1.raw
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagtataccgttggggagatcgtgatgacgcagtctccagccatcctgtctgtgtctccgaggggganagacgcccaccctctccctgccagggcccaggtcaagaacagtttggagcaacttagcctggtaaccaaacaaaaacctggccagcctcccagacctcctcattttatcgttacatccaccgagggccactgatcgtacccaacagacttcaagttcggactaggacggggttcctaggggacctaagggtacctttacgagttccctaccgaaccctaagttccgaacggtaccaacggtaccggttaacaacggttcgtacggaaaacggtaccgttagggaccgttaaggtttttaactttaaccgtcgttaaccgtaaaacctaagtttgtagggttacctaaggggttcgggtaccccttacgggtaacccggttccggggaacccgaaccgggggtaacccacggtaacgggtacggtacttacggtccgaacggggtacgtaaaccgttggtacggtccgtaccggaccgtaacccgtactccgttcgttactttacccg

SEQ ID NO: 91728 - DNA, 544 bp, Homo sapiens
  misc_feature: GYAE6OF02HO3QG.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (384)..(384): a, c, t, g, unknown or other
  misc_feature (384)..(384): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctggtacaacaaaaacctggaccagcctcccagactcctcatttatcgttcatccacaggccactgatgtccaaccagattcagtgcagagggtctgggacagacttcagtctcaccatcagcagctacagtcngaagtacttggacagtttaattacttcgtactaactaaagttgtaggttcaggttgccgtaacgtacggttccggcccgaagggacccaacgaggtcggtagtactacggaggtaccgtaacgtggtcggacttaggacaccctagtcctgtctttaccg

SEQ ID NO: 91729 - DNA, 514 bp, Homo sapiens
  misc_feature: GYAE6OF02FPGZX.5.57.F02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccggggganagagcccaccctctcctgcagggccagtcagaacattggancaacttagcctggtaccaacaaaaacctggccagcctcccagactcctcatttatcgttcatccaccaggcccactgatcgtcccaaccagattcagtggcagagggtctgggacagacttcagtctcaccatcagcagcgtacagtcagaagcttggctagtttatactgtacaacatgtgtcagtggacctcgaacgttcgccgagggaccacgagtgatactcgaggtcgaactggtcggctcggcaccgtatcgtgttccttgtaccg

SEQ ID NO: 91730 - DNA, 636 bp, Homo sapiens
  misc_feature: GYAE6OF02IGE03.5.57.F02.1.454.CMB.1.raw
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggganagacgccaccctctcctgcagggccagtcagaacattggtanctaacttagcctggtaaccaacaaaaacctggaccagcctcccagacttcctctatttactcgttcattccaccacgggaccactgtactcgtacccaaaccagtacttaccaggtggaccgtaggaacgggtctgggaacaggtaacttcgaagttctacgacctatccagtcagtacgtacagtctaggaaagtcgttcggacttaagttttaactcgttacgtacaaacgttagtgttacggtcaacggttcggacccttacgtaaccggttccgggacccaggggtaacccacgtaacggtgaactacgtcggtaacggtaccggtaacgtcggtacggtaccttcggtaccctaaccgtagtccgtttacggtaccctttacccg

SEQ ID NO: 91731 - DNA, 580 bp, Homo sapiens
  misc_feature: GYAE6OF02ILC3K.5.57.F02.1.454.CMB.1.raw
  modified_base (201)..(201): a, c, t, g, unknown or other
  misc_feature (201)..(201): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagacgcccaccctctcctgcagggccagtcagaacattggancaacttgcctggtaaccaaacaaaaacctggaccagccctcccagacctcctctaatttatcgttacactccaccgaggccactgactcgtacccaaccagtacttcagtgacaggtacgggtctagggaacagtacttcgagtctacgaccatcagcgagaccgtacagtcagtaaagtcgttggactagttttattactgtaacaataagtggtagtctaggtcgaccttagaaccgttcggacccgtaagggaaccacgtaggtagactacgtcgaacgggtacgtaacggttggcggtacttacgaccgtaacctacgttcttcgtccttacc

SEQ ID NO: 91732 - DNA, 584 bp, Homo sapiens
  misc_feature: GYAE6OF02GIAKC.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctntcctgcagggccagtcagaacattggancaacttgcctggtaccaacaaaaacctggccagcctcccagacctcctcatttactcgttcactccaccagggccacgtgatcgtacccaacagattcagtcgcagagggtctgggacagtacttcagtctcaccatcagcagcgtacagtctagaacgtacgttggactagtttattacgtgtacaaactaatggtaggtctaggtcggtacccgttacggtaaccggtttccggacccgtaaggggaccctaagtacggttagggaacttacgtaccgaacgggtaccgtaaacgtggtacggtctacggcctaacctagttccttacggttctttacccg

SEQ ID NO: 91733 - DNA, 519 bp, Homo sapiens
  misc_feature: GYAE6OF02GK8PJ.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcctaccctctcctgcagggccagtcagaacattggancaacttgcctggtaccaacaaaaacctggaccagcctcccagactcctcattatcgttcatccacaggccactgatcgtcccaacagtattcagtcgacagaggtctgggacagactcagtctcacatcagcagcgtacagtctagaagtactggctagtttatactgtacaactatgtgtctagtcgacctcgtaacgttccggacccgaggaccacgagtcgatacgtcgacggacaacgtggtacgcgtcgtacgacctatcgtgtacttaccg

SEQ ID NO: 91734 - DNA, 655 bp, Homo sapiens
  misc_feature: GYAE6OF02F4L6V.5.57.F02.1.454.CMB.1.raw
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
  modified_base (305)..(305): a, c, t, g, unknown or other
  misc_feature (305)..(305): n is a, c, g, or t
  modified_base (368)..(368): a, c, t, g, unknown or other
  misc_feature (368)..(368): n is a, c, g, or t
  modified_base (398)..(398): a, c, t, g, unknown or other
  misc_feature (398)..(398): n is a, c, g, or t
  modified_base (407)..(407): a, c, t, g, unknown or other
  misc_feature (407)..(407): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagccaccctctcctgcagggccagtcagaacattggancaacttagcctggtaccaaacaaaaaccctggaccagccctcccagacctcctctatttaacncgttcatccaccacgggccacttgactcgtcccaaccagtattcaggtggacaggacgggtcngggacagtacttcgagtcctacaccatcancagcgtacngtcaggaagtacgttggacttagtttacttactgtaccaaacgtaattcggtacggtacgtaacggttcgacccgttacggtaaaccgggtttcccggacccgggtaacgggtaacccaaacggtacgggtacggtaactttaacggtccggaaacggggtacccgtaaaacggttggggttaccggtaccgtacgggtacccgtaaccttacggtttacccgttaccgggttacccctttaacccgg

SEQ ID NO: 91735 - DNA, 707 bp, Homo sapiens
  misc_feature: GYAE6OF02IZNBN.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcccaccctctcctgccagggccagtcagaacnttggtancaattgctaggtaaccaacaaaacctgaccagccctccagcctcctctatttactcgttacacttcccaccgaggcccactgactccgtacccaactacgtattaccgaggttcggctagggacgggtccgtggggaccaaggtaccttacgacgttacctaccgacctaacgtccgaagtaccacggtacgtaacgaggttactacggtaagtaccgttacggtaccgttagttttaacttacgtagttaaccaaacgttaagttcggttaggtacgtagggttaccggtacccgttaccggaaacggtttccccgggaaccccgtaaacggggtacccgaaccggtaacggttacgggtacgttacgtacccgggtaacgggttaccggtaaaccggttcgggttacggtaccgttaccggacctaacccggttactaccggtttacgttacccttaaccg

SEQ ID NO: 91736 - DNA, 465 bp, Homo sapiens
  misc_feature: GYAE6OF02FNNS9.5.57.F02.1.454.CMB.1.raw
  modified_base (448)..(448): a, c, t, g, unknown or other
  misc_feature (448)..(448): n is a, c, g, or t
  modified_base (450)..(465): a, c, t, g, unknown or other
  misc_feature (450)..(465): n is a, c, g, or t
tcagatcagacacgcacgaccggtgctcgatttagctcgatatagttgggtttggggggaagaggaagactgacggtccccccaggagtccagagtgcgtcgcaagtattggcagtgtgaaatttgacaccttatatgcagactctgtgaggggccgcttcaccgtgtccagagacaactccaagaacgccgtctatttgcagatggacagcctgagagtcgacgacacgggcatctattattgtacggcggccgagcaatactctcttactttctggagtcagggagtcccggtcactgtctcctcagcctccaccagggcccatcggtcttccccctggccaccctcctccaagacgcacctcgtggggcacagccgccctgggctgcctggtcaacggactacgttcccgtgtctgatctgagcggctggcgaaggcgcagtagnannnnnnnnnnnnnnnn

SEQ ID NO: 91737 - DNA, 573 bp, Homo sapiens
  misc_feature: GYAE6OF02HMN6T.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagccaccctctcctgcagggccagtcagaacattggtagcaacttagcctggtaaccaacaaaaacctggccagccctcccagactcctcatttactcgttcactccaccgaggccactgactcgtacccaacgagtacttcagtcgcgaggacggtcgtgggacagtacttcagtctacaccatcagcagtcgtacgagtctagaatacgttggacttagtttacgttacgtgtacaaactaagtgtacgtctaggtcgtaccgtacgtaaccgttccggacccgagggacccacgtagtaggtagtacgtacggaggtaccgaacgttggcggtacgtcgactaccgtattccgttcgtccttaccg

SEQ ID NO: 91738 - DNA, 554 bp, Homo sapiens
  misc_feature: GYAE6OF02G0BAO.5.57.F02.1.454.CMB.1.raw
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagcccaccctctcctgcacgggccagtcagaacnttggancaacttgcctggtaccaacaaaaaaccctggcccagccctccccagacctcctctatttatcgttcattcccaccacgggccactgactcgtaccccaaccagacttcgagtggcaggacgggtctgggacaggacttcagtcctcaccatcgagcagcgtacacggtctaggaaagtacgttggacctagtttaacttactgttacaacgtatgtaggtcaggttcggccttacgtaaccgttccggaccgtacgggaccacgagttgactagtcgaggacgacgtgtggctcgcaccatctgtctccg

SEQ ID NO: 91739 - DNA, 563 bp, Homo sapiens
  misc_feature: GYAE6OF02H7A2Q.5.57.F02.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctntcctgcagggccagtcagaacnttggancaacttagcctggtaccaaacaaaaacctggaccagcctcccagactcctacatttactcgttacatccaccagggccactgatcgtcccaacagattcagtggacagagggtctagggacagacttcagtctcaccatcagcagcgtacagtctagaagacttggactagttttaattacgtagtacaaataatggtagtcaagttcgcctacgtaacgttcggaccctaacgggaccaacgtagtacggtatacgtacgaaggaccgaacgttaggtcggaccgtacggaccaacccgtattaccgttcgtaccttaccg

SEQ ID NO: 91740 - DNA, 510 bp, Homo sapiens
  misc_feature: GYAE6OF02IZI0U.5.57.F02.1.454.CMB.1.raw
  modified_base (483)..(483): a, c, t, g, unknown or other
  misc_feature (483)..(483): n is a, c, g, or t
  modified_base (485)..(510): a, c, t, g, unknown or other
  misc_feature (485)..(510): n is a, c, g, or t
tcagatcagacacgcacgaccggtgctcgatttagctcgatatagttgggtttgggggaagaggaagactgacggtccccccaggagtccagagtgcgtcgcaagtattggcagtgtgaaatttgacaccttatatgcagactctgtgaggggcccgcttcacccgtgtccagagacaactccaagaaccgccgtctatttgcagatggacagcctgagagtcgacgacacgggcaagtcattatgtaacgcgccgagcaatactctcttacttttctgagtcaggagtccggtcactgtctcctcagcctccaccaacgggtcccaatccggtcttccccctggccacccgtcctccaacgaacgcaccctctcggggacaccgacgccgaccctgggcctcgccctgggtaccaaacggtactaccgttccccgtagtcctgacttctgacgtcgggcttggcgaacggcgccgatacggngnnnnnnnnnnnnnnnnnnnnnnnnnn

SEQ ID NO: 91741 - DNA, 580 bp, Homo sapiens
  misc_feature: GYAE6OF02HSGU0.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctaggtaaccaaacaaaaacctggaccagccctcccagacctcctctatttatcgttcatccacacgggccacgtgatcgtacccaacagattcagtggcaggagggtctgggacagacttcgagtcacaccatcagcgagtcgtacagtctagaagtacgttggacttaagttttacttaacttgtactaaactagttggtgtacgagtcggtacctacggtaacggttccggacccgtaacgggacccaaggtacgtaggacttacgtacgacgggtaccgtaaacgtggtacggcgtacgaccgtaccgtattccgtcgttccttac

SEQ ID NO: 91742 - DNA, 653 bp, Homo sapiens
  misc_feature: GYAE6OF02H23BS.5.57.F02.1.454.CMB.1.raw
  modified_base (370)..(370): a, c, t, g, unknown or other
  misc_feature (370)..(370): n is a, c, g, or t
  modified_base (394)..(394): a, c, t, g, unknown or other
  misc_feature (394)..(394): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttgcctaggtaccaaacaaaaaccctggaccacgccctcccagaccttcctctatttactcgttacactccaccgaggacccactgactcgacccaaccgagacttcaggtgcgaggtagggtcngggacagtactcacgtctccactntacagcaacgtcgtacacgtactagtaacgtacgttggactttagttttaattaccttacgtaactaaacgtaagttcggtacgtacgtacggtcggtacccgttaccggtaaccggttcccgggaccccggtaaggggaaaccctaccggtacggttacggaacttaccgtccggtaacggggtaccgtaaacggttcgggtacggtaccgtacggtacccctaagttacccgtttcgttaccggtttcctttacccg

SEQ ID NO: 91743 - DNA, 629 bp, Homo sapiens
  misc_feature: GYAE6OF02IZNVR.5.57.F02.1.454.CMB.1.raw
  modified_base (153)..(153): a, c, t, g, unknown or other
  misc_feature (153)..(153): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccaggggagagagccaccctctcctgcagggccagtcagaacattggancaacttgcctggtaccaacaaaacctggaccacgcctacccagacctcctctatttatcgttcacttccaccgacgggccacgtcgactcgtacccaaccagtacttcgagtggcagggacggttcgtagggacaggtacttcgacgttcctcacctactaccagacacggtaccgtacacgtacgtagaaacgtacgttaggctagttttacttactgttacaataagtcgtggtacgaggttcggaccttacggtaaccgttccgggaaccgtacgggaaccctaacgtaggtacggtacgtactaccggtaacgggtaccgtaacgtcgggttacggacccgttaggacctaacccgtcgtttacgttccggttcgtttaacccg

SEQ ID NO: 91744 - DNA, 542 bp, Homo sapiens
  misc_feature: GYAE6OF02G1S26.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
  modified_base (370)..(370): a, c, t, g, unknown or other
  misc_feature (370)..(370): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagccaccctctcctgcagggccagtcagaacattggancaacttagcctggtaaccaacaaaaacctggaccagcctcccagactcctcatttatcgttcatccaccagggccactgatcgtacccaacagattcagtgcaggaggtctgggacagacttcagtcncaccatcagcagcgtacagtctagaagtacttggcctagtttactctagtacaacgtatgtgtactagtcggtcctacgtaacggttccgacccgaagggacccagacgtggtactagtacgaggaccgtaacgtcggtgtcctcgacctaccgtacttcgtgttcttaccg

SEQ ID NO: 91745 - DNA, 746 bp, Homo sapiens
  misc_feature: GYAE6OF02HCXGK.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagccaccctctcctgcgacgggccagtcaagaacagttggagctaacttagcctaggtaaccaaacaaaaacctggaccacgcctcccagactcctcatttatcgttcactccaccagggccacgtgactcgtacccaacagattcgagtcggacaggacgggtactagggacacgtacttacgacgttcctaccacctactacgagtccgacgtaccgtaacgagttaccgtagtaaacggtaccgttagggtacttaacggtttttaacttaaccgtttggttaaacccaaacgttaaacgtttcgggtttacgggttaccgtaagggtttaccgggtacccgtttaaccggggtaaaccggtttacccggggtaaccccggtaacgggggtaaaccccgtaacggtaacggggttacgggtaacgttaacggtaccggtaacgggggtaaccggttaaaccggtttcgggtacgggtcccgttacgggtacccctaacccggttaaccgttaccggttttacggttaccctttaccccg

SEQ ID NO: 91746 - DNA, 665 bp, Homo sapiens
  misc_feature: GYAE6OF02J00UQ.5.57.F02.1.454.CMB.1.raw
  modified_base (216)..(216): a, c, t, g, unknown or other
  misc_feature (216)..(216): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagcccaccctcncctgcagggccagtcagactgttggtagcaacttagcctaggtaaccaaacaaaaacctcggaccagcctacccagacctcctctaactttactccgttactactcccaaccgacggtcctacgtcgtactcgtacccaacagtacttcgagtcggacgtaggacgggtcgtacgggaacacgtacttcgaacgtctaccaaccgtatccacggacacggtactacgacgtaccgtagtaaacggtcgttaggacttaggtttaacttaccgtaggtaccctaaacgtaagtttcggtaggtacaagggttcggtaccttaccgggtaacggttccgaccggtaaccgggtacctaaggtacggtacggtatacgtccgggtaaggtaccggtaactgggttaccggcttacggacctaacccgtaagttccttacggttctaacccgg

SEQ ID NO: 91747 - DNA, 514 bp, Homo sapiens
  misc_feature: GYAE6OF02HGTUS.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
  modified_base (489)..(489): a, c, t, g, unknown or other
  misc_feature (489)..(489): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctctcctgcagggccagtcagaacattggancaacttagcctggtaaccaacaaaaacctggaccagcctcccagacctcctcatttatcgttcatccacaggccactgatcgtcccaacgagattcaggtgcaggagggtctgggacagcttcagtcncaccatcagcagctacngtctgagtacttggactagtttatactgtacaactatgtgtacagtgcctcgacgttcgcctagggaccagaggtgatactcgaacgggctaacgtggtcggntcgaccaccgtatcttgtaccttac

SEQ ID NO: 91748 - DNA, 582 bp, Homo sapiens
  misc_feature: GYAE6OF02JT9FA.5.57.F02.1.454.CMB.1.raw
  modified_base (201)..(201): a, c, t, g, unknown or other
  misc_feature (201)..(201): n is a, c, g, or t
  modified_base (240)..(240): a, c, t, g, unknown or other
  misc_feature (240)..(240): n is a, c, g, or t
  modified_base (410)..(410): a, c, t, g, unknown or other
  misc_feature (410)..(410): n is a, c, g, or t
  modified_base (505)..(505): a, c, t, g, unknown or other
  misc_feature (505)..(505): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagacattggancaacttagcctgtaaccaacaaaaacctggaccagcctcccagacctcctacatttactcgtacactcccacacggccactgatcgtaccccaacagtattcagtcggacaggaggtctagggactaggtaccttacagttacgccaacctatcgagcaagtaccgtaangtctagaacgtacgttggaccttaggtttaattactgtacaacattgtggtactagtcggtacctacggtaccgttcggacccgaggacccaagngtacgatagtaccgaacggtacgaacggttgtcggtacgtacgtaccggtaccctaggttccgttaggtccttaccg

SEQ ID NO: 91749 - DNA, 667 bp, Homo sapiens
  misc_feature: GYAE6OF02IBFQ8.5.57.F02.1.454.CMB.1.raw
  modified_base (156)..(156): a, c, t, g, unknown or other
  misc_feature (156)..(156): n is a, c, g, or t
  modified_base (205)..(205): a, c, t, g, unknown or other
  misc_feature (205)..(205): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
tcagatcagacacgcacgaccggtgctcgatttagctcgatatagtttgggtttgggggaggaactgctcagttaggacccagacggaaccatggaacgccccagcgcagcttctcttcctcctgctactctggctcccagataccggttgggganatcgtgatgacgcagtctccagccatcctgtctgtgtctccgagggganagacgccaccctctcctggacacgggccaggtccaagtaacntttggancctaaacttcgcctacggtaaccaaaacgtaaaaacctggaccaacgccctacccaagtacctcctactaatttactccgtttcacgttcccaccgacggccaacgtgtactcgacccaacagtacttacgagtacggcgtaaggacgggtcgtacgggaacaacgtactttcgagttaccgtccaactacgtccgaacgacacggtaccgtactacgtacgtagaacgtacgttcgggactttaacgtttacttacgttacgtaacctaacgtaagtggtacggtcgtaggtcggtacctacgggtaaccggttccggacccgtaacggaccgaacgtacgtacgactacggtacgacggtaccgaacgttcggtcgtacgtcgaccgtacctacgttcgtacgtcttaccg

SEQ ID NO: 91750 - DNA, 665 bp, Homo sapiens
  misc_feature: GYAE6OF02I5FED.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctctcctgcagggccagtcagaacattggancaacttgcctaggtaccaaacaaaaacctggaccagcctaccagactcctcatttactcgttcactccaccgacggccactgatcgtacccaacagtattcagtcggacgagtacgggtcgtacgggactacggtacttacgacgtcctaccaccgtactacgacgtacacggtacgtaacgacgtacttaaggaaacgtacgttcggacgttaagttttaacgttaactgttaaccaaactaagttcggtagttacgtacggttccgggtaccttaaccgggtaaccggtttccggacccggtaagggtaacccctaacgtacggtacgggtaacttacgtaccgtaacggggtaactaacgggttacggtaggtaccgttacggacccgtaaccgttacggtccttacgttaccgtttaccg

SEQ ID NO: 91751 - DNA, 789 bp, Homo sapiens
  misc_feature: GYAE6OF02I12AV.5.57.F02.1.454.CMB.1.raw
  modified_base (203)..(203): a, c, t, g, unknown or other
  misc_feature (203)..(203): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccaccctctcctgcagggccagtcagaacattggtacgcaacttacgcctaggtaaccaacaaaaaccgtggaccacgccctacccgagacctcctactatttatccgttcactccaccgacgggccacgtcgactacgtacccaacgtagtacttacgaggtcggcgaaggtagggtccgtagggaaccaggtaccttcgaagttccctaccaacccgtacgttacgaacgggtccctaacggtaccggtttaaacccgtagggtttacccgttaacggtaaaaccgggtaccggtttacgggtaaccgttttaaacggtttttaaccgtttaaccggttaccggtttaaacctaaaccgttaaaaggtttcggttacgggttaccgtacgggttaccggttacccggtttaaccgggtaacccgggtttaccccgggaaccccgggttaaaccgggggtaaccctaaccgggtaaggttacgggtacgttaaccgttaccgggaacgggtacccgttaacggttcgggtacggtccgttacggacctacccgtagttcccgttcggttacccttaccg

SEQ ID NO: 91752 - DNA, 644 bp, Homo sapiens
  misc_feature: GYAE6OF02G5438.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgccaccctctcctgcacgggccagtccagacattggagcaacttagcctaggtaaccaaacaaaaaccgtcggaccacgcccctcccagtactccctacatttactcgttcactcccacgacggccactgactcgtacccaactagtattacgaggtgacgaggtagggtctagggacaggtaccttcgagtcctacgacctagtaccaggaccaaggtccgtacgtagtcgtacgtaaacgtcgtttacgggactttaagtttacttaacgtcgtaactaaacgtcgttgggtacgtagtaccggttcggtacctaccggttaaccggttccggacccgaaggtacccgaacgtgggtagtacgtacgtacggacgggtacgaacggtcggtacggaccgttacgaccgtacctacgtaccgtttgtcctttacccg

SEQ ID NO: 91753 - DNA, 580 bp, Homo sapiens
  misc_feature: GYAE6OF02JTZM7.5.57.F02.1.454.CMB.1.raw
  modified_base (152)..(152): a, c, t, g, unknown or other
  misc_feature (152)..(152): n is a, c, g, or t
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (281)..(281): a, c, t, g, unknown or other
  misc_feature (281)..(281): n is a, c, g, or t
  modified_base (315)..(315): a, c, t, g, unknown or other
  misc_feature (315)..(315): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
tcagatcagacacgcacgaccggtgctcgatttagctcgatatagttgggtttgggaggaactgctcagttaggacccagaccggaacccatggaagccccagcgcagcttctcttcctcctgctactctggctcccagataccgttggganatcgtgatgacgcagtctccagcccatccctgtctgtgtcctccagggnagcgccacccctncccgtgccaggggcccctgtccaggaaccattttggggaagccaaactttaggccctggtacccaanaaaaaacccgtggccacgcctcccagactcctcnttatcgtcatccaccaggccactgatgtcccaaccagattcagtggcacgagggtctggggacaggacttcagttcncaccancagcagcgtacagtctgaagacttggctagttttacttactgtcaacaagtgtgggtactaggtcggacctcggtaaaccgtttccggacccccgagggtacccacgtaacggtagggtataactccgaacgggcgtaaacctggttcgggccttgccgaaccctattcctacgttctttcc

SEQ ID NO: 91754 - DNA, 565 bp, Homo sapiens
  misc_feature: GYAE6OF02HCE1S.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagacgcccaccctctcctgcagggccagtcaagaacagttggagctaacttgcctaggtaccaacaaaaaccgtggaccacgcctcccagacctcctacatttatcgttcactccaccagggccactgatcgtcccaaccagtattcagtcggcgagagggtctgggacagacttcagtctacaccatcagcagcgtacacgtctagaagtacttaggctagtttacgttactgtacaatagtgtgtacgtagtacggtcctacgtacggttcggcccacgggtaccacgtagtacggatacgtacgacggtacgtaacgtcggtacggtcgtacgaccaccgtacgtccttacgtaccttccg

SEQ ID NO: 91755 - DNA, 510 bp, Homo sapiens
  misc_feature: GYAE6OF02G25T1.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (473)..(473): a, c, t, g, unknown or other
  misc_feature (473)..(473): n is a, c, g, or t
  modified_base (487)..(487): a, c, t, g, unknown or other
  misc_feature (487)..(487): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttagcctggtaccaacaaaaacctggccagcctcccagactcctcatttatcgttcatccaccagggccactgatgtcccaaccagattcagtgcagaggtctggacagacttcagtctcacatcagcagcgtacagtctagaacgacttggactagtttattactgtacaacaatgtgtcaggttcgcctacgtaacgttcggacccaagggaccacgagtgattancgaaggcgaagtgnggctcgcaccgatctagtcttac

SEQ ID NO: 91756 - DNA, 681 bp, Homo sapiens
  misc_feature: GYAE6OF02HVSGO.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctgctcccagataccgttgggagatcgtgatgacgcagtctccagccatcctgtctgtgtctccgaggggagagagccaccctctcctgcgagggccagtcaagaactagttggtagactaaacgttacgccgttacggtaacccaaaaccaaaaaacctggacccaacgcccctacccaagaccttcctactaacttttactccgttctactacccaaccgacgggcccacgtgactacgtaccccaaaccagtactttccgaaggttcggacgaagggacgggttccgtaggggaactagtaaccgttcaacgtcctaccaaccctatacaggtccgaacgtaccgtaactacgttcgtaggtaaacgtaccgttggacttaagttttaactacgtttagaactaaactagttagttcggtacgtaggttcggtacccgttaccgtaaccggttcccgggacccaaggggtacccaacggtagtaggtacgtagtccgaaggtccgtaagtcggttacggcgtacgccgaacctctcgttcggtcttaccg

SEQ ID NO: 91757 - DNA, 645 bp, Homo sapiens
  misc_feature: GYAE6OF02ID9VR.5.57.F02.1.454.CMB.1.raw
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccacctctcctgcagggccagtcagaacattggancaacttgcctggtaaccaacaaaaacctggaccagcctcccagacctcctcatttatcgttcatccacacggccactgatcgtacccaacagtattcagtcggacaggtagggtctgggaacaggtacttcgacgttctcaccatcgaagcaacgcgtacgacgtcgtagaacgacgttacggacttagttttacttaacgttggttacctaaaccgtaattcggttacgggtacgtagggttacgggtaccgttaccggtaaaccggtttccgggacccgttacgggaacccgtaccgtaagggtacggtacgttaattccggaacgggtacccgtaaaacggttcggtaacgggtaccgtcggaaccgtaccgtaacgttccgttacgtttccgttacccg

SEQ ID NO: 91758 - DNA, 518 bp, Homo sapiens
  misc_feature: GYAE6OF02F7O39.5.57.F02.1.454.CMB.1.raw
  modified_base (154)..(154): a, c, t, g, unknown or other
  misc_feature (154)..(154): n is a, c, g, or t
  modified_base (400)..(400): a, c, t, g, unknown or other
  misc_feature (400)..(400): n is a, c, g, or t
tcagatcagacacgcacgaccggtgctcgatttagctcgatatagttgggtttggggaggaactgctcagttaggacccagacggaaccatggaagccccagcgcagcttacctcttcctcctgctactctggctcccagataccgttgggganatcgtgatgacgcagtctccagccatcctgtctgtcgtctccaggggagagacgccgaaccctctccctgccagggccagtcagaacattggagctaacgttgcctggtaaccaacaaaaacctggaccagacctcccgagactcctcatttatcgttcatccacagggccactgatcgtacccaacagattcagtgcagacggtctgggacagacttcagtctcaccatcagcagcgtacagtcngaagacttggactagtttattactgtacaacaatgtgtcagtgctacgacgttcgacccgaggaccacgtagtcgatatacgaggacgaacgtcgtgctacgcaccgatctcgtctac

SEQ ID NO: 91759 - DNA, 609 bp, Homo sapiens
  misc_feature: GYAE6OF02JE3C1.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggagatcgtgatgacgcagtctccagccatcctgtctgtgtctccgaggggagagagccaccctctcctgcagggccagtcagaacattggtagcaacgttagcctggtaaccaaacaaaaacctggacccagccctaccccagacctcctactatttatcgttcactccaccgagggccacgtgatcgtaccccaaccagtattccgagtcggcaggaggtctagggacagacttcagtctacaccatcgagcaagcgtacagtctagaacgacttggactagtttactactgtacaaacgtattgcggtcaggttcgaccttacggtaaacggttccgacccgtaacgggtaacccaccgtaagttcggactttaacgccgtaagggcccggtaaaatcgggtacgggtaccgtacggacccgtaaccgtaactttccgttacggttacctttacccg

SEQ ID NO: 91760 - DNA, 559 bp, Homo sapiens
  misc_feature: GYAE6OF02IEH4I.5.57.F02.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
  modified_base (358)..(358): a, c, t, g, unknown or other
  misc_feature (358)..(358): n is a, c, g, or t
  modified_base (420)..(420): a, c, t, g, unknown or other
  misc_feature (420)..(420): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccgaggggganagacgccaccctctcctgcagggccagtcagaacattggtancaacttagcctaggtaaccaaacaaaaactggccagcctcccagactcctactatttactcgttcatccaccagggcccactgatcgacccaacagattcagtggcagaggtcnggacagacttcagtctcacatcagcagctacagtctagaagcttggctagtttacttacgtntacaaataatggtagtcaaggttcgccgtacgaaccgtttcggacccgtagggaaccacgaagtcggaattagtacgaagggaccgtaaagttcggtacggtcgtacgaccaaccctagtccttacggttcctttaccg

SEQ ID NO: 91761 - DNA, 509 bp, Homo sapiens
  misc_feature: GYAE6OF02FWIPT.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (423)..(423): a, c, t, g, unknown or other
  misc_feature (423)..(423): n is a, c, g, or t
  modified_base (460)..(460): a, c, t, g, unknown or other
  misc_feature (460)..(460): n is a, c, g, or t
  modified_base (497)..(497): a, c, t, g, unknown or other
  misc_feature (497)..(497): n is a, c, g, or t
  modified_base (506)..(506): a, c, t, g, unknown or other
  misc_feature (506)..(506): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcagggccagtcagaacngttggancaacttgcctggtaccaacaaaaacctggccagcctccagacctcctcatttatcgttcatccaccgaggccactgactcgtcccaaccagtacttcagtggacagagggtctgggacagacttcagtctcacatcagcagctacagtcagaagtcttgctagtttatactgtacaanaatgtagtcagtcgcctacgacgttcggccaggaccngagtgactagtacgaggcaacgtgtagctacgctacnctctcgttntcg

SEQ ID NO: 91762 - DNA, 531 bp, Homo sapiens
  misc_feature: GYAE6OF02F0IKR.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
  modified_base (364)..(364): a, c, t, g, unknown or other
  misc_feature (364)..(364): n is a, c, g, or t
  modified_base (489)..(489): a, c, t, g, unknown or other
  misc_feature (489)..(489): n is a, c, g, or t
  modified_base (526)..(526): a, c, t, g, unknown or other
  misc_feature (526)..(526): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctntcctgcagggccagtcagaacattggancaacttgcctggtaccaacaaaaacctggaccagcctccagactcctcatttatcgttcatccacagggccactgatcgtcccaaccagtacttcagtgcagagggtctagggacagacttanacgtctccacactcaggacagcgtacagtcagaagacttggactagtttattactagtacaactaagtgtaggtctaggtaggtccctacgtaacgttcgacccgaggtaccacgagtggactancgtacgacgaacgtggtagcgtacgctaccgatcgtntctac

SEQ ID NO: 91763 - DNA, 498 bp, Homo sapiens
  misc_feature: GYAE6OF02F77WM.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (394)..(394): a, c, t, g, unknown or other
  misc_feature (394)..(394): n is a, c, g, or t
  modified_base (404)..(404): a, c, t, g, unknown or other
  misc_feature (404)..(404): n is a, c, g, or t
  modified_base (438)..(438): a, c, t, g, unknown or other
  misc_feature (438)..(438): n is a, c, g, or t
  modified_base (460)..(460): a, c, t, g, unknown or other
  misc_feature (460)..(460): n is a, c, g, or t
  modified_base (468)..(468): a, c, t, g, unknown or other
  misc_feature (468)..(468): n is a, c, g, or t
  modified_base (479)..(479): a, c, t, g, unknown or other
  misc_feature (479)..(479): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctctcctgcagggccagtcagaacattggtancaacttagcctggtaacccaaacaaaaaacctggaccagcctcccagactcctcatttatcgttcattccaccagggccactgatcgtccccaaccagtacttcagtgcaggacgggtctgggacagacttcagtctcacatcagcagctanagtctagaancttggactagtttattactgtacaactatgtgtnagtgcctgacgtcgcgagacanagtgatangacggcactgngctgcacntcgtntcttcg

SEQ ID NO: 91764 - DNA, 688 bp, Homo sapiens
  misc_feature: GYAE6OF02HOGJ9.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (249)..(249): a, c, t, g, unknown or other
  misc_feature (249)..(249): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgccagggccagtcaagaactagtttggtanactaacgttagcctaggtaaccaaacaaaaacctggaccacgcctcccagacctcctctatttactccgttacactccaaccgacgggccacgtgactacgtacccaaccgagtacttcgagtcggcaaggtcgggtcgtagggacgacgtacgttcgagttccaccaccgtactccgagtcgacggtacgtacgaggtctaacggacgtaacggtttggtaccgttaagttttattaaccgtttacgtaactaaacttaagttcggtaggttacgtacggttcggtacccgttacgtaacgggtttacccggacccggtaacgggtacccgtaacgtacgggtacggtacgttacgtaccggaagggtacccggtaacgttcgggttacgggccgttacggaccgtacccgtagtttacccgttcgtaccctttaccg

SEQ ID NO: 91765 - DNA, 623 bp, Homo sapiens
  misc_feature: GYAE6OF02H4TOP.5.57.F02.1.454.CMB.1.raw
  modified_base (217)..(217): a, c, t, g, unknown or other
  misc_feature (217)..(217): n is a, c, g, or t
  modified_base (505)..(505): a, c, t, g, unknown or other
  misc_feature (505)..(505): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctccngcagggccagtcagaacattggagcaacttagcctaggtaaccaaaacaaaaacctggaccacgcctcccagactcctactatttactcgttcactccaccgaggccactgactcgtaccccaacacgtattaccgaggtcggaccaaggtacggggtcgtagggaacagtaaccttcgaacgttcctaccaccattccgaagccaggtacctaacgacgttccgtaggaaacgtacgtttcggacttaagttttacttaacgttgtaaccaaagtaatggtacggtnacggttacggcccttaggaaccgtttccggcccgaacgggacacggtagtacggattacgtacggacggaccgtaaggtcgtacggtcgtcggacctaccgtagtctcgtacccttac

SEQ ID NO: 91766 - DNA, 821 bp, Homo sapiens
  misc_feature: GYAE6OF02HY0AI.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctccagataccgttgggagatcgtgatgacgcagtctccagccatcctgtctgtcgtctaccgagggganagacgccctaccctctccgtgccgagggccagtccaagaactgtttaggagcaaactttcgccgtacggtaaccaaactaaaaaccgtcggaccacgcctacccacgtacctccgtactacgtttactcgttactaacctccaaccgtcggaccctacgtcgtaactccgttaacccaaaccgtaacgtacgttaccgtacggtacggacccgaacgggtacggggttacgtacggggtaaacctacggtaaccgtttaccgaacgttacccgttaccaaacccgtacgtaccaacggtaaccgacgtaccgttaacgtaacggttactaacgggttaaaccgtacgttacgggtaaccttaaagttttaacgttaaaccgtttacggaaaccttaaacgttaacgttacggttaacgtacggttaacggttaccgggtacccgtaaaccggttaaccgggtttacccggaacccggtttaaaccggggaaacctaaccggtaacgttcggaacgttttaacggaccgtaacgggttaaccgtaaacgggttcccgttagggtaccgtaccgggtaaccttaccccgtaaacgttccgtttaaccggcttttaaacccgg

SEQ ID NO: 91767 - DNA, 671 bp, Homo sapiens
  misc_feature: GYAE6OF02GCD75.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagacgccaccctctcctgcagggccagtcagaacattggagcaacttagcctggtaaccaaacaaaaacctggccagccctcccagacctcctctatttactcgttcactccaccaggccactgatcgtacccaaccagacttcgagtggacaggtagggtctagggaacagtacttacacgttcctcaaccgtatcagcaaggtccgtaacacgttactaggaaacgtacgttagggaccttaaggttttaacttaacgttacgttaaccaaaacgtaagttcggttacgggttacgtaacggttcgggtacccttaaccgggtaaaccggtttcccgggaccccgtaaagggtaaccccaagtaacgggtacggtacttaacggtacggtaacgggaaccgtaaacggttcggtacgggtaccttacggaccaacccgttattccggttacggttacccttttaaccg

SEQ ID NO: 91768 - DNA, 580 bp, Homo sapiens
  misc_feature: GYAE6OF02HATI0.5.57.F02.1.454.CMB.1.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctctcctgcagggccagtcagaacattggancaacttagcctggtaaccaaacaaaaacctggaccacgccctccagacctcctactatttactcgttcactcccaccgacggccacgtgactcgtacccaacacgtacttcagtcggacgaggacgggtcgtagggacacgtacttcgacgtctaccaccatcgagcagacgtacagtcgtagaacgtacgttgacttaagtttattacgtgtacaactagtgtagtacgtaggtaccgccgttacggtaaccggtccggaccgacgggaccacgtagtggacttagacgtcggaacgtacgtcggcggtactcgaccgtactactcttcgtcttac

SEQ ID NO: 91769 - DNA, 629 bp, Homo sapiens
  misc_feature: GYAE6OF02GEZEF.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaacaaaaacctggaccagcctcccagactcctcatttatcgttcatccaccaggccactgatcgtcccaacagattcagtggcaggacggtctgggacagacttcgagtctacacatcagcagcgtacagtctagaacgtacgttggctagtttattactgtacaaactaattggtacggttacagggttcggtacccgttacggtaaccggtttccgggaccccgtaacggggtaaccccaacgtaacgggttacgggaacttaacggttaccggaacggggtaacccggttaaacgttcgggtttacgggacccgtttgggaccctaaacccgtacgtttacccgtttacggtttacccttttaacccg

SEQ ID NO: 91770 - DNA, 680 bp, Homo sapiens
  misc_feature: GYAE6OF02IU2K4.5.57.F02.1.454.CMB.1.raw
  modified_base (201)..(201): a, c, t, g, unknown or other
  misc_feature (201)..(201): n is a, c, g, or t
  modified_base (243)..(243): a, c, t, g, unknown or other
  misc_feature (243)..(243): n is a, c, g, or t
  modified_base (366)..(366): a, c, t, g, unknown or other
  misc_feature (366)..(366): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccacctctcctgcgagggccagtcaagaacagttggancaattagcctaggtaaccaaacaaaaaccgtggaccacgacctaccagacctcctactatttatcgttacactccacacggaccacgtgactacgtacccaacagtattacgagtcgcaaggnggtcgtagggacagtacttacgacgtcgtacaccagtcaacgacgacgtaccgtaacgtagtaccttagaaacgttacgttcgggtaactttaaggttttaacttaaccgttacgttaaaccaaagttaagttagtgggttaacctagggtacgtacccgttaaggtaacccggttaccggacccgtaaacgggtacctaaaccgtaagggtaccggtacgtaacgtccggaaacgggtacccgtaaacggttcggttacgggacgttacgacccgtaacccgtagtttaccgttcggttaacctttaacccgg

SEQ ID NO: 91771 - DNA, 887 bp, Homo sapiens
  misc_feature: GYAE6OF02IWF4Q.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganaggagcccaccctctccgtgcgacgggcccaggtaccaagaacctagtttacgggtaacgacctaaaccgtttcggcccgttacggggttaaaccccaaaaaccgaaaaaaaccccgttcggggccccaacggacccccgttacccccaaggtaacccttcccttactaacgttttttaaccgttccggtttacctaacttaccccgaaccccggtacggggtaccccctaaccttacggtaccttacccggtacccccaaaaccgtacggtaactttccgaaacggggttcgggaccgtaacggggtaacggggttaccgttacgggggaaccctaaagggttacccgtttacgaaccggtttcctacccggaaccttaacgtccgtaacgaccgtaacggtaccggttaacgacgtttacccgtaaggtaaacgttaccgttacgggtaaccttaacgttttaacttacgtttactaaccgtaaacgtagttacgggtggttaccgtaaggtccgggttaaccctacgggaacggtttcccgggacccgtaaacggggtaacccacgttaacgggacggttaacgttacggtaccggtaagggtacctaaacggtttcgggtaccggggacctttacggacccgttaaacctaaccggtttccgttacggttccctttaaccgg

SEQ ID NO: 91772 - DNA, 765 bp, Homo sapiens
  misc_feature: GYAE6OF02JYCUD.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagactaccggttggggagatcgtgatgacgcagtctccagccatcctgtctgtcgtctccgaggggagagacgcccaccctctccgtgcgacgggccagtcaagactagttggagctaacttagcctaggtaaccaaacaaaacctggaccaacgcctacccagacctcctactatttactacgttacactcccgaacgacggacccacgtgactcgtacccaacgagtactcgacgtcggacaggtacgggtcgtacgggaactacgtaccgttacgaacgttcctaaccgaacccgtatacccggtaacgtaccgaaccggtaaccggtaacctaacggttacccgtaagggtaaaccgttaccggtttacggtaacctttaaggtttttaaccttacgttaccggttacctaaaccgttaaggttccggttacggttacgtaacgggttccgtacccgttaccgtaaaccggtttcccgggaacccgtaagggtaacccgaaggtaacggttcggtaacgttaccgtaccgggtaaacggtacccgggttaacttacgggttaccggtacgttacccgggtaccctaaccgttaacgtttcccgttacggtttccctttaaccgg

SEQ ID NO: 91773 - DNA, 629 bp, Homo sapiens
  misc_feature: GYAE6OF02F5R9E.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagccaccctctcctgcagggccagtcagaacattggagcaacttgcctggtaaccaaacaaaaacctggaccagccctcccagacctccctcatttatccgttcatcccaccagggccactgatcgtacccaacagtattcagtggcaggaggtctggggaacaggtacttcgaagtcctaccaccatacagccaagccgtaactaggtctaggaaagtacttcgggactagttttaattactgttactaaactaagtggttaggtacgtaggtcggtacccttaccggtaacggtttccgggaccccgtaacgggtacccgtaacgtaacggtacggtacttaacgtaccgtaacgggtaccggtaaaccgttcggtacgggtcctacggaccgaaccctagtaccgttcgttccctttacccg

SEQ ID NO: 91774 - DNA, 564 bp, Homo sapiens
  misc_feature: GYAE6OF02IJO39.5.57.F02.1.454.CMB.1.raw
  modified_base (202)..(202): a, c, t, g, unknown or other
  misc_feature (202)..(202): n is a, c, g, or t
  modified_base (351)..(351): a, c, t, g, unknown or other
  misc_feature (351)..(351): n is a, c, g, or t
  modified_base (396)..(396): a, c, t, g, unknown or other
  misc_feature (396)..(396): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccaccctctcctgcacgggccagtcagaacattggtagcaacttacgcctaggtaacccaaacaaaaacctcggaccagccctcccagactcctctatttactcgttcactccacgacgggccacgtgactcgtacccaaacngtacttcagtcgacaggtacgggtcagggacaggacttgacgtcncaccatcagcagctacagtctagaacgtacgtggacttagtttacttacgttgacaactaatgtgtcaggtccgtcctacgtaacggttccgaccgtacgggaccacgagttggattacgcgaaggtaccgacgttggcgtctacggctacgactacttccgtcttcc

SEQ ID NO: 91775 - DNA, 629 bp, Homo sapiens
  misc_feature: GYAE6OF02FXK9U.5.57.F02.1.454.CMB.1.raw
  modified_base (153)..(153): a, c, t, g, unknown or other
  misc_feature (153)..(153): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggaagacgccaccctctcctgcagggccagtcagacattggancaacttgcctaggaccaacaaaacctggaccagccctcccagacctcctcatttactcgttcactccaccgacggccacgtgatcgtacccaacagtacttaccgaggtcggacctaaggacgggttctaggggaacaaggtaccttcgaacgttcctaccgaacctactcgaacgtcaacggtccgttaaacagttacgtaggaaacgtacgtttagggacttaggttttaacttactgttaacaaacgtagtcggtaggtactaggtacggtcctacggtaacggttccgacccgtagggacccacgtagtaggtactacgtacggtaacggaccgtaacgtgggtacgtacgtacgacctaccgtactccgttacgtccttaccg

SEQ ID NO: 91776 - DNA, 629 bp, Homo sapiens
  misc_feature: GYAE6OF02GFRGU.5.57.F02.1.454.CMB.1.raw
  modified_base (153)..(153): a, c, t, g, unknown or other
  misc_feature (153)..(153): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagacgccaccctctcctgcagggccagtccaagaacagtttggagacaacttagcccttaggtaacccaaacaaaaacctcggaccacgccctaccccagtacctcctctatttactcgttcactccgaaccacgggccactgactcgtacccaaccagtacttcaggtcggcagggtagggtcgtcgggacaggtacttcgacgtctcactactcgagcacggtctacgacgtcgtaggtaacgtacgttgggaccttaagttttaacttacttagtaccaaagtaagttcgttaggtacgtaggtcggtacccttaacggtaccggttcccgacccgaacgggtaccctaagacgttaggattacgtacgaacgggtacgaacgttggtcggacctcgacgacctacgttcgttcgttcttaccg

SEQ ID NO: 91777 - DNA, 607 bp, Homo sapiens
  misc_feature: GYAE6OF02F3R2Y.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgcagggccagtcagaacnttgganctaacttagcctgtaaccaaacaaaaacctggaccagccctacccagacctcctactatttatccgttacatcccaaccagggccaactgactcgtacccaacagattcagtcggacaggagggtctagggacacgtacttacgagtctacaaccgatacagctagacgtaacagttctagaagtacttggactaagttttactactagtacaaactaagtgtacgtactacggtcgaccgtacgaaccgtttcggacccctaacgggaacctaacggtagtacgggtataacgtacggtaagggaccgtaaacgttggtacgggtcctacggacctaaccgtagtccggttacgttacttacc

SEQ ID NO: 91778 - DNA, 708 bp, Homo sapiens
  misc_feature: GYAE6OF02IKSTB.5.57.F02.1.454.CMB.1.raw
  modified_base (153)..(153): a, c, t, g, unknown or other
  misc_feature (153)..(153): n is a, c, g, or t
  modified_base (249)..(249): a, c, t, g, unknown or other
  misc_feature (249)..(249): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagcgccacccttctcctgccgagggcccagtcaagaactagttggancaacgttagcctacggtaaccaaaaccgtaaaaaacctcggaccaacgcccctacccaacgaccttccctactaattttactcgtttacaacttccaaccgtacggcccaacgtcgtactcgtaccccaaactagtacttaccgaggtcggacgtagggtacgggtacgtaggggaactacggtaccttacgacgttacctaccgtaacccatccgacgacgtaacgtaccgtaacgtacgtaccgttaagaaacgtacgttacggtacttaacgttttacgttactagttacctaaactagttggtacggttacgtacggttccggtaccgtacgtaaccgttcccggaccgtacgggacctaacggaagttacgggacttacggtacgtaacgggaccgtaacgttcggtacgtaccgtgaaccctaccgttagttaccgttcggttacctttaccg

SEQ ID NO: 91779 - DNA, 578 bp, Homo sapiens
  misc_feature: GYAE6OF02IBV9S.5.57.F02.1.454.CMB.1.raw
  modified_base (200)..(200): a, c, t, g, unknown or other
  misc_feature (200)..(200): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctcagccatcctgtctgtgtctccagggganagagccaccctctcctgcagggccagtcagaacattggtancaacttagcctggtaccaaacaaaaacctggccagcctcccagacctcctctatttatcgttcattccaccgagggccactgatcgtacccaaccagattcagtcggcagagggtctgggactagacttacgagtctacaccatcgagcagcgtacagtctgaaagtcgttaggctaagtttattaacttgtacaactaagttcgtacggtatacggtcggtaccttcgaaaccggtttccggacccgtaaggggaacccagtagttacgggtatacgtcgtaacgggacctaacgtggttacggcgtcgacctaccgagtccgttgtaccttaccg

SEQ ID NO: 91780 - DNA, 656 bp, Homo sapiens
  misc_feature: GYAE6OF02HLX4Z.5.57.F02.1.454.CMB.1.raw
  modified_base (623)..(623): a, c, t, g, unknown or other
  misc_feature (623)..(623): n is a, c, g, or t
  modified_base (641)..(641): a, c, t, g, unknown or other
  misc_feature (641)..(641): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtcctccagccatcctgtctgtgtctccgaggggagagacgcccaccttctcctgcgacgggccagtcagaacagttggagactaacttacgcctacggtaaccaaaccaaaacgtcggaccacgcccctacccacgacctcctacttactttactccgttactacctacccaccgacgggccactcgactaccgacccaacctagtacttaccgaggtcggacgtaggacgggttcgtaggggaacaacggtactttacgacgttcctaccaactacgtaccgacgaccgaacgtacgtaacctacggttcgaaggttaaacgtaccgttgggtaaccttaagttttacttaacgttgtacctaaacgtagttcggttagtccgtaggttcgtaccgtacggtaccggtccgaccggaaccggacaacgagtgactacgcggacggacgtaacgngtcgcgtacgaccacgtntcgttcgtcttaccg

SEQ ID NO: 91781 - DNA, 590 bp, Homo sapiens
  misc_feature: GYAE6OF02GK05M.5.57.F02.1.454.CMB.1.raw
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtancaacttagcctggtaccaacaaaaacctggaccagcctcccagactcctcattatcgttcatccaccaggccactgatgtcccaaccagattcagtgcagaggtctgggacagacttcagtctcacatcagcagcgtacagtctagaagacttggactagtttaattacgtagttacaaacgtaatggtaggttcaagggttacggaccctcggtaaaccgtttccgggaccccgtaaggggaaccccaacgtaacggttagggtactaagttcccgaaaggggtaccgaaaaccgttgggtaggtccgttaacgccgaaccctaacgttacgttacgttaccttacc

SEQ ID NO: 91782 - DNA, 657 bp, Homo sapiens
  misc_feature: GYAE6OF02G850V.5.57.F02.1.454.CMB.1.raw
  modified_base (153)..(153): a, c, t, g, unknown or other
  misc_feature (153)..(153): n is a, c, g, or t
  modified_base (418)..(418): a, c, t, g, unknown or other
  misc_feature (418)..(418): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctcgaggggagagagccaccctctcctgccagggccagtcagaactagttggagactaacgttagccgtaggtaacccaaaaccgaaaaaccgtcggaccacgcccctacccagtacctccctactaattttactccgttacactacccaccgtacggacccacgtgactcgtaccccaacagtacttcgagtggactaggtacgggtcgtagggactacgtacttanacgtccacacctatccgacgtccacggtacctacgacgttacgtagaaacggtcgttaggaccttagttttactaacgtgtaccaacgtagttgtacgggctaggtccggtaccgtacgggtaccggttaccggacccgaagggtaccctagggttacgtacggtacgttagtaccggaaggtaccgtaaaggtcggtagtccgtacgacccgtaactacgttcgttcgttccttaacg

SEQ ID NO: 91783 - DNA, 530 bp, Homo sapiens
  misc_feature: GYAE6OF02GWCJD.5.57.F02.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
  modified_base (421)..(421): a, c, t, g, unknown or other
  misc_feature (421)..(421): n is a, c, g, or t
  modified_base (456)..(456): a, c, t, g, unknown or other
  misc_feature (456)..(456): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
  modified_base (500)..(500): a, c, t, g, unknown or other
  misc_feature (500)..(500): n is a, c, g, or t
  modified_base (516)..(516): a, c, t, g, unknown or other
  misc_feature (516)..(516): n is a, c, g, or t
  modified_base (519)..(519): a, c, t, g, unknown or other
  misc_feature (519)..(519): n is a, c, g, or t
  modified_base (526)..(526): a, c, t, g, unknown or other
  misc_feature (526)..(526): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagcccaccctctcctgcagggccagtcagaacagttggtancaacttagcctaggtaacccaaacaaaaacctggaccagcccctacccagacctccctactacttttactcgttaccactcccaccgacgggccacgtgactcgtacccaaccagtacttcaggtggacaggtagggtcgtagggacagtacttcagtctcacatcagcagctacngtctagaagtctggctagtttattactagtacaanatgtgtcagtcgctacgtacgtcgaccaggccagngngatgcgnggacagtgtgctgacnctntctcgtnttac

SEQ ID NO: 91784 - DNA, 607 bp, Homo sapiens
  misc_feature: GYAE6OF02HLBLN.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganaggacgccacccttctccgtgcagggccagtcaagaacagttggagcaacgttgcctggtaaccaaacaaaaacctggaccagcctcccagacctcctctatttatcgttcactccaccgacggccactgtactcgtacccgaaaccagtacttccaggtcggacaagggtacgggtcgtggggactaaggacttcgacgttccacaccgatcgagcacgctacgagtctagaagtaccgttggacttagtttaacttacgtacgtactaactaagtgtcggtacaggtcggtaccgcgttaaaccggtccgtacccgaacgggacgtaacgaggtcgagttacgtacgacggaccggtaaccgtggtacgtgtaccgacgacctacgtacttcgttacttaccg

SEQ ID NO: 91785 - DNA, 710 bp, Homo sapiens
  misc_feature: GYAE6OF02GEAV7.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgccaccctctcctgccgagggccagtcagaactattggagcaacttagcctaggtaaccaaacaaaaacctggaccagccctacccagacctcctctattttactccgttacacttacccaaccgacgggccctacgtgactccgtaccccaacgagtacttcgaggtacggactaacgggagggtcgtacggggaacacggtacttactacggttacctaccgaacctactacgacgaccgtacggtaccgtaacgtacggtcgtaaggaacgttacgttacgggtacttaacggtttttaacttaccgttagttacctaaagtaagttcgggttacgtacgtacggtccgggtaccgtaccggttaacggttcccggaacccggtaccggaacctaccggtaggttacggtattacggaccggtaacgggtaccgtaacggttcggtacggtaccgtacggtacccgtaaccgtaacgtttccgttacgtttaccttacccg

SEQ ID NO: 91786 - DNA, 900 bp, Homo sapiens
  misc_feature: GYAE6OF02FO73D.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccacccttctccctggccgacggggtcccaggtccaaggaaacctagttttcgggaacgcctaaaaccgttttaggccccttaggggttaaacccccaaaaaccgtaaaaaaaaaccccttcggggaacccccaaacggccccccttacccccgaaggtaacccttccccccttacctaaacttttttaacgttcccggttttaccaaaccgtttacccccgaacccgtaaccgggggaccccctaaaccgttcggtaacgttacccggttaaccccccaaaaaccccgtaaggtaacttttcccggaaaggtttcgggaccctaaggggtaacgggggttcccgttacgggggaaacctaacgggtaaacctttcgaacggttacccttacccgaaccccgtaagttaccgaacggaccgtaacggtacccggttaacaacggttaccgtaaggtaaacgtacgtttacgggaccttaaaggttttttaaccttaaccgttaaggttaaccctaaaacgttaacgtttacggtacgggttacctaagggtaccgggttaccctaccggggttaaaccggttcccgggaacccgaacgggaccctacgtacggtacgtactcgtaccgggaggaccggttaacgtcgggtcggacgttcggacctaccgacttccgttacggtcccttaccg

SEQ ID NO: 91787 - DNA, 561 bp, Homo sapiens
  misc_feature: GYAE6OF02I6HQT.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (398)..(398): a, c, t, g, unknown or other
  misc_feature (398)..(398): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagacgccaccctctcctgccagggccagtccagaacagttggtagcctaacttgcctggtaaccaaacaaaaacctggccagcctcccagacctcctcatttactcgttcatccaccagggccacgtgatcgtcccaaccagacttcagtggcagagggtctagggacagtactacagtctcaccatcagcagcacngtctgaacgcttggactagtttatactgtacaactagtgtaggtcagtcgtccgtaggtaaccgttccggaccgacgggaccacgtagtacggactagtaccgaaggtaccgtaacgtcggtcggtaccgtggtacccaccgtataccggtcgttccttaccg

SEQ ID NO: 91788 - DNA, 540 bp, Homo sapiens
  misc_feature: GYAE6OF02FGF4H.5.57.F02.1.454.CMB.1.raw
  modified_base (201)..(201): a, c, t, g, unknown or other
  misc_feature (201)..(201): n is a, c, g, or t
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagacgccaccctctcctgcagggccagtcagaacattggtagctaacttgcctggtaaccaacaaaaacctggccagcctccccagacctcctcattttactcgttcatccaccaggccactgactcgtacccaaccagtacttcagtggacaggtacgggtctaggggactacgacttcacgtctacgaccatccagcagacgtacagtcagaacgtcttggctagtttatctagtacaatatgtggtacaggtgccctagtaacgttccggaccaggaccagtagngtanacgtcgaacggcgtaactgcgcgtcgaccaccgtatctactcgttac

SEQ ID NO: 91789 - DNA, 700 bp, Homo sapiens
  misc_feature: GYAE6OF02I2493.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagccaccctctcctgcagggccagtcagaacattggancaacttgctgtaaccaacaaaacctgaccacgcctacccagacctcctctatttactcgttcactccaccgacggccactgtactcgtacccaacagtacttacgagtcggacaggtacgggtcgtacgggaacacggtacttacgtaacgttcctacctaaccgtaactcgaacgaccgtaacggtccgtaacgacggtttactacggaaaacgttaccggttaggtaccgttaacggttttaactttaccgttacgtttaaccaaacgttaacgtttacggttcggttaccgtaacgggttccggtacccgttaccgggttaacccgggttccgggtacccgaacgggtacccaacgtagtacggtacttacgtacggtaacggtaccgtaacggttacggtacggtaccgttacggaccctaaccggtactttaccgttcgttaccctttaaccg

SEQ ID NO: 91790 - DNA, 779 bp, Homo sapiens
  misc_feature: GYAE6OF02JDAI5.5.57.F02.1.454.CMB.1.raw
  modified_base (709)..(709): a, c, t, g, unknown or other
  misc_feature (709)..(709): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtcctcacgccatccgtgtctgtcgtcctccggaggggagacgcgccctaccctctccgtagcgacgggccagtcaagaacctgtttagggacaccgtaacttcggtccttacgggtaaacccaaaaacgtaaaaacctcgggacccaacggcccctacccgaagtaaccctcccgtacttaacttttaccgtccgtttaccaaccttcccgaacccggtacgggtcccctaacggttagaccgttaccccgtaacccctaaaaccgtaggttaccttacggtaacgggttcggaacggaggggttaaccgggttccggaaggggtaacccaaggttccttacgtaccggttacccaccgtaaccctagtaccgacgtacgaaaccggtccgtaacgttaccgtacgtaaggaaaccggttaccgtttaggacgtttaaacgtttttacgtacttacggtaaacctaaaccggtgttcggttacggtctaaggtcggtacccgtacggttaccgttcccggaccggtaacgggacctaacgnggttttacgacgtacgtaccggaggtaccgtattcggcggtactcggacctacgacttcgtactcgtacc

SEQ ID NO: 91791 - DNA, 675 bp, Homo sapiens
  misc_feature: GYAE6OF02JGNKL.5.57.F02.1.454.CMB.1.raw
  modified_base (152)..(152): a, c, t, g, unknown or other
  misc_feature (152)..(152): n is a, c, g, or t
  modified_base (201)..(201): a, c, t, g, unknown or other
  misc_feature (201)..(201): n is a, c, g, or t
  modified_base (251)..(251): a, c, t, g, unknown or other
  misc_feature (251)..(251): n is a, c, g, or t
  modified_base (455)..(455): a, c, t, g, unknown or other
  misc_feature (455)..(455): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggganatcgtgatgacgcagtctccagccatcctgtctgtgtctccgagggganagacgccaccctctccgtgcgacgggccagtcagaactagtttcgggaanctaaacgtttacgccgttacggtaacccaaaaccgaaaaaccgttcggacccaaacggtcccctaccccaaggaaccttccctactaactttactccgttacaactacccaaccgaggtcccaactcgactccgtacccaaccgtaagtacttcgagtcggacaggtaggtacgtagggacacgtacttcacgtctacgaaccntacacgcgacgtactacgacgtctagaaacgtacgtggtactaagtttactcgttacgtactaaagtaacgttcggttacgtacgtacggttccgtaccgtaaccggtaccggttaccgaccggtaacgggacctaacggacgttacgggataccggtacgacggtaccgaacgtcggtacggtctacggtacgaccgttagttaccgttgtaccttacg

SEQ ID NO: 91792 - DNA, 711 bp, Homo sapiens
  misc_feature: GYAE6OF02I7764.5.57.F02.1.454.CMB.1.raw
  modified_base (151)..(151): a, c, t, g, unknown or other
  misc_feature (151)..(151): n is a, c, g, or t
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
  modified_base (303)..(303): a, c, t, g, unknown or other
  misc_feature (303)..(303): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggganatcgtgatgacgcagtctccagccatcctgtctgtgtcctccgagggganagacgccacccgtctcctgcagggccagtcaagaacngttggagcaacttagcctggtaaccaacaaaaacctggccacgcctcccagactctctatttacncgttcatccaccgaggccaactgatcgtacccaacagattcagtacggcgaagtacgggtctagggacagtacttcaacgttcgtacctaaccgacttacacggtaccaacggtccgtaactacggttactacggtaaagtacccgtttggaacgttaagttttacgttaacgttgtaactaaaacgtaacgttggtacggtaccaggttacggtaccccgttaggtaaacccggtttccggacccggtaaacgggtaaccccgtaacggtaacgttaccgggtaacgttacggttaaccggtaacggtaaccggtaaaccgttacggggtaaccggtttaccgtacgggttaaccccgtaaacccggttaacgtacccggtttacgtttacccgttttaaacccggg

SEQ ID NO: 91793 - DNA, 793 bp, Homo sapiens
  misc_feature: GYAE6OF02JRRTS.5.57.F02.1.454.CMB.1.raw
  modified_base (204)..(204): a, c, t, g, unknown or other
  misc_feature (204)..(204): n is a, c, g, or t
  modified_base (260)..(260): a, c, t, g, unknown or other
  misc_feature (260)..(260): n is a, c, g, or t
  modified_base (394)..(394): a, c, t, g, unknown or other
  misc_feature (394)..(394): n is a, c, g, or t
tcagatcagacacgcacgaccggtgctcgatttagctcgatatagttgggtttgggggaggaacgtgctcagttaggacccagacggaaccatggaagccccagcgcagcttctcttcctcctgctactctggctcccagactaccggttgggagatcgtgatgacgcagtctccagccatcctgtctgtgtctccgagggganagacgccctaccctctccgtgccgacgggcccagtcagtaacctagtttgggaacnctaaacgttcgccgtacggtaacccaaaacgtaaaaaccgtcggtacccaacggtacccctaccccgaacgtacccttcccgtactaacgttttaactccgttacctacttacccaccgacggtacctacgtanactaccgtacccctaacgacgtacttcaacgtcggacacggtacggtcgtacgggaacctacgtaacgttcgtaacgttccgtaccaaccgtactaccggaagaccgtacgtaccgtaaccgtacgtaccgtagtaaacggtccgttaaggtaccttacggttttaacttaccggttacggtaaccttaaacggtacgtttacggttacgggtacgttaaccgggtcgttaacccgttaacgggtaacccgttccggtaacccggtaacggaaccctaaccgtagggtaccggtaacttaacggtaccggtaacgggaccgttaaaccggtgggtttacccggtacgttacgacccggtaaccgttaaccgttacggtttacgttaaccgtttacccgg

SEQ ID NO: 91794 - DNA, 577 bp, Homo sapiens
  misc_feature: GYAE6OF02I9FRH.5.57.F02.1.454.CMB.1.raw
  modified_base (546)..(546): a, c, t, g, unknown or other
  misc_feature (546)..(546): n is a, c, g, or t
  modified_base (551)..(551): a, c, t, g, unknown or other
  misc_feature (551)..(551): n is a, c, g, or t
  modified_base (554)..(554): a, c, t, g, unknown or other
  misc_feature (554)..(554): n is a, c, g, or t
  modified_base (558)..(562): a, c, t, g, unknown or other
  misc_feature (558)..(562): n is a, c, g, or t
  modified_base (564)..(577): a, c, t, g, unknown or other
  misc_feature (564)..(577): n is a, c, g, or t
tcagatcagacacgcacgaccggtgctcgatttagctcgatatagttgggtttgggggagaggaagactgacggtcccccaggagtccagagtgcgtcgcaagtattggcagtgtgaaatttgacaccttatatgcagactctgtgagggccgcttcaccgtgtccagagacaactccaagaacgccgtctatttgcagatggacacgcctgagagtcgacgacagggcatctatattgtacggcgccgagcaagtactcgtccttactttctggagtcaggggtatccccgggtcaaccgttggtcctccttcacgtcccgtcctacccgaacgggacccctactaccgggtccttccccccgtcgggcccctacccgtaccctccctaaacgacgacctacccgttccttcgggggccaacgacggccggtccccgtggggcccttcgcccgtaggttacccgaacgggtaccttaacttccccggttgttccgttgactccttggacgtccgggcgtcggcgacggcgtaccgagtacgctgnagctncgntgcnnnnngnnnnnnnnnnnnnn

SEQ ID NO: 91795 - DNA, 659 bp, Homo sapiens
  misc_feature: GYAE6OF02I3V1U.5.57.F02.1.454.CMB.1.raw
  modified_base (155)..(155): a, c, t, g, unknown or other
  misc_feature (155)..(155): n is a, c, g, or t
  modified_base (205)..(205): a, c, t, g, unknown or other
  misc_feature (205)..(205): n is a, c, g, or t
tcagatcagacacgcacgaccggtgctcgatttagctcgatatagttgggtttgggggaggaactgctcagttaggacccagaccggaaccatggaagccccagcgcagcttctcttccctcctgctactctggctcccagataccgttgggganatcgtgatgacgcagtctccagccatcctgtctgtgtcctccgagggganagaggccctacccgtctcctgacgacgggccaagtccaagaactagttaggagcaacgttagccctaggtaaccaaacaaaaacctggacccagccctacccagacctcctactatttactccgttacatcccaaccgacggccactgactcgtacccaacacgtacttcgagtcggacaggtacggtcgtagggaacaggtaccttacgacgtctaccgaaccagtaccgagcaacgtcgaacgtagtaccgtaagaacgttaccgtagtacgtaagttttaacgtactacgttaacctaataacgttggtacgtacgtagtccggtaccttaaccggtaaccgttccggacccgtaacgggacctaagagttacgaagttactccggtaacgggtaccgtaaagtcggtacgtaccgtacgtacgaccgttacgtccttacggtcctttaac

SEQ ID NO: 91796 - DNA, 671 bp, Homo sapiens
  misc_feature: GYAE6OF02IU027.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgcaggccagtcagacattgganacaacttgcctggaaccaacaaaacctggaccacgccctcccagacctcctctatttactcgttcactcccaccgaggccactgactccgtacccaacagacttcacggtggaccaggtacgggtcgtaggggacacgtacttcgagttccaccgacctactccagaccgtacggaccgttacgacgttacgtagtaaacgtaccgtttaggacccttaagtttttaaccgtttaacttacggttaacctaaacgtagttacggttggttacgtaaggtcggttccctaaccggttaaccgggtttccgaaccccggtaagggaccctaaccgtaggttacggagttacgtaccggagggtacccggtaaacgtgggttaccggcgttaccggaccctaccgtacgtcccgttaccggtctttaacccgg

SEQ ID NO: 91797 - DNA, 610 bp, Homo sapiens
  misc_feature: GYAE6OF02I353B.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (301)..(301): a, c, t, g, unknown or other
  misc_feature (301)..(301): n is a, c, g, or t
  modified_base (406)..(406): a, c, t, g, unknown or other
  misc_feature (406)..(406): n is a, c, g, or t
  modified_base (457)..(457): a, c, t, g, unknown or other
  misc_feature (457)..(457): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtcctccagggganagacgccaccctctcctgcagggccagtcagaacnttggagcaacttagcctggtaccaacaaaacctggccagcctacccagacctcctcattttacncgttcatccaccaggccactgactcgtcccaacagacttcagtggcaggacgggtctagggacagaccttcgaagtctacaccgatcgagaccgagaccgttaanacggttactagaacgtagttggacctaggttttacttacgttgtacctaanaacgttggtacggtcaggtcgtcccgtacggtaaccgttccggacccgtaaggggccctaacgaggtacgggactaacgtccggaacggtaccgtaaacgttcggtggtacccttacggcctaaaccctggttcccttggttacctttacccg

SEQ ID NO: 91798 - DNA, 580 bp, Homo sapiens
  misc_feature: GYAE6OF02JH32D.5.57.F02.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctntcctgcagggccagtcagaacattggancaacttgcctggtaccaacaaaaacctggaccagcctcccagacctcctctatttatcgttcatcccaccagggccactgatcgtaccccaaccagattcagtggaccaggtagggtctaggggacagacttcagtctccaccatcagtcagtcctacagtcagaagtacgttggactagtttatacttgtaccaactaagtgtcggtacaggttcgaccgtacgaaaccggtttccgacccgaagggaccctaacgaggttaggacttagtacgtacgggacggtaaacgtggtacgggtctccgtaccgaaccctatccgttagttcccttaaccg

SEQ ID NO: 91799 - DNA, 842 bp, Homo sapiens
  misc_feature: GYAE6OF02HU4XW.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtcgtctccgaggggagagacgccctaccctctccgtgaccgacgggccaggtacaaggaactagttagggtaacgacctaaacgttacgcccgttaacgggtaacccaaaaaacccgtaaaaaaccgtccgggaaccccaaccggtacccccttaccccgaacggtaccctttaccccgtacttaatttttaccgttccgtttacctaaccgtaccccgaacccggacgggtaccctaacgttacgtaacttacccgtaaccccaaaccgaagttacgttaccgtaagggttacggaccgtaacggggtacgggttaccggtaggggaacctaacggttaacccttacgtaacgttacctacctaacctaagttcccgaaggaccgaacggtccgtaaacgtacggtaccgtaaggtaaacgtaacggttcggaactttaagttttaactaccgttacgtaaccgtaaacgtaaagttcggtacggttacgtaaacgggttccggtacccgtaaccggtaaccgttccgggtaacccgaaccgggtaaccggaacctaagggtacgtaggtacctaacgtcgggaaccgtaccggttagttacggtccgtacggtacccgaacccgttaacgttccgttacgttacttaacccg

SEQ ID NO: 91800 - DNA, 669 bp, Homo sapiens
  misc_feature: GYAE6OF02IG7EV.5.57.F02.1.454.CMB.1.raw
  modified_base (153)..(153): a, c, t, g, unknown or other
  misc_feature (153)..(153): n is a, c, g, or t
  modified_base (246)..(246): a, c, t, g, unknown or other
  misc_feature (246)..(246): n is a, c, g, or t
  modified_base (633)..(633): a, c, t, g, unknown or other
  misc_feature (633)..(633): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagacgccaccctctcctgcagggccagtcagaactagttggtanctaaacgttagcctacggtaaccaaaccaaaaaccgtcggacccacgcccctacccacgaacctcctactaacttttactaccgttacacttaccaaccgacgggaccactgacttacgaccccaaccatacttccaggttcggaccgtaggtacgggtcgtaggggaacaacggtacgttaccgacgttacctacccgtaacctaactcgtaacgctaacggtccgtaactacgtacgttaaacggaacgttacggtcggtacttaagttttaacttacgttgtaacctaaataagttggtaggttcacggttcgaccgttacggtaaccgttcccgggacccgaacgggaaccagtaacgtagactacgacgaacggacgtacgngttacgctcgaccgtaccgtatcgttcgtacttacg

SEQ ID NO: 91801 - DNA, 569 bp, Homo sapiens
  misc_feature: GYAE6OF02F2QQ7.5.57.F02.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccaccctctcctgcagggccagtcaagaactnttggagctaacttgcctggtaccaaacaaaaacctggaccacgccctcccagacctcctcactttatcgttcatcccacagggccactgactcgtaccccaaccagtattccagtcggactaggagggtctggggacagtcttcagttcctacaacctatacagcagtccgtacagtctagaaacgtcgttaggactagttttatactagtacaagtaagttgtggttacaggtcggaccgttacgtacgttccgacccgaggaccagagtagtattacgtaggacgtaactggtcgcgtacgaccacctagtctcgtacttctaaccg

SEQ ID NO: 91802 - DNA, 699 bp, Homo sapiens
  misc_feature: GYAE6OF02H7E0V.5.57.F02.1.454.CMB.1.raw
  modified_base (154)..(154): a, c, t, g, unknown or other
  misc_feature (154)..(154): n is a, c, g, or t
  modified_base (202)..(202): a, c, t, g, unknown or other
  misc_feature (202)..(202): n is a, c, g, or t
  modified_base (294)..(294): a, c, t, g, unknown or other
  misc_feature (294)..(294): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccagggganagacgcccaccctctcctgcagggccagtcagaacattggtagcaacttgcctcggtaacaacaaaaacctggaccagcctcccagactccnctattatcgttcactccaccagggccactgactcgtacccaacacgacttcaggttcggcgtaggtacgggtcgtacggggacagtacctttacgaacgttctccgaaacccgtagtttccaaggtccaacggtaccggttaaacctagggtaaccttacggtaaacgtaccgtttaggaaccctttaaggttttaactttacgttacgttacaaacgttaaacgttggttagttaccggtagttaccgggtccttaacccgggtaaacgtttcccgggacccgaaacgggtacccgtaacgtacggttagggtaactacgttaccggaaggggtaacccggaacggttacggtcggaccgttagtacccgaaccgtactttcccggttacggttctttaacccg

SEQ ID NO: 91803 - DNA, 610 bp, Homo sapiens
  misc_feature: GYAE6OF02ICGNZ.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (248)..(248): a, c, t, g, unknown or other
  misc_feature (248)..(248): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgccaccctctcctgccaggggccaggtcaagaacattggancaattcgcctggtaccaaacaaaaacctggaccagcctcccagacctcctactatttactcgttcactccacgacggccacgtcgtatcgtacccaaaccagtacttcaggtcggccgaggacgggtcgtagggactaggacttcgacgtcctacaccatcgacgcacggtcgtacgtagtactaggtaacgtcgttacggacttaagttttataccgttatacgaaactagttggtgtactaggtcgtccgtacggtaacgttccgggaccctaggggaccctacggagtacggattacgtacgaggtaaccgtacgtcggttacggcgtacgacctacctacgttcttcggtctttaccg

SEQ ID NO: 91804 - DNA, 518 bp, Homo sapiens
  misc_feature: GYAE6OF02G7EKC.5.57.F02.1.454.CMB.1.raw
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (432)..(432): a, c, t, g, unknown or other
  misc_feature (432)..(432): n is a, c, g, or t
  modified_base (504)..(504): a, c, t, g, unknown or other
  misc_feature (504)..(504): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagccaccctctcctgcagggccagtcagaacnttggtagcaacttgcctggtaccaacaaaaacctggaccagcctcccagactcctcatttatcgttcactccaccagggccactgactcgtcccaacagtacttcagtggcaggaggtcgtgggacagtcttacagtctacaccatcagcagcgtacagtctagaagtacgttggactagtttattactgtacaanagttgtgtcaggtcgctacgacgttcggccaggaccagcgtagatagacgaggctaacgtgtggctgccacngtcttgtcttaccg

SEQ ID NO: 91805 - DNA, 543 bp, Homo sapiens
  misc_feature: GYAE6OF02IVMY1.5.57.F02.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
  modified_base (395)..(395): a, c, t, g, unknown or other
  misc_feature (395)..(395): n is a, c, g, or t
  modified_base (477)..(477): a, c, t, g, unknown or other
  misc_feature (477)..(477): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctntcctgcagggccagtcagaacattggancaacttgcctggtaaccaacaaaaacctggaccagcctcccagacctcctcatttatcgttacatcccaccgagggacccacgtgactcgtacccaacagattcagtcggcagagggtctgggacagacttcagtctcacatcagcagctaacntcgtagaagacttggactagtttattacgtgtacaatatgtagtctagtcgcctacgaacgttccgaccgacggaccaacgngtagtatacgtacgaggtaccgaacgtggtacggtctacggacctaccgagtcgttagtcttaccg

SEQ ID NO: 91806 - DNA, 730 bp, Homo sapiens
  misc_feature: GYAE6OF02I283F.5.57.F02.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccagggganagacgccaccctctcctgcagggccagtcagaacnttggancaacttgcctggtaccaacaaaactggaccagccctacccagacctcctactattttactccgttacactcccaccgacgggccactcgactcgaccccaacagtacttcgaaggtcggacgaggacgggttcgtagggaactaagtacctttacgacgtttccctaccgtaaccctataccgacgaccgaacgtaccggtaactacgttaccgtagtaaacggttacgttacggtacttaaggttttaacttacgttacgttaaccaaacgttagttggttacggttacgtacgttacgggtacccgttacgggtaaacccggtttccgggaccccggtaacgggggtaaccctaaccgggtaagggttacggtaacggttacgttaacgggaaccgggttaaccggttaaacgttcgggttaccggtaccggtttacggacccgttaccgttaacgtttccgtttaccggttactttaaccccgg

SEQ ID NO: 91807 - DNA, 656 bp, Homo sapiens
  misc_feature: GYAE6OF02GYGQK.5.57.F02.1.454.CMB.1.raw
  modified_base (153)..(153): a, c, t, g, unknown or other
  misc_feature (153)..(153): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagagccaccctctcctgccgagggccagtcaagaactagttggtacacaacgttagcctggtaaccaaacaaaaacctggaccagccctacccagtacctcctactatttactcgttacactccaccgacggccactgactccgtaccaacacgtattcgagtcggcgagtacgggtctagggacagtacttcacgttccacacctactacgacgtacaacggtctaacgacgtacgttagaaacgttacgttcggtacttaacgtttttacgttaaccttagttaaccgtaaactaagttcggttacggtacgtagggtaccgtacccgttaccggtaaccgggttccggacccgtaaggggaccctaagtaggtcggtacttagtccggaacggtacggtaacgttggtacgccgttacgaccgtaccttacgttcgttcggttaccttccg

SEQ ID NO: 91808 - DNA, 569 bp, Homo sapiens
  misc_feature: GYAE6OF02IFHEH.5.57.F02.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggganagacgccaccctctcctgcagggccagtcagaacngttggagcaacttagcctaggtaaccaacaaaaacctggaccagcctcccagacctcctctatttactcgttcactccaaccgagggccacgtgactcgtacccaaccagacttcagtgacaggacgggtctgggacagacttcagtctcacatcgagcagcgtacagtctagaagtacgttggcttagtttattactagtacaatagttgtaggtcaggtcgcctacggtaacgttccgacccgtaagggaccaacgtacgtagacttacgtccgaagggtacgtaaccgtggtcgacgtcgacctacctacgttcgttcgtactttaccg

SEQ ID NO: 91809 - DNA, 687 bp, Homo sapiens
  misc_feature: GYAE6OF02I513Z.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctcagccatcctgtctgtgtctccgagggganagacgcccacccttctcctgccacgggccagtcaagaactagttggtagactaacgttagccgttacggtaaccaaaaccaaaaaaccgtcggacccaacggcccccttaccccgacggaaccttccccttacttaagttttaacttccgtttacctaacttaccccaaccgtacgggaccacgttagtactcgtaccccaacagtacttcgagtcggactaaggtcgggtcgtagggactagtacttacgtacgtctaccgactactccagactacgacgtacagtcgagtaacgtacgttgtacttagtttattaccgttagtactaaacgtaagttggtacgtacgtaggtcgtacccgttacggaaccggtttcccggaccggtaaccggaccgtaacgtaggttacggacgtacgtacgtaacgggacgtaaacgtggtaccgtagacgaccctaacgtaccgtcgttacgttcttaaccg

SEQ ID NO: 91810 - DNA, 762 bp, Homo sapiens
  misc_feature: GYAE6OF02IXLJJ.5.57.F02.1.454.CMB.1.raw
  modified_base (153)..(153): a, c, t, g, unknown or other
  misc_feature (153)..(153): n is a, c, g, or t
  modified_base (205)..(205): a, c, t, g, unknown or other
  misc_feature (205)..(205): n is a, c, g, or t
  modified_base (361)..(361): a, c, t, g, unknown or other
  misc_feature (361)..(361): n is a, c, g, or t
tcagatcagacacgcacgaccggtgctcgatttagctcgatatagttgggtttgggggaggaactgctcagttaggacccagacggaaccatggaagccccagcgcagcttctcttcctctgctactctggctcccagataccggttgggganatcgtgatggacgcagtctccagccatcctgtctgtgtctccgaaggggganagacgcccacctctcctggccgacgggccaggtcaacgaactagttggacgctaacgttcgcctacggtaaccaaaactaaaaaccgtcggaccacgcctaccaacgtacctacctactactttacgtcttccactacccacgacggacctacgtntacgtccgtaacccaactagtattaccgagtcgacgaaggtacgggtcgtagggtacaacgtaccgttactaacgtcctaacgacctaactcgaacggtacgaacggtacggttaacccgacgttaccgtaacgggttaaacgtaacggttacggtaaccgttttagttttaaaccgttacgttaacggtaaactaaacgtacggtttacgggtcggttacgttacgggttaccggtacccgtttaacgggtaacccgggttaccgggtaacccgacggggtaaaccacgggtaagttaccgggattacggtaccggtaacggtaaccggttacggttagtaccggtacggacccgttaccggaaccctttaacggttaccgttccgttaaccgtttaccg

SEQ ID NO: 91811 - DNA, 709 bp, Homo sapiens
  misc_feature: GYAE6OF02F4WUQ.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagccaccctctcctgcagggccagtcagaactagttggtagctaacttgcctaggtaaccaaacaaaaccgtggacccagcccctacccagacctcctctatttactcgttacactcccaccgacgggccacgtgactcgtaccccaacagtactacagtcggacaagggtacgggtcgtacgggacaggtaccttcgagttccctaccaacctagtaccgacggtaccgacggtacccgtaacctaggtaccgttaaggaaaccggttacgttcgggtaacctttaagttttaacgttaactcggttaaacctaaacgttaagtttacggttaggttacgtaacggtccggttacccgttaccgggtaaaccgggttcccgggaacccgtaaccgggaacccgtacgggtaacggtacgggtacttacggtaaccggtaacgggtaccgaacgttcgggtacggtaccgcgtaccgaaccgttcgtacttcggtacccttaccg

SEQ ID NO: 91812 - DNA, 517 bp, Homo sapiens
  misc_feature: GYAE6OF02IQH3F.5.57.F02.1.454.CMB.1.raw
  modified_base (473)..(473): a, c, t, g, unknown or other
  misc_feature (473)..(473): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (489)..(489): a, c, t, g, unknown or other
  misc_feature (489)..(489): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
  modified_base (497)..(498): a, c, t, g, unknown or other
  misc_feature (497)..(498): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (511)..(511): a, c, t, g, unknown or other
  misc_feature (511)..(511): n is a, c, g, or t
  modified_base (514)..(515): a, c, t, g, unknown or other
  misc_feature (514)..(515): n is a, c, g, or t
tcagatcagacacgcacgaccggtgctcgatttagctcgatatagttgggtttgggggaagaggaagactgacggtcccccaggagtccagagtgcgtcgcaagtattggcagtgtgaaatttgacaccttatatgcagactctgtgaggggccgcttcaccgtgtccagagacaactccaagaacgccgtctatttgcagatggacagcctgagagtcgacgacacgggcatctattattgtacggcggccgagcaatactctcttactttctggagtcaggagtcccggtcacgtgtctcctcagcctccaccacggcccatcgtcttcccctgccacctctccaacgacgcacctctcggggcacgagccgccgtcgggctcgcctcggtacaacggaccttccgtcccgttcgtccgtgacgtcgtgacggtccgggcgtcggacgaacggtcgtacacgtagctcgangtncngtacgctcgtncgncgncnncngngncncnctnctnntc

SEQ ID NO: 91813 - DNA, 602 bp, Homo sapiens
  misc_feature: GYAE6OF02GEHO9.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggagcaacttagcctggtaaccaaacaaaaaacctggaccagccctacccagacctcctacatttatcgttacactcccaccacgggccactgactcgtacccaaccagacttcagtggacaggagggtctgggacaggactcgagtctacacctatcagcagcgtacagtctagaacgtacttggaccttaaggttttacttaacgtcggttaactaaaccgtaagttcggttaggtactagggtacgtacccttacggtaaccggtttccggacccgtaagggacccaagtacgtaggtactagtaccgagggtaacccaagttcgaggtacctaggaccctaccagttcttgtaccttaccg

SEQ ID NO: 91814 - DNA, 628 bp, Homo sapiens
  misc_feature: GYAE6OF02JMWPB.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (221)..(221): a, c, t, g, unknown or other
  misc_feature (221)..(221): n is a, c, g, or t
  modified_base (449)..(449): a, c, t, g, unknown or other
  misc_feature (449)..(449): n is a, c, g, or t
  modified_base (505)..(505): a, c, t, g, unknown or other
  misc_feature (505)..(505): n is a, c, g, or t
  modified_base (574)..(574): a, c, t, g, unknown or other
  misc_feature (574)..(574): n is a, c, g, or t
tcagatcagacacgcacgaccggtgctcgatttagctcgatatagttgggtttgggggaggaacgtgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctccngcgagggccaggtcacgaactgttgggagcctaaacttcgccgtacggtaaccaaacaaaaaccgtcggaccacggccctacccgacgtacctccctactaatttacgtcgttaccactcccaccgacgggtcccacttgacttccgtacccaaccgaagtacttacgtacgtacggacgtaggcggtcgtagggacaggtacttcgacgtctacaccactcgacganacgcgtacagtactagaactgttcgactattagtcttagtacaatgtcgtggtacnggttcgacccttaggtacttccggaccgtcggaaccacgtacgtggacgtacgtcgtaacggggtaacncggttacggaggttccgtacggtacctaccgaaccttggttactaccgttaccg

SEQ ID NO: 91815 - DNA, 609 bp, Homo sapiens
  misc_feature: GYAE6OF02FO2B4.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgtcactccaccagggccactgatcgtacccaaccagtattacagtggcagagggtctgggacagacttcagtctcaccatcagcagcgtacagtctgaaagtacgttggctagttttaattacctagtaccaaactaatggttagggttacaaggtcggtacccgttaccggtaaccggtttccgggaccccgtaacgggaacccgtaaccgagggttacgggattaacgtcggtaacgggaccgtaaaccggttggtcgggtaccgttacggcctaaccccgtaggttcccttcggtacccttttacccg

SEQ ID NO: 91816 - DNA, 657 bp, Homo sapiens
  misc_feature: GYAE6OF02ICWTO.5.57.F02.1.454.CMB.1.raw
  modified_base (203)..(203): a, c, t, g, unknown or other
  misc_feature (203)..(203): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccggttggggagatcgtgatgacgcagtctccagccatcctgtctgtgtctccgaggggganagacgccaccctctcctgcagggccagtacagaactagtttggagcaacttacgccgtaggtaaccaaacaaaaaaccgtcggaccacgcccctcccagtacctcctactatttactcgtttcactccgaccgacgggccactgtactcgtaccccaaactacgtattacgagtggaccgaggacgggtcgtcgggaacaggtacctttgacgttcctaccgaacctagtaccaggacaggtaccgttaacgacggttctaggaaacggtacgttaggacgttaagttttaacttacgtagttaacgataaagttcggtagtacgtaggtccggtacctacgggtaccgttaccggaccggaacggaccgaacgtacgtacggacttacgaccggtaaggtaccgtaacgtcggtacggcgtacgccgactaacgttcgttacggttcttaccg

SEQ ID NO: 91817 - DNA, 498 bp, Homo sapiens
  misc_feature: GYAE6OF02H1I5M.5.57.F02.1.454.CMB.1.raw
  modified_base (201)..(201): a, c, t, g, unknown or other
  misc_feature (201)..(201): n is a, c, g, or t
  modified_base (457)..(457): a, c, t, g, unknown or other
  misc_feature (457)..(457): n is a, c, g, or t
  modified_base (468)..(468): a, c, t, g, unknown or other
  misc_feature (468)..(468): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccacctctcctgcagggccagtcagaacattggagcaacttgcctggtaccaaacaaaaaacctggaccagcctcccagactcctcatttatcgttcatccaccagggccactgatcgtcccaaccagattcagtggcagagggtctagggacagacttcagtctcacatcagcagcgtacagtctgaagtactggctagtttaatactgtacaacaatgtgtcagtgcctcgaacggttcgccaggaccanagtgatatcgnggacgactgtgctgcaccatctgtcttacg

SEQ ID NO: 91818 - DNA, 687 bp, Homo sapiens
  misc_feature: GYAE6OF02II36O.5.57.F02.1.454.CMB.1.raw
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (245)..(245): a, c, t, g, unknown or other
  misc_feature (245)..(245): n is a, c, g, or t
  modified_base (353)..(353): a, c, t, g, unknown or other
  misc_feature (353)..(353): n is a, c, g, or t
tcagatcagacacgcacgaccggtgctcgatttagctcgatatagttgggtttggggaggaactgctcagttaggacccagacggaaccatggaagcccagcgcagcttctcttcctcctgctactctggctcccagataccgttgggagatcgtgatgacgcagtctccagccatcctgtctgtgtctaccgagggganagngccacccgtctccgngcaggccaggtcaagactagttcggancaaacttgcctaggtaaccaaaccaaaaaccgtggccaagcctccgaagacctcctactatttactccgttactactccaaacgcggccactgactcgtacccaaacngtactcgagtcggctaaggacgggtcgtcgggaacacgtaacttcgacggttacctccaacgatacacgacgacgtcgtaacgtagtactagaacgtacgtttacggactttaagtttacttacgttacgtacgtaaacgttaagttcggtaggttacctagggtttaccgacccgtttacgaaaccggtttcccggtacccgaccggggtaaaccctaaccggtaacggttacggtacgttaacgttacggaacggtaccggtaaccgttacggtccggttaaccggttacgcccgtaaccgttaaccgtttcgtaccggtttcccgttaacg

SEQ ID NO: 91819 - DNA, 576 bp, Homo sapiens
  misc_feature: GYAE6OF02GH018.5.57.F02.1.454.CMB.1.raw
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (243)..(243): a, c, t, g, unknown or other
  misc_feature (243)..(243): n is a, c, g, or t
  modified_base (404)..(404): a, c, t, g, unknown or other
  misc_feature (404)..(404): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctacccagataccggttggggagatcgtgatgacgcagtctccagccatcctgtctgtgtctccagggganagagcccaccctntcctgcagggccagtcagacattggancaacttgcctggtaccaaacaaaaacctggaccagcctcccagacctcctcatttatcgttcactcccaccgagggaccacgtgatcgtaccccaaccagacttcagttggcaggagggtctagggacagacttcgagtctacaccatcagcagcgtaacngtctagagtacttggctagtttatactgtacaacgatggtcgtacagtcggccttacgaacgtttccgggacctaacgggaccctaacgagtcgggtaattactacggacgggaaccgtaacgtggtacggtacgtacggacctaaccgtagtttccttaggtcctttaccg

SEQ ID NO: 91820 - DNA, 518 bp, Homo sapiens
  misc_feature: GYAE6OF02FFWLT.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (240)..(240): a, c, t, g, unknown or other
  misc_feature (240)..(240): n is a, c, g, or t
  modified_base (463)..(463): a, c, t, g, unknown or other
  misc_feature (463)..(463): n is a, c, g, or t
  modified_base (472)..(472): a, c, t, g, unknown or other
  misc_feature (472)..(472): n is a, c, g, or t
  modified_base (493)..(493): a, c, t, g, unknown or other
  misc_feature (493)..(493): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctntcctgcagggccagtcagacattggancaacttgcctggtaccaacaaaacctggccagcctcccagactcctcatttatcgttcatccaccaggccactgatcgtcccaaccagattcagtgcagagggtctgggacaggacttcgagttcctacaccatcagcagcgtacagtctagaagtacgttggactagttttatactgtacaacagtgtgtcagtgacctacgacgttccgaccgaggacccngacgtgtanactcgaaggtccaacttcggngctcgacaccgtatccgtgttctac

SEQ ID NO: 91821 - DNA, 655 bp, Homo sapiens
  misc_feature: GYAE6OF02FXNUX.5.57.F02.1.454.CMB.1.raw
  modified_base (204)..(204): a, c, t, g, unknown or other
  misc_feature (204)..(204): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgccaccctctcctgcgagggccagtcagaactagttggtagcaacttgcctggtaacccaaacaaaaacctggaccacgccctacccagacctcctctatttactccgttcactcccaccgacgggccactgactcgtaccccaactacgtacttacgaggtcggacgaggtagggtcgtaggggacaggtacttacgagtcctccacctactcagcaacgcgtacacgtctaggaacgtacgttggactagtttacttacgtagtactaaacgtaagtgttacggtctagggttcggtacccgttacgggtaaccggtttccgggacccgtaacgggtaaccctaacggtacggtaggtactacggtacggaacgggtacccgtaacggttcggtacggtaccgttacggccgtaacccgtagttccgtttaccgttctttacccg

SEQ ID NO: 91822 - DNA, 707 bp, Homo sapiens
  misc_feature: GYAE6OF02IW8XF.5.57.F02.1.454.CMB.1.raw
  modified_base (202)..(202): a, c, t, g, unknown or other
  misc_feature (202)..(202): n is a, c, g, or t
  modified_base (241)..(241): a, c, t, g, unknown or other
  misc_feature (241)..(241): n is a, c, g, or t
  modified_base (249)..(249): a, c, t, g, unknown or other
  misc_feature (249)..(249): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccaccctctcctgcgacgggccagtcaagaacngttgggancaacttacgcctaggtaaccaaacaaaaacctggaccagcctaccagacctcctactaatttctaccgttacactccaacgacggtacctacgtgatcccgtacccaaccagtacgttacaggtacggacgaaggtacgggtcgtacggggaacacgtacgttacaaggttcctaccgtaccgagtaccgagaccgtacgtaccgtaacgtacgttacctaggtaacgtacggttaacggtaccttaaggttttaacttaacgttaacgtttaacgaaaccgtttaagttacggttcggtaactaacgggttaccggtccctaacggtaaccggttaccgggtacccgtaaccggggtacctaaccggtagttcggtaacgttacgtaccggtacgggtacgtaacgtggttacggacgtacggccggtaacctaggttccgttacgttacgtacccg

SEQ ID NO: 91823 - DNA, 665 bp, Homo sapiens
  misc_feature: GYAE6OF02HLWGE.5.57.F02.1.454.CMB.1.raw
  modified_base (438)..(438): a, c, t, g, unknown or other
  misc_feature (438)..(438): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagacgagcccaccctctccctgcgacgggccagtcaacgaactagttgggtagcctaaactttagccttacggtaacccaaaaccgtaaaaaaaccgtcggacccaacggaccccctacccaacgtaccctccctactacttttactccgttacacgtcccaaccgacggcctactgactacgtacccaaccgtagtattacgagtaggcgagtagggtcgtgggaactagacttacngttactcacctatcagcacgtacgtacacgtcgagaacgtacgttggtacttagtttactaacgttcgaactaaacgtatttacggtagtacgtagttacgtacccgttacggtaaccggtttcccggaacccggtaacgggtaaccacggtaggtagggacttacgtacggacggtacgtaacggtggtacgcggtacaccgactacgttcgttcgtacgtttacg

SEQ ID NO: 91824 - DNA, 558 bp, Homo sapiens
  misc_feature: GYAE6OF02G7MO0.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcagggccagtcaagaacagttggagctaacttgcctggtaccaaacaaaaacctggaccacgcctcccagactcctcatttatcgttcactccaccagggccactgactcgtccaacagattcagtgacagaggtctggacagactcagtctacacatcagcagcgtacagtcgtagaacgtacttggactagtttacttactgtacaactagtgtacggtctagtcggtcctacggtaacgtccggaccgaacgggtaccaacgaggtacgtatacgtacgacgggacgtaacgtcggtacggcttacggacctacctacgtccttcgtacttccg

SEQ ID NO: 91825 - DNA, 613 bp, Homo sapiens
  misc_feature: GYAE6OF02IG4Q4.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
  modified_base (247)..(247): a, c, t, g, unknown or other
  misc_feature (247)..(247): n is a, c, g, or t
  modified_base (432)..(432): a, c, t, g, unknown or other
  misc_feature (432)..(432): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggganagacgcccaccctctcctgcagggccaagtcagaacagttggancaacttagcctaggtaacccaaacaaaacctcggaccacgacctcccagtacctcctactacttttactcgttacacttcccaccgacgggcctactgactccgtacccaaaccagtacttcgagtcggacaggacgggtcgtaggacaagtacctcgtacgtctacactatcagcagaccgtanacgtactgaacgacgttggcttagtttattactcgtactaactaagtggtacgtacgtacggtacggtacctcgggtaaaccgttccgggcccgaagggtacccacgtagtagggtactacgtacggaaggtaccggtaatcggtaggcgtacgaccgtaccctagtaccttcgtcttacg

SEQ ID NO: 91826 - DNA, 671 bp, Homo sapiens
  misc_feature: GYAE6OF02GQPXF.5.57.F02.1.454.CMB.1.raw
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgcccaccctctcctgcagggccagtcagaacattggancaactagcctaggtaaccaaacaaaaacctggaccagccctcccagacctcctactatttatccgttacactcccaccgacgggccactgactccgtacccaaccgagtacttacgaggtcggacgaaggggtacgggtcgtggggaactacggtaccttcgacgttcctaccgacctactcgaacgcgaacggtcgtaaaccgtaggtccgtaaggtaaacgtaccggttaggacgttaacgttttacttacgttcgtaactaacgtagttaggtacggtcgtaggttcggtacccgtacggttaacccggttcccggacccggaacgggtacccaaggtacgggtacgtacgttacgtacggcgggtaccgaacggttggtacgggtctacggacctaaccgtacgttcttaccgttaccttccg

SEQ ID NO: 91827 - DNA, 617 bp, Homo sapiens
  misc_feature: GYAE6OF02GST4S.5.57.F02.1.454.CMB.1.raw
  modified_base (204)..(204): a, c, t, g, unknown or other
  misc_feature (204)..(204): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
tcagatcagacacgcacgaccggtgctcgatttagctcgatatagttgggtttgggggaggaactgttctcagttaggacccagacggaaccatggaagccccagcgcagcttctcttcctcctgctactctggctcccagataccggttggggagatcgtgatgacgcagtctccagccatcctgtctgtgtctcgagggganagacgccaccctctcctgcgagggccagtcagaacngttggancaacttgcctggtaaccaacaaaaacctggccagccctcccagacctcctctatttactcgttcactccaccgagggccactgactcgtacccaaccagtacttcaggtcggacaggaggtcgtagggacagtacttcgacgtctcaccatcagcacgtcgtacagtctagaagtacgttggacttagtttacttacgtacgttacaactattggtacgtacgtaggtcggaccgtacgtaaccggttccggaccgtaacgggaccaacgtagggtacggtacgttacgtacggtaacgggtaccgtaacggttggtaccgggtacgtacggtaccaaccggttacttccggttacgttcctttaacccg

SEQ ID NO: 91828 - DNA, 577 bp, Homo sapiens
  misc_feature: GYAE6OF02FXVAS.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggcagcctcccagactcctcatttatcgttcatccaccacggccactgactgtccccaaccagattcagtcggacaggagggtctaggggacaaggaccttacacgtctccaccatccgagtcagacgtacagtctagaagtacgttggctagttttaacttactcgtactaacaattgtaggtacaggtcgcctacgaacgttccggacccaacgggtaccacgacgtggtactagtaccgaagggtacccgaacgttcggtacggaccgtcggtacccgaaccgagttccgtgttaccctttacc

SEQ ID NO: 91829 - DNA, 732 bp, Homo sapiens
  misc_feature: GYAE6OF02FZUWE.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgcagggccagtcagaacagttggancaacttagcctggtaaccaacaaaaacctggaccagcccctacccagacctcctactactttactccgtttcactccctaaccgacgggtacccacgtgactcgtaccccaactagtacttaccgagtcggacagggtaacgggtctacggggaacaggtacttacgacgttccttaccgaacctacgtaccgacggtccaacgggtaccgttaacaggttacctagggaaaacgttcgttacgggtccttaaagggttttctttaacgttacgtaacctaaacgttacgtaggttaaccgggtacttagggttaacccgggtcccgttaaccgggtaaacccgggtttccgggtaacccccgaaacgggtaaccccgtaaggaccgggtttaagggaccctttagaaccggtaacgggtccggttaaccggttacggtaccggtacttcgggaccaacccgttcgtcggttaccgtttccttaaccg

SEQ ID NO: 91830 - DNA, 608 bp, Homo sapiens
  misc_feature: GYAE6OF02GXUQ7.5.57.F02.1.454.CMB.1.raw
  modified_base (352)..(352): a, c, t, g, unknown or other
  misc_feature (352)..(352): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgccaccctctcctgcacgggccagtcagaacattggagcaactgcctgtaaccaacaaaaacctggaccacgcctcccagacctcctctatttactccgttcactacccaccgacgggccacgtcgtactcgtaaccccaacctanacttcacgtggaccgaggtacgggtccgtagggaccgagtacttcacgtcctacaaccatacgagtcgaacgtcgtaacagtcaggaatacgtggactagtttacttactgtaacaacgtattggtagtccgaggtccgaccgttaccggaacgttccggacccgtaagggacccaacgtagtacgattacgacgagggtacccgtaacgttggtccggtcgtacggactacccgtattccgttacgtccttaccg

SEQ ID NO: 91831 - DNA, 685 bp, Homo sapiens
  misc_feature: GYAE6OF02IRVBB.5.57.F02.1.454.CMB.1.raw
  modified_base (153)..(153): a, c, t, g, unknown or other
  misc_feature (153)..(153): n is a, c, g, or t
  modified_base (236)..(236): a, c, t, g, unknown or other
  misc_feature (236)..(236): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagagccaccctctcctgcagggccagtcagaacnttggagcaacttagcctaggtaaccaaacaaaacctggaccagccctcccagacctcctctatttactcgttcatcccaccgacgggaccacgtgactcgtacccaacagacttacgaggttcggacgtaggtacggggtcgtagggaacctacggtaccttcgaacttccgtacctaaccacgtaccacgacgacgtaccgtaactacggtactaggtaaacgtcgttcgggaacttaggttttacttaacgtacgttacaaacgttagtcggtaggtacgtaggttaccgggtaccgttaaccgggtaaccggtttccgggacccgggtaacgggtaaaccctaggtaccggggtagtacgtaacgtcggaacgggtaccggtaaaccgttgggtacggtcctacggttacccgaccgttaagttccgtttacgttacccgttaccg

SEQ ID NO: 91832 - DNA, 717 bp, Homo sapiens
  misc_feature: GYAE6OF02IT0CP.5.57.F02.1.454.CMB.1.raw
  modified_base (215)..(215): a, c, t, g, unknown or other
  misc_feature (215)..(215): n is a, c, g, or t
  modified_base (260)..(260): a, c, t, g, unknown or other
  misc_feature (260)..(260): n is a, c, g, or t
  modified_base (269)..(269): a, c, t, g, unknown or other
  misc_feature (269)..(269): n is a, c, g, or t
  modified_base (659)..(659): a, c, t, g, unknown or other
  misc_feature (659)..(659): n is a, c, g, or t
  modified_base (690)..(690): a, c, t, g, unknown or other
  misc_feature (690)..(690): n is a, c, g, or t
tcagatcagacacgcacgaccggtgctcgatttagctcgatataggttgggtttgggggaggaactgctcagttaggacccagacggtaaccatggaagccccagcgcagcttctcttcctcctgctactctggacttcccgagagtaccgttgggggacatcgtgtattggacgcagtctccagccatcctgtctggtcggtctccgagggganagacgccgaccctctcctggccgagggccccagtcaacgaacctntttgggacnctaacttgtcctggtaaccaacaaaacctgccagccctccgacgacctaccgtctacgtttacgtccgttacacgtcccaaccgtagggtacccgaattcggtaactcggttaacccctaaacccagtaacttaccacgggttacggaccgtaagggtaccggggttacgtcggggtaactaggggtaccttacgtaacggtaccttaccgacccgtactaccgtaacgggtaccaccggtaccgttaaccgacggtttacgtagtaaaacgtcggtttaaccgggactttaaacggtttaacttacgtttacggtaacctaaacgtaactttgggtacggtactacgggtcgggttacctaccgtaacggttcgtaccagggtacacgngtacgattcgacgtcggaagacgtggtacgngacgtaccgacctgtcctgtcttaccg

SEQ ID NO: 91833 - DNA, 582 bp, Homo sapiens
  misc_feature: GYAE6OF02JJLAW.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (239)..(239): a, c, t, g, unknown or other
  misc_feature (239)..(239): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccacctntcctgcagggccagtcagacattggancaacttagcctggtaaccaacaaaaacctggaccacgcctcccagacctcctcatttatcgttacactccaccacgggccactgactcgtacccaaccagattcagtggcagagggtctgggacacgtacttcagtctacaccatcagcagcgtacagtctagagacttggactagtttaacttctgtacaacaattgtacggtcaggtcgacccttacgaacgttccggtaccgacgggtacctaacggacggttacgacgttactacggtacgggtaccgtaaccgttagggtacggttacgtaccgaccgtattaccggttcgttaccttcgttaacccg

SEQ ID NO: 91834 - DNA, 612 bp, Homo sapiens
  misc_feature: GYAE6OF02IXET1.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
  modified_base (371)..(371): a, c, t, g, unknown or other
  misc_feature (371)..(371): n is a, c, g, or t
  modified_base (392)..(392): a, c, t, g, unknown or other
  misc_feature (392)..(392): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccacctctcctgcagggccagtcagaacattggtagcaacttgcctggtaaccaacaaaaacctggaccagcctcccagacctcctacattttacncgttcactccaccgacgggccactgatcgtacccaaccagacttcgagtcgcaggacgggtctagggacncgacttcgaagtctacacctntacagcagtcgtacagtctagaagtacgttcggacttagtttacttacgtcgtaccaaactaagttcgtcgggtacacgggttacgtacccgtacggtaccgttaccggccgtaacgggtacccaagacgggttcgacgttacgtaccggaacgggtaccgtaacgttcgggtcgtcggttaccgaccgtaccgaacgttcggttacggtcctttacccg

SEQ ID NO: 91835 - DNA, 628 bp, Homo sapiens
  misc_feature: GYAE6OF02HBSPS.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (493)..(493): a, c, t, g, unknown or other
  misc_feature (493)..(493): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctctcctgcagggccagtcagaacattggagacaacttagcctaggtaaccaaacaaaaacctggaccagcccctacccagacctcctactattttactcgttcactaccaccgacgggcccaactgactcgtaccccaacgagtacttcaggtcggacgaaggcgggtctggggacagtacttacagtcctacgacctactcaacggcacggaccgttaacacgttacgtagaaacgtaccgttagacttagtttattacgtgttacaactagtgtcggtanaggttcggaccttacgtaaccggttccggacccgtaacgggacctaacggtacggttgaacttagtaccggaacggaccgtaaacggtgggtccgtactacggtacccaccgtaacgttccgttgttccttaccg

SEQ ID NO: 91836 - DNA, 704 bp, Homo sapiens
  misc_feature: GYAE6OF02IPSYQ.5.57.F02.1.454.CMB.1.raw
  modified_base (240)..(240): a, c, t, g, unknown or other
  misc_feature (240)..(240): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtcctccagccatcctgtctgtgtctccgaggggagagcgcccaccctctcctgcacgggccagtcagaactntttggacactaacttgccgtacggtaaccaaacaaaaaccgtggaccacgccctacccaagtacctccctctattttactcgttaccactcccaaccgacgggcccagtcgactccgtaccccaacagtactacgaggtcggacaacgggtacgggtcgtacgggaacctaaggtaccttacgacgttaccctaccgaccctacgtccacggaccacggtaaccgtacgtacgtaccgtagtaaacggtacgtttacggacgtttaagttttaacgttacgttaacttaactaaacgttaacggttcggtacggttacgtacggttacggtcccgttaaccggtaccgggttacccggaccggtaaccgggtacctaacggtaacggtacgtaacttcgtaccggacggtaccgtacgtcggttcggaccgttcgaccgtacttacgtcgttacgtcttacccg

SEQ ID NO: 91837 - DNA, 532 bp, Homo sapiens
  misc_feature: GYAE6OF02GKRXI.5.57.F02.1.454.CMB.1.raw
  modified_base (412)..(412): a, c, t, g, unknown or other
  misc_feature (412)..(412): n is a, c, g, or t
  modified_base (523)..(523): a, c, t, g, unknown or other
  misc_feature (523)..(523): n is a, c, g, or t
  modified_base (527)..(527): a, c, t, g, unknown or other
  misc_feature (527)..(527): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaaccaaacaaaaacctggaccagccctcccagacctcctcatttactcgttcatcccaaccacgggccactgactcgtaccccaaccagtattcgagtggcaggacgggtcgtgggacagtacttcgagtctacacctatcagcagcgtacagtcngaagcttggctagtttattactagtacaactagtgtggtctaggtcgacctacgtaacgttccgaccgacggaccagagtcgatactcgaaggtcgaatggtgctcgcacntctntcttc

SEQ ID NO: 91838 - DNA, 754 bp, Homo sapiens
  misc_feature: GYAE6OF02H6TYN.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgaggggagagacgccaccctctccgtgccgagggccaggtcagaactagttggaagcctaactttacgcctacggtaaccaaactaaaaacctcggaccacgccctcccgaacgtacctcctactatttacgtcgtactacctccaaccgacggaccacgtgtactcgtacccaacgagtacttacgtagcggtacaggtacgggtcgtacgggacgtaacgtaccgtttccgaacgttacctacccgaacctagtccgaacggacccgtacggtaaccgttaaaccgtcggttaaccgttaacggtaaacggtaccgtttagggtaactttaacggtttttaacttaaccggttacgttaaacctaaaacgttaaagtttcgggtaccggtttaagttacccggggttaacggtttaccccgtaacgtaccgggttacccgggttaccccggtaacgggtaacccgtacgtaacggtacgtaagttaacgtaccggagggttaccgtaacggtcgttacggcgttacgaccgaccttagtccgtttagttccgttacg

SEQ ID NO: 91839 - DNA, 575 bp, Homo sapiens
  misc_feature: GYAE6OF02G4E0S.5.57.F02.1.454.CMB.1.raw
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagcccaccctctcctgcagggccagtcagaacattggancaacttgcctggtaccaacaaaaacctggccagcctcccagactcctcatttactcgttcatcccaccgacgggccactgactcgtaccccaaccagattcagtcggcaggagggtcgtagggacagtacttacagttcctaccaccatcgagcagccgtacagtctagaagtcgttgggaccttaagtttacttagtacgtaactaacgtagttgtacgtcgtggtacgtaccgtacgtaccggtccggaccggtacggaccgacgtagtacgactcgacggacggtaccgtaggtcggtcgtacgtccgcacctcgtcttcgtcttaccg

SEQ ID NO: 91840 - DNA, 545 bp, Homo sapiens
  misc_feature: GYAE6OF02GE2TS.5.57.F02.1.454.CMB.1.raw
  modified_base (303)..(303): a, c, t, g, unknown or other
  misc_feature (303)..(303): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgccaccctctcctgcagggccagtcagaacattggtagcaacttagcctggtaaccaaacaaaaacctggaccagccctcccagactcctcatttancgttcatccaccagggccactgactcgtaccccaaccagtattcgagtcggacaggagggttctaggggaacaggtacttcgacgttctcctaacctatccgagcagccgtaacaggtctgaagtacttgggctaagtttattactgtacaactaagtgtggtctagtcggtcctacgtacgtcggcccaggacccagagtgatagtcgaagggcaacgtgtcgctgccacatctgttctac

SEQ ID NO: 91841 - DNA, 765 bp, Homo sapiens
  misc_feature: GYAE6OF02H1OU0.5.57.F02.1.454.CMB.1.raw
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttggggagatcgtgatgacgcagtctccagccatcctgtctgtgtcctccgaggggagagacgccacccttctcctgaccgcgggccaggtccaaggaaactagtttgggtaacgactaacttagcctaggtaacccaaaaccgaaaaaaccgtcggaccaacgccctacccgtaacgaccttcccttactatttacttccgttctactccaaccgtacgggccctacgtcgtaactccgtacccaaactagttaccttacgacggtacggaccgtagggtacgggttcggtacggggaactaacggtaccttacgaacgttcctaccgaacctactaccgaacggccgaggtaccggtaaacctaggttaccgtacggtaaaacggtaccggtttagggacgtttaagttttaaccgttaaccgtaggttaaccaaaacgttagtcgggtacggttacgtaccgggtaccggacccgtttaacggtaaccgggtttcccggaacggtaaccgggtaacccgaacgacgggttagataccggtacggtaaccgggtacgttaccgtagggtcgtacgtacgacccgtaaccgagttttaccgtacgtttccttacccg

SEQ ID NO: 91842 - DNA, 792 bp, Homo sapiens
  misc_feature: GYAE6OF02I6QG9.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganacgacgccctaccctctcctggccgacggggccctaggtccaagaactgtttcggaagacctaaacgttcggccgttacggtaacccaaaacgtaaaaaccgtcggaccacgaccctacccacggtacctcctacttaactttactcgttactactacccaccgacggacctacgtcgtactaccgtacccaaaccgtagtacttaccgaaggtcggacgacggtacgggtacgtacgggactacgtactttcgaacgtcctacgaccgtatacgacgaccgtaacggtaccgtaactaggtaaccgtaggtaaacgtacggttacgtaacgttaagtttactttaacgtaggttaacctaaacgttaacgttcggtttaccggtaacgttacgggtaccggttacccgttacgggtaaaccggtttacccgggaacccgtaacggggtaaccctaacgggttaacgggtacggtaccgtttaacggaccggtaccgggtaaccggttaaacggttcgggttaaccgtaccggttaaccgttacccgaacccgtttacggttacccgttaccgggttacctttaacccgg

SEQ ID NO: 91843 - DNA, 770 bp, Homo sapiens
  misc_feature: GYAE6OF02JJ5UJ.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
  modified_base (224)..(224): a, c, t, g, unknown or other
  misc_feature (224)..(224): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccggttgggganatcgtgatcgacgcagtctccagccatcctgtctgtgtctccgagggganagacgccctacccttctcccngcgacgggcccagtacaagaactagttgggtaacactaaacttcgtccgtacggtaaacccaaaacgtaaaaaccgtcggaccaccggtacccttaccccgaacggtacctccctaccttaacttttaactccgtttctacttacccaaccgtacggtacctacgtacgtacgtaccgttacccctaaaccgtacgtaacgttaccgtacggttacggaccgaaacggggttacgggtccgttaacggggaacgtaacggtacgtttaccgacgttccttaacccgacctaacgtcctacggtaccgtagacccggttaaacgcgttacctaaacggtaacggtacgttacgggtaactttaggtttaacttaacgtacgttaaccaaagttcgttacgttacgacgttagtccggtaccgttaacggaccggttaccggacccgtaggaacccgtaagtgtaacggtcttaacggtacggtaacggtacggtactcgggtacgttacgaaccttcgtaacgttcctcgtttacctcttaacccgg

SEQ ID NO: 91844 - DNA, 870 bp, Homo sapiens
  misc_feature: GYAE6OF02HXF9K.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (253)..(253): a, c, t, g, unknown or other
  misc_feature (253)..(253): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccacccttctcctgccgagggcccaagtccaagaactagttggtancctaaacgttagccttaggttaacccaaaaccgtaaaaaacccgtcgggacccaacggaccccttaccccgaacgtaaccttccctaccttaacttttacttccgttttaccaacttaccccgaacccgtacgggtacccctaacgttacgtacttaccggtaccccaaaacccgtaacgttactttaccgaacggtttcgggaccgtaacggggtacggggttaccggttacgggggtaaaccctaacgggttaaccctttaccggtaacgtttacccgttaacccgtaaacccgtaacgtttacccgaaacggtaccgtaaacggtacccggttaaccgtaacgggtttacccgttaaggtaaaaccggttaaccgtttacggggtaaccgtttaacgtttttaaactttacccgtaaggttaccctaaaacgtttaagttggttacggttacgtaacggtcgggtacccttacgggtaaacccggtttccgggaccccgtaacggggtacctaaccgtagggttacggtacttaacggtaccggaaggtacccggtaaacgttggtacggccgttcggaacctaccgtaccgttacgttccgttacgttacccg

SEQ ID NO: 91845 - DNA, 774 bp, Homo sapiens
  misc_feature: GYAE6OF02I2EU3.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtcgtctccgaggggagaggacgcccaccctctcctgccagggccaggtcagaacattcgggtagactaacttacgccgttaggtaaacccaaacgaaaaacccgtcgggacccaacgtcccctaccccgagaaccctccctactattttactccggttacactcccgaaccgtacgggaccactgactccgtacccaacgacgtatttcgaggtacggctagggtacgggtcgtaggggaacctaggtacctttaccgaagttaccctaccgtaaacccgtataccgacggacccgtaggtaacccgtaacgtaacggttacgttaacggtaaacgtaccgttagggtaacctttaaggttttaaaccgttttaccgtaggttaaccttaaaaccgttaaacggttcgggtttacggtttacggtacggttaccggtcccgtttaaacccgggtaacccggtttcccgggaccccggtaaacggggtaccccgaacggttacgggtacggtacgttacgtaccggaacggggtaccttacgggtggttacgtacgttcggacctaccgtactcgttacctcgttacc

SEQ ID NO: 91846 - DNA, 617 bp, Homo sapiens
  misc_feature: GYAE6OF02GZOR8.5.57.F02.1.454.CMB.1.raw
  modified_base (201)..(201): a, c, t, g, unknown or other
  misc_feature (201)..(201): n is a, c, g, or t
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgccagggccagtccagaactattggancaacttagccttaggtaaccaaacaaaaacccgtggaccacgccctacccagacctcctactactttatccgttcaactcccaacgacggccacgtgactcgtacccaacacgtacttcgagttcgcgtaggacgggtctagggacaggtacttacgagtacctcaccgatacgacgcacgtcgtaacagtcgtagaacgtacttggctaaggtttatttacgttagtacaactagttcggtacgttacgaggttcgaccgtacggtaccggttcgacccgtagggacccagtacgtaggtactacgtaccgagggtaccgtaacgtggaccggtacgtacgccgtaaccgtagttccgttagttccttaacg

SEQ ID NO: 91847 - DNA, 621 bp, Homo sapiens
  misc_feature: GYAE6OF02FLI45.5.57.F02.1.454.CMB.1.raw
  modified_base (153)..(153): a, c, t, g, unknown or other
  misc_feature (153)..(153): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagacgccaccctctcctgcagggccagtcagaacagttggagactaacttgcctaggtaaccaacaaaaaccctggaccacgcccctacccagacctcctactattttactcgttcactcccaccacgggccactgactcgtaccccaacctagtattcaggtcggacagggacgggttcgtcggggactagtactacacgtcctaccacactcgacgcacgccttaacgagtactaggaacgtacgttaggacttagtttacttactacgtactaactagttcgtaggtacgtggttcggtacccgtacgtaccggttccggacccgtaacgggaccacgtagtacggtactaggtcgaacgggtcgtaacgtggtacgtacgtacggaccaccgtacttccgtacgttccttacccg

SEQ ID NO: 91848 - DNA, 623 bp, Homo sapiens
  misc_feature: GYAE6OF02G7X94.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcacgggccagtccagaacagttggtagcaacttacgcctggtaaccaacaaaaacctggccaacgccctcccagacctcctactactttactcgttcactccctaaccgacggggcccaacgtcgatcgtaccccaaaccagtacttcaggtcggacaggacgggtcgtagggacagtaaccttcgaacgtctacacctatcaacgctacggctacagtctagaagtacgttcggtactagttttaattactacgttaccaaatagtgttggtactaggtccggtcctacggtaaccggttccgggacccgacgggtaccacgtacgggtaggtacgtactacggtaacgggaccgtaaacgttggtacggtctacggactaccctacgtccgttgtaccttccg

SEQ ID NO: 91849 - DNA, 583 bp, Homo sapiens
  misc_feature: GYAE6OF02I7ELJ.5.57.F02.1.454.CMB.1.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (361)..(361): a, c, t, g, unknown or other
  misc_feature (361)..(361): n is a, c, g, or t
  modified_base (426)..(426): a, c, t, g, unknown or other
  misc_feature (426)..(426): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggggagatcgtgatgacgcagtctccagccatcctgtctgtgtctccagggganagagccaccctntcctgcagggccagtcagaacattggagcaacttgcctggtaccaacaaaacctggaccagcctccccagacctcctacacttttatccgttcacttccaccagggccacctgatcgtacccaaccagattcagtggcagaggtcgnggacagctcatctcacactcagcagcgtacagtcctagaacgtacgttggacctagtttattacngttacaaactagttgtacgggttctaggtacgtccgtacgtaacggttccggcccgaacgggacccaagtcgtacggtacttagtacgtacgggtaacgtacggtaggtcgggtaccgtcggaccgtacctaacgttcgttaccggttacttacccg

SEQ ID NO: 91850 - DNA, 592 bp, Homo sapiens
  misc_feature: GYAE6OF02IBUYE.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (337)..(337): a, c, t, g, unknown or other
  misc_feature (337)..(337): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgccacctctcctgcagggccagtcagaacagttggancaattgcctaggtaccaaacaaaaactggaccagcctaccagactcctctatttactcgttcactccacaggccaacgtgactcgtacccaacngtatcagacgcagacgggtctaggacagacttcagtactcaacatcagcaacgcgtaacacgtactagaacgtacgttacggtactaagtttaactacgttgtaacgaaactagttgtacggtacgtacgtacgggtaccctacgggtaaccgttccggaaccgtacgggaaccacgacgtagtacgtacgtacgacggtaaccgtaagtcggtacgacgttacgacctaccgtaagtccgttacgtcttacccg

SEQ ID NO: 91851 - DNA, 632 bp, Homo sapiens
  misc_feature: GYAE6OF02GLFQP.5.57.F02.1.454.CMB.1.raw
  modified_base (244)..(244): a, c, t, g, unknown or other
  misc_feature (244)..(244): n is a, c, g, or t
  modified_base (430)..(430): a, c, t, g, unknown or other
  misc_feature (430)..(430): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgcccaccctctcctgcagggccagtcagaacattgganctaacttagcctggtaaccaacgaaaaactggaccacgcctcccgaagacctcctactatttactccgttcactcccgaccgacgggcctacgtggtactaccgtaccccaaacctagtacttacgaggtggacagggacggtacgtacgggaacaggtaccttcgacgtcctacaccctatacgngacgagtcgtaacgagttaccgtaggaagtacgttcggaaccttagttttaacttacgtacgtaacttaacgtaagttcggttacggtctacggtcggtaccctagggtaccgttcggacccgacggtacacgtaaggtcgtatacgtacggagaacgtacgtaggtcggtcacggtaccacgtacgtcgttacgtcttacg

SEQ ID NO: 91852 - DNA, 646 bp, Homo sapiens
  misc_feature: GYAE6OF02H279Y.5.57.F02.1.454.CMB.1.raw
  modified_base (200)..(200): a, c, t, g, unknown or other
  misc_feature (200)..(200): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggganctaacttagcctggtaccaacaaaaacctggaccagcctcccagacctcctcaatttactcgttcactccaccaggccacttgatcgtacccaacagattcagtggcagaggtctggacacgacttcgagtctcgaccatcacgcacgtcggttaacaggtctagaaagtacgtttcggacttaagtttaattacgttcgtacaaaccgtaattggtacggttcgaaacggttcggcccttaacgggaaaccggtttccgggaccctaacgggggtaccaaaccgtaacggtacgggtaacttaacgttccggaacgggttaaccggtaaaccgtacggtttacggggtccttaccggtaacccgtaacccgtaacgtttcccgttacggttaacccgtttaccg

SEQ ID NO: 91853 - DNA, 730 bp, Homo sapiens
  misc_feature: GYAE6OF02IM5EC.5.57.F02.1.454.CMB.1.raw
  modified_base (151)..(151): a, c, t, g, unknown or other
  misc_feature (151)..(151): n is a, c, g, or t
  modified_base (169)..(169): a, c, t, g, unknown or other
  misc_feature (169)..(169): n is a, c, g, or t
  modified_base (199)..(199): a, c, t, g, unknown or other
  misc_feature (199)..(199): n is a, c, g, or t
  modified_base (689)..(689): a, c, t, g, unknown or other
  misc_feature (689)..(689): n is a, c, g, or t
tcagatcagacacgcacgaccggtgctcgatttagctcgatatagttgggtttggggaggaactgctcagttaggaccagacggaaccatggaagccccagcgcagcttctcttcctcctgctactctggctccagactaccgttgggganatcgtgatgacgcagtcncgagccatcctgtctgtgtctccgaggganagacgcccacctctccgtgcgacgggtccagtcgaagtactagttggaacgctaacgttcgccgtacggtaaccaaacgtaaaaccgttcggaccgacgtacccctacccgaagaaccttccgtacttaactttacgtccgtttaccaccgtttacccgaaccgtacggtacccctacgttcgtaacttacccgtaaccccgtaaccgtaacgttacgttaccgtacggtaccggtaccggtaaggtacgggttccggtaacgggaacgtaacgtaccgttacgacgttacccgaccgtaccctaagtaccgacgtacgtacgtaccgttaacacgggttactaacgaacggttacttagggccttaaagtttacctaacggttcgtaacaaaccttaggttacgcggttactacgggttcgtacccgtacgtaaaccggttcgcccgtaaggaccgtaacaggtacagtaccgttagacggtaccagtnttacgggcttacgacctaagccgtttaacgtgtaccttacg

SEQ ID NO: 91854 - DNA, 592 bp, Homo sapiens
  misc_feature: GYAE6OF02F0GBN.5.57.F02.1.454.CMB.1.raw
  modified_base (201)..(201): a, c, t, g, unknown or other
  misc_feature (201)..(201): n is a, c, g, or t
  modified_base (291)..(291): a, c, t, g, unknown or other
  misc_feature (291)..(291): n is a, c, g, or t
  modified_base (429)..(429): a, c, t, g, unknown or other
  misc_feature (429)..(429): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttgcctggtaccaacaaaaacctggccagcctacccagactcctnatttatcgttcatccaccagggccactgatcgtcccaacagacttcagtggacagagggtctgggacagtacttcagtctacgacatcagcagcgtacagtctagaacgacttggactagttttatactagtacaaanattgtaggtacaaggtggacccttagaaccggttccggaccgtaacgggtaacccaacgtagggttacgaacgttacgtaccgaacgggtaaccgtaccgttacgggtacgggtactacggtaccctaacccttaaggtacccgtttagtacccgttttaacc

SEQ ID NO: 91855 - DNA, 587 bp, Homo sapiens
  misc_feature: GYAE6OF02FUVE1.5.57.F02.1.454.CMB.1.raw
  modified_base (436)..(436): a, c, t, g, unknown or other
  misc_feature (436)..(436): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggacgactaacttagcctaggtaaccaaacaaaaaacctggaccacgcctcccagactcctcatttatcgttcactccaccaggccactgatcgacccaacagtattcagtggcagacgggtctgggacagacttcacgtctaccacatcgagcagcgtaacagtctagtaaacgacgttggacctagtttaattaccnggttacaaactaagttgtaggtactaggttcggccttaccggaacgttccggacccgacgggaacccacgaggtcgagttacgtacgaacggtaccgtaaccgtggtacggtcgtacggacctaaccgtacttcgttcggttccttaaccg

SEQ ID NO: 91856 - DNA, 586 bp, Homo sapiens
  misc_feature: GYAE6OF02IEY4N.5.57.F02.1.454.CMB.1.raw
  modified_base (200)..(200): a, c, t, g, unknown or other
  misc_feature (200)..(200): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagatcgtgatgacgcagtctccagccatcctgtctgtgtctccagggganagagcccaccctctcctgcagggccagtcagaacattggagcaacttagcctggtaaccaacaaaacctggaccagcctacccagactcctactatttactcgttcatacccacgacgggaccactgactcgtacccaaccagacttacacggtcggacaggtacggtcgtgggactaggtaccttcgacgtctccacctatcacgcaacgtcgtaacacggtctaggaacgtacgttcggacttagtttacttacgtacgtactaacgtaagttcgtagtctagtcgtactccgtaacgttccgcccgacggacctagcgtagatatacggtaggaccgaagttcggcggacttcggacctacctcttacgttcggttaccttcg

SEQ ID NO: 91857 - DNA, 831 bp, Homo sapiens
  misc_feature: GYAE6OF02HPK58.5.57.F02.1.454.CMB.1.raw
  modified_base (203)..(203): a, c, t, g, unknown or other
  misc_feature (203)..(203): n is a, c, g, or t
  modified_base (797)..(797): a, c, t, g, unknown or other
  misc_feature (797)..(797): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgcccaccctctcctgcacgggccagtcaacgaactagttgggtagactaaactttagcctacgggtaacccaaaactaaaaaaaccctcgggacccaaggcccccttacccccaaggtaaccctcccttacctaacgtttttaactccggtttacctaacgttccccgaacccgtaacggggacccctaaccggttcggaacttaccggttacccccaaacccgtagtaacctttccggtaaggtccggtacgaacggtaacggggttccgtacgggggaacctaacggtaaccttacgaacgtttcccgtaccaacccgtaattaccgaacggtaccacgggtacccgttaaacgacggttacctaggtaaaacgtaccgtttagggaaccctttaaggttttaacttaacgtttacggtaaccttaaacgtaaagtttcggttaccgggttaacttacggggttaccggttacccggttaaccggtaacccgggttttaccgggacccccgggtaaggggtaacccaaccggtagggtacggtaacgttaccgttaccgaaggggtacccgaacgttcgggaccggtnacggttaccaccgttactcgttcgtcctttaccg

SEQ ID NO: 91858 - DNA, 808 bp, Homo sapiens
  misc_feature: GYAE6OF02JNEYV.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgaccgacgggtccagtcaagaactgttggacgactaacgttacgccgtaggtaaacccaaaactaaaacccgtggacccacgtcccctacccgaagtaccctccttactaacttttactccgtttaccaccgttacccaaccggccgggtacccctacgttcgaacttccgtaccccaacgttacgtaacttcgaagtcggacgtagggtacggtcgacgggtacacgttacttcgaacgttcctaaccaccgtacgtaccgacggtaccaacggttaccggtaataccgggttaacacgggttaaaaccgtcggtttacggaaccgttttaagttttaacgttaccgtagttaaacccaaacgttagggtttacggtccggtacgttaagggttaccccggttacccgttaacggtaaccccggttaccggacccggggtaacgaacccggttaaccggaagggttagggttaacccaccggtttacccggaaaacgggtaccgttaacggttcccggttacgggaaccttacccggtaccgttaaccgttaacccgtttccgggtttacttacccccgtttaacgg

SEQ ID NO: 91859 - DNA, 699 bp, Homo sapiens
  misc_feature: GYAE6OF02FJYY4.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccaggggganagacgccaccctctcccgtgcaggggcccaggtccaggaacatttgggacgctaacttgcctaggtaaccctaaacaaaaacctggaccctaacgccctcccagacctcctacatttactcgttcactcccaccacgggccacgtgatcgtacccaactagattcgagtgacaggacgggtctaggggactagaccttcacgttcctacacccgatacgacgtctacggcgttaacaggttctaggaaacgtacgtttcgggactaagttttaacgttaccttacgttactaaacctaagttcggttacgggttactacgggttacggtaccccgttcgggtaaaccggttttccgggaaccccgtaacggggtaacccaaacggtacgggttacggaactttacggtaccggtaaggggtacccggaaacggtttcggggtaaccgtcggttaccgaccggtaaccctagttttccggttaccgttcctttacccg

SEQ ID NO: 91860 - DNA, 544 bp, Homo sapiens
  misc_feature: GYAE6OF02HGTTK.5.57.F02.1.454.CMB.1.raw
  modified_base (200)..(200): a, c, t, g, unknown or other
  misc_feature (200)..(200): n is a, c, g, or t
  modified_base (433)..(433): a, c, t, g, unknown or other
  misc_feature (433)..(433): n is a, c, g, or t
  modified_base (482)..(482): a, c, t, g, unknown or other
  misc_feature (482)..(482): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggnagagccaccctctcctgcagggccagtcagaacattggagcaacttagcctggtaccaacaaaaacctggaccagcctacccagactcctcatttatcgttcatccaccagggccactgactcgtcccaactagattcagtcgcaggaggtctaggacagacttcagtctcaccatcagtcagtcgtacagtctgaaagtacttaggctagtttattactgtacaactaagtnggtctagtggtcctacgacgtttcggccgtaagggacctagacggtagntaagtcgaaggtcgtaacttggtcggtactcggaccgaacctacgtacgttcgtacttaccg

SEQ ID NO: 91861 - DNA, 577 bp, Homo sapiens
  misc_feature: GYAE6OF02IFKW2.5.57.F02.1.454.CMB.1.raw
  modified_base (201)..(201): a, c, t, g, unknown or other
  misc_feature (201)..(201): n is a, c, g, or t
  modified_base (243)..(243): a, c, t, g, unknown or other
  misc_feature (243)..(243): n is a, c, g, or t
  modified_base (327)..(327): a, c, t, g, unknown or other
  misc_feature (327)..(327): n is a, c, g, or t
  modified_base (412)..(412): a, c, t, g, unknown or other
  misc_feature (412)..(412): n is a, c, g, or t
  modified_base (455)..(455): a, c, t, g, unknown or other
  misc_feature (455)..(455): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccacctctcctgcacgggccagtcagaacagttggancaacttagcctggtaaccaacaaaaacctggaccagcctaccagactcctctattactcgttcactccaccgacgggccacgtnactcgtacccaaacctagtacttacaggtgacgaggtagggtctagggacagacttcgagtctccactatcacgcacgcgtacgngtactagaagtcgttgacttagtttacttacgtctacaaagtntacggtaggtctaggtcgtccgttacggaaccggttcgacccgaggaccacgtagtcggatacgtcggaggtaccgacgtggtacggaccttacgctaacccttgtaccgttcgttacttcc

SEQ ID NO: 91862 - DNA, 515 bp, Homo sapiens
  misc_feature: GYAE6OF02IL59K.5.57.F02.1.454.CMB.1.raw
  modified_base (202)..(202): a, c, t, g, unknown or other
  misc_feature (202)..(202): n is a, c, g, or t
  modified_base (426)..(426): a, c, t, g, unknown or other
  misc_feature (426)..(426): n is a, c, g, or t
  modified_base (482)..(482): a, c, t, g, unknown or other
  misc_feature (482)..(482): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtcctccagggganagagcccaccctctcctgcagggccagtcacgaacattggagcaacttgcctggtaccaaacaaaaacctggaccagcctcccagactcctcatttactcgttcatccaccgagggcctactgactcgtacccaaccagacttacagtgcagagggtctgggacacgacttcagtctcacatcagcagacgacagtcagaagtacgtgactagtttattacgtntacaacatgtgctagtcgctacgacgttcgacctaggacccatagacgatactcgnggacgaactgagctcgcgtacagcttgtcttac

SEQ ID NO: 91863 - DNA, 651 bp, Homo sapiens
  misc_feature: GYAE6OF02F7HXY.5.57.F02.1.454.CMB.1.raw
  modified_base (199)..(199): a, c, t, g, unknown or other
  misc_feature (199)..(199): n is a, c, g, or t
tcagatcagacacgcacgaccggtgctcgatttagctcgatatagttgggtttggggaggaactgctcagttaggacccagacggaaccatggaagcccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaaccaacaaaaacctcggaccagccctacccacgactccctacatttactcgttcactccaccgagggccaactgactcgtaccccaacagtattcagtggacaggaggtcgtagggacaggtacttcagttcctacacctatccagcgaagcgtaacacggttctacggaaacgtacgtttaggactaaggttttacttaacttcgttaacgaaacttaaagttcggtttaggtaccgtacggttcgggtacccttacgggtaaccggtttcccggaccccggaacgggtaacccaacgtaggtacggtagttacgtacggtaacgggaaccgtaacggttggtaccgggtaccgttcggacctaaaccctacgttccgttacggttcctttaccg

SEQ ID NO: 91864 - DNA, 683 bp, Homo sapiens
  misc_feature: GYAE6OF02JPN3V.5.57.F02.1.454.CMB.1.raw
  modified_base (155)..(155): a, c, t, g, unknown or other
  misc_feature (155)..(155): n is a, c, g, or t
  modified_base (173)..(173): a, c, t, g, unknown or other
  misc_feature (173)..(173): n is a, c, g, or t
  modified_base (205)..(205): a, c, t, g, unknown or other
  misc_feature (205)..(205): n is a, c, g, or t
  modified_base (329)..(329): a, c, t, g, unknown or other
  misc_feature (329)..(329): n is a, c, g, or t
tcagatcagacacgcacgaccggtgctcgatttagctcgatatagttgggtttggggggaggaacgtgctcagttaggacccagacggaaccatggaagccccagcgcagcttctcttcctcctgctctctggctcccagataccggttgggganatcgtgatgacgcagtcncagccatcctgtcctgtgtctccgaggggganagacgcccacccttctcctagccgacggggccctaggtcaaggaacctgtttcgggagctaacttgcctaggtaccaaacaaaaaccgtggaccagccctccacgacctcctactacttttacncgttctactccaaccgaggtcccacgtacgacgttccgtacccaaccgagtacttcaacggtgaccggtaggtaacgggtcgttagggaaccacggtaacctttcggaacgtcgtacccactacgtacgacggacgacggtaccgtacgtactacgtagtaacgacgttcgggacttaaggtttattacggtctactaaactagtgtacggtactgggtactaccgtagtaccgttccgggtaaccgtacggaccgaacgtcgggtacgacttaggacgtaccgggtaccgtaaacgttgggtccgtaaggtacgtaccggaaccttccgttacggtccgtttacgttacccgg

SEQ ID NO: 91865 - DNA, 648 bp, Homo sapiens
  misc_feature: GYAE6OF02JAH5R.5.57.F02.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagatcgtgatgacgcagtctccagccatcctgtctgtgtctccgagggganagagcccaccctntcctgcagggccagtcagacattgganctaactagcctaggtaaccaacaaaacctggacacgcctacccagactacctactatttactaccgttcactacccacgacggtaccacgtacgtactaccgtacccaacgtagtacttcgagtacggactaggtacgggtacgtacgggacacggtactacgtacgtactaccaaccgtatacgagtaccgacgtaccgtaacggtacgtacgtaggaacgttacgttaggacgtttagtttaacttacgtacgtaacaaaccgttagtgtacggtacgtacggttccggtacctacgggtaccgttccggaccgtaaccgggtacacgtaagtacgtatacgtacgtaacggacgtacgtagtaccggtactacggactaccgtagtcgttacgttaccttaccg

SEQ ID NO: 91866 - DNA, 755 bp, Homo sapiens
  misc_feature: GYAE6OF02JBOIK.5.57.F02.1.454.CMB.1.raw
  modified_base (202)..(202): a, c, t, g, unknown or other
  misc_feature (202)..(202): n is a, c, g, or t
  modified_base (250)..(250): a, c, t, g, unknown or other
  misc_feature (250)..(250): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccacccttctcctgccagggcccagtcaagaactagttgganctaacttagcctggtaccaacaaaaccgtgaccacgtccctcccagaccttcctactattttactccgttacacttcccaaccgtacgggccactgacgtcgtacccccaaccagtacttacgacggtcggtacgaacggtaggggttctaggggactacggtaactttacgaacgttccctaccgaaccctacgtccgaacgtccaacggtaccttaacgacggttacgtagtaaacgtccggtttaggacctttaaacgggttttaactttaaccgttaggttacctaaaacgtaatttacggggttacggtaccgttagggttacccgggtccctttaacccgggttaacgggtttccccgggaaccccgttaacggggaaccccgtacgtaacggggttacgggtaacttacggtacccgggaaacgggttcccgtaaacggttcggtaccggtaccgtacggtaccacccggtactttaccggtcgtttaccctttaccg

SEQ ID NO: 91867 - DNA, 552 bp, Homo sapiens
  misc_feature: GYAE6OF02FHTDV.5.57.F02.1.454.CMB.1.raw
  modified_base (201)..(201): a, c, t, g, unknown or other
  misc_feature (201)..(201): n is a, c, g, or t
  modified_base (539)..(539): a, c, t, g, unknown or other
  misc_feature (539)..(539): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaacctggccagcctcccagactcctcatttatcgttcactccaccaggccactgatgtcccaacagattcagtggcaggagggtctgggacagactcagtctcacctatcagcagcgtacagtctagaacgtacttggactagtttaatactgtacaaacgaatgtaggtctagtcgggtccttacggaacgttccggacccgaacgggtaccaacgtacggtacggatacgtcgtaacggccgaaacgttggtacgcgtcggacctaaccgtntccgtgttcttac

SEQ ID NO: 91868 - DNA, 955 bp, Homo sapiens
  misc_feature: GYAE6OF02J02B9.5.57.F02.1.454.CMB.1.raw
tcagatcagacacgcacgaccggtgctcgatttagctcgatatagttgggtttgggggtagggaacgtgctcagttaggacccagacggaaccatggaagcccagcgcagcttctcttcctcctgctactctggctcccagataccgttggggagatcgtgatgacgcagtctcagccatcctgtctgtcgtctccgaggggtagagacgtcccaccctcgtacctgccgacggggccctaggtaccaaggtaaacctagttttcggggaacgaccgtaaaccttttacggaccccttacggggttaaaccccaaaaacccgtaaaaaaaccccgttgggaacccctaaccggtacccccttaccccgaaccggtaacccttaccccgttacctaacgtttttaacgtccgtttaccctaaccttaccccaacccgttaacggggacccctaaccgttcggaacgttaccggttacccccaaaccccgtaaggttaccgttaccgtaaaggggttcgggacccgtaaacggggtacgggggttaccgttacgggggaacctaaccggggtaacctttacccgggtaaggttaccccgtttaccgacccgttaaaaccgttccgaacgtaccctaacgggtacccggttaactaacgggttaccgttaggaaaccggttaccggtttagggtacctttaaacgggttttaacttttaccgttaacgggttaaccctaaacgggttaagttaccgggttacgggttaacgttaccgggtttaacggttccccggttaaaccgggtttaaaccggtttccccgggggacccgttaaacggggacccccgtaagtaacgggttcgggtaactacggtaccggacgggtacccggttaaactcgggtttaacgccgtacccggttacgaaaccccgtttgacgtttccggttaaccctcg

SEQ ID NO: 91869 - DNA, 681 bp, Homo sapiens
  misc_feature: GYAE6OF02F9MO3.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagccaccctctcctgcacgggccagtcagaacagttggagactaacttagcctaggtaacccaaacaaaaaccgtggaccacgcctacccagacctcctctatttactcgttaccactaccgaccgacgggccacgtagactacgttaccccaaacctagtacttacgaggttggacgaggggtacgggtcgtacggggacacggtacttcgaacgttcctaccaccgtactccgagtaccgaacggtaccgtaacgacgttacgtaggaaacgtacgtttacgggacttaaggttttacttaacgtcgttaaccaaacgtaagttcggtacggtacgtacggtaccggtaccttaaccggggttaaccgtccgggacccgaacgggaccctaagtacgggttaggtacgtacgtacggaacggaccgtaacggtcggtacggcgtcgacctaccggtattaccgtcgttccttacc

SEQ ID NO: 91870 - DNA, 583 bp, Homo sapiens
  misc_feature: GYAE6OF02IFYYE.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (325)..(325): a, c, t, g, unknown or other
  misc_feature (325)..(325): n is a, c, g, or t
  modified_base (417)..(417): a, c, t, g, unknown or other
  misc_feature (417)..(417): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagcgcccaccctctcctgccaggggccagtcagaacnttggtagctaacttgcctaggtaccaaacaaaaacctggaccacgcctcccagacctcctactatttactccgttcactccaaccnggaccactgactcgtacccaactagacttcagtgctaggacgggtcgtgggacacgtacttcgacgtcctacacctatcgagcacgacgtanacgtctagtaacgtacttggctagtttattactgtactaacgtatggtagtctaggtcggacctacggtaacggttcccggaccgaacggtaccacgtacggtgactacgtcgaaggccgtaacgtggtacgtcgtcgacctaccgtacttccgtcgtaccttacg

SEQ ID NO: 91871 - DNA, 709 bp, Homo sapiens
  misc_feature: GYAE6OF02HACRQ.5.57.F02.1.454.CMB.1.raw
  modified_base (154)..(154): a, c, t, g, unknown or other
  misc_feature (154)..(154): n is a, c, g, or t
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctcgagggganagngccacctctcngcgagggccagtcaagaactagttgggagactaacgttacgacctacggtaacccaaacaaaaaccgtcggaccacgaccctacccgaacgacctcctactacttttacgtccgttactactacccaccgacggacctactgaactccgtaacccaactagtactacgagtacggacgtaggtacgggtacgtagggactacgtacttcgacgtcctaccaccataccgagtacgacgtaccgtacgtacgttacgtagtaaaccgtacgttaggaaccttagtttaacgttacgtacggtaacaaaccgtagtcggtaggtactacggtacgtacccgtaacggtaccggttacccggaacccggtacgggaaccgtaaccgtagggttacggtaacttaacggtacgggtaaccgtaccggtaacggttaccgggtacgtaccgtacggtaccgaacccgtaggtttaccttacggtttcccgttaacccg

SEQ ID NO: 91872 - DNA, 811 bp, Homo sapiens
  misc_feature: GYAE6OF02IFYJS.5.57.F02.1.454.CMB.1.raw
  modified_base (691)..(691): a, c, t, g, unknown or other
  misc_feature (691)..(691): n is a, c, g, or t
tcagatcagacacgcacgaccggtgctcgatttagctcgatatagttgggtttggggagggaacgtgctcagttaggaccagacggaaccatggaagcccagcgcagcttctcttcctctgctactctggctccagataccgttggggacgatcgtgatcgacgcagtctccagccatcctgtctgtgtactccgaggggtgacgcgcccaccctcgtcctgccgtaagggccaagtcaacggtaacctgtttcggacgctaaaccgtttaggccttaggtaaccaaacgaaaaacttcggaccacgcctaccgacgtacctccgtacctaacgtttactccgtttacgtaacctaccgtacccgaaggtccccaacgtaccgtaacgttacggttaaccccctaaaaccgtacgtaacgttaccgaacggttaccggtacctaacgggacggggtaccttacggggaacttaacgggaccttaccggtaacgttttccacccgtaacctacgtttaccaacggtacgacggtaccgtaccgaacgttaaccgtcggaaaacgttaccgttacgggtactttaggttaacttaacgttctaacgtaactaagtcgttaacgggacttacgggtacgtaccctaacgggtaacccgttcgggtaaccgtaaccggggtactaaacccgggtnttaaccggggtaccggttacttaccgggaaccggttacggtaaaccggttacgggttaccgtaccggttaccgtaacccggcccgttaatttaccggtttcccggttactttaaccccgg

SEQ ID NO: 91873 - DNA, 519 bp, Homo sapiens
  misc_feature: GYAE6OF02GZN9I.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (243)..(243): a, c, t, g, unknown or other
  misc_feature (243)..(243): n is a, c, g, or t
  modified_base (299)..(299): a, c, t, g, unknown or other
  misc_feature (299)..(299): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (367)..(367): a, c, t, g, unknown or other
  misc_feature (367)..(367): n is a, c, g, or t
  modified_base (392)..(392): a, c, t, g, unknown or other
  misc_feature (392)..(392): n is a, c, g, or t
  modified_base (426)..(426): a, c, t, g, unknown or other
  misc_feature (426)..(426): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctntccgtgcagggccagtcagaacagttggancaacttgcctggtaccaacaaaaacctggaccagcctcccagactcctcatttacncgttcactccacaggccactgatcgacccaacagtacttcagtgcagaggtcnggacngactcagtcncacatcagcagctacagtctagacnctgactagttacttactgtacaagattgtgtacngtcgctacgacgttccgaccgtaggaccagcgtggtactagacgtacggactacgtcggtacgcgtcgaccgtacctagtctgtacttacccg

SEQ ID NO: 91874 - DNA, 732 bp, Homo sapiens
  misc_feature: GYAE6OF02HYOE2.5.57.F02.1.454.CMB.1.raw
  modified_base (155)..(155): a, c, t, g, unknown or other
  misc_feature (155)..(155): n is a, c, g, or t
  modified_base (204)..(204): a, c, t, g, unknown or other
  misc_feature (204)..(204): n is a, c, g, or t
  modified_base (252)..(252): a, c, t, g, unknown or other
  misc_feature (252)..(252): n is a, c, g, or t
  modified_base (715)..(715): a, c, t, g, unknown or other
  misc_feature (715)..(715): n is a, c, g, or t
tcagatcagacacgcacgaccggtgctcgatttagctcgatatagttgggtttgggggaggaactgctcagttaggacccagacggaaccatggaagccccagcgcagcttctcttcctcctgcctactctggctcccagactaccgttgggganatcgtgatgacgcagtctccagccatcctgtctgtgtctccgagggganagacgcccaccctctcctgcacgggccaggtcaagaactagttggganacaacgttgcctaggtaaccaaacaaaaacctggaccacgcccctaccgagtacctcctactatttactccgttacactccaccgacggtaccctacgtgactaccgtacccaaacagtacttaccgaggtcggaccgtagggtacgggttcgtaggggaaccgtaaggtacctttacgtacgttccctaccgtaaccccgtatacccgtaacggtaccaacggtaccgtaacgttaacggtcgtaaggtaaacggtaccgtttgggaacctttaagggttttaacttacgttacttaacgtaaactacgttggtacggttacgtaacgggtcggtacccgttacgggttaaccggttccccgggacccggtaagggtaaccctagtaacgggtacgtagttacggtccggaagggttacccgaaggttcggtaccggtctaggtaaccctgttaacccgttnttccggttaccttaccg

SEQ ID NO: 91875 - DNA, 917 bp, Homo sapiens
  misc_feature: GYAE6OF02IYV0G.5.57.F02.1.454.CMB.1.raw
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgaggggagagacgcccaccctctcctgcgagggcccagtcaacgaactagtttagggtacgacctaacgtttacgacccgttacggtaacccaaacgaaaaaaccccgttcgggaccccaacggtaccccctacccccgaaggtacccttccccgtaccttaacgtttttaactacccggtttaccaaccgttaccccaacccggtaaccgggggtacccctaaccgtttcggtaacgttaccccggttaacccccgaaaacccgtaacggttaactttaccggaacgggttacgggtaacccggtaagggttaacggggggttaccttacgggggggaaacctaacgggttacccgtttaccgaacgggttcccttaacccgtaacccgtaacgtttaccgaacggtacccgtaacggtacccggtaacgtacggtttaccggtaacggtaaaccggttaccgtttagggtacccttaagttttttaaccgttaacgtttacgtaactaaacgtacgtttaggtacgggttaacgtacgggttacggttaccccggtacggttaacccgggtttacccgggaacccgtaaccggggaacccgtaacggttaacgggtacggttaacgtacggttaccggaacggggtaacccgttaacggtacggttacgggacccttaggacccgtaacctaccgttacgtttaccggttccttaaccg

SEQ ID NO: 91876 - DNA, 507 bp, Homo sapiens
  misc_feature: GYAE6OF02F9JHK.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagacctccctcatttatcgttcatccaccagggccactgatcgtcccaacagattcagtggcagagggtctgggacagacttcagtctcaccatcagcagcgtacagtctgaagacttggctagtttattactgtcaacaatgtaggtcagtggcctcgaacgttcgccagggaccagagtgatagtcgaggcgaacgtgtggcgtagcaccgatcctgtcttac

SEQ ID NO: 91877 - DNA, 733 bp, Homo sapiens
  misc_feature: GYAE6OF02GM2RM.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtcctcgagggganagacgccaccctctcctgcgagggtccagtcagaactagtttgggacgcctaacttagcctacggtaaccaaaacaaaaaccgtcggaccacgccctaccgagacctccactatttactcgttacactccaccgacggcctacgtcgactcgacccctaacacgtacttcgaacggtcgacgtagggtacgggtacgtagggaacctacggtaccttacgtacggtcctacctaccgtagtacgacgacgaacgtaccggtactaccggttacgtaacggtaaccgtaaccggttacggtaccgttaaggttttaaccttaaccggtacggtttaacaaaaccgttagttacgggtacggtttacgacgggtttacccggtacccgttaaccggtaaccggtttccccgggaaccgtaaccgggaaaccgtacgtacggtaggtaagtacgtaccggtacgggtaaacctacgggtaaggtccggtaccgtacggtacccgaaccgtgtttccggttacgttccgttaccg

SEQ ID NO: 91878 - DNA, 464 bp, Homo sapiens
  misc_feature: GYAE6OF02IEX13.5.57.F02.1.454.CMB.1.raw
  modified_base (283)..(283): a, c, t, g, unknown or other
  misc_feature (283)..(283): n is a, c, g, or t
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
  modified_base (440)..(464): a, c, t, g, unknown or other
  misc_feature (440)..(464): n is a, c, g, or t
tcagatcagacacgcacgaccggtgctcgatttagctcgatatagttgggtttggggggaagaggaagactgacggtccccccaggagtccagagtgcgtcgcaagtattggcagtgtgaaatttgacaccttatatgcagactctgtgaggggccgcttcaccgtgtccagagacaactccaagaacgccgtctatttgcagatggacagcctgagagtcgacgacacgggcatctattatgacggcgcgagcaatactctcttactttctggagtcagggngtcccggtcactgtctcctcacgcctccaccaaggcccatcgtctcccngcncctcnccagagcacctctggggcacgngcgccctgggctgccgtgacgaaggactacgttccgtcgtctgatctgagcgggcgtcgcgaaggcgcaatagcagcnnnnnnnnnnnnnnnnnnnnnnnnn

SEQ ID NO: 91879 - DNA, 549 bp, Homo sapiens
  misc_feature: GYAE6OF02FPBII.5.57.F02.1.454.CMB.1.raw
  modified_base (201)..(201): a, c, t, g, unknown or other
  misc_feature (201)..(201): n is a, c, g, or t
  modified_base (433)..(433): a, c, t, g, unknown or other
  misc_feature (433)..(433): n is a, c, g, or t
  modified_base (544)..(544): a, c, t, g, unknown or other
  misc_feature (544)..(544): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttagcctggtaccaaacaaaaacctggaccagccctcccagactcctcatttatcgttcatccaccagggccactgatcgtaccccaaccatattcgagtcggacaggaggtcgtgggacagtacttcgagtcctcgaaccatcagcagcgtacagtctagaagtacgttcggactagtttattacgngtacaatagtgtgtacagtcggtcctggtaaccgttccggaccgtaacggccacgtagcgtatacgtcgacggacgtaacgtggcggtactcgccaaccgtactcgtcgtnttacc

SEQ ID NO: 91880 - DNA, 698 bp, Homo sapiens
  misc_feature: GYAE6OF02HBQ9V.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (438)..(438): a, c, t, g, unknown or other
  misc_feature (438)..(438): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgccaccctctccgtgccgagggcccagtcaagaactagttggagcctaaacgttgcctacggtaaccaaaccaaaaaccgtcggaccacgcccctacccacgtacctcctctaatttactcgttacactcccaccgacgggcctactgactccgtacccaaccgagtacttcaggtacggcgaaggtcgggtacgtagggactacgtacttacgacgttcctaccaaccgtntacgacgacaggtaccgtaacgacgtcgtaagtaaacgtacgttaggacttaagttttacgttaacttcggtaacctaaacgtaacgttacggtacggttacgtaggttaccggtacccgtaccggttaaccggttcccgggaacccgtacggggaaaccctcggaaggttacgggtaacttacggtacggaacggtaccgtaaaccggtggtccggtacgttcgaccgtaacctcggttaccgttcggttaccttaccg

SEQ ID NO: 91881 - DNA, 488 bp, Homo sapiens
  misc_feature: GYAE6OF02FSPTZ.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggtagcaacttagcctggtaccaacaaaaaacctggccagcctcccagactcctcatttatcgttcatccacagggccactgatgtcccaacagattcagtggcagagggtctgggacagacttcagtctcaccatcagcagcgtacagtctgaagacttggcagtttattactgtcaacatgtgtcagtgcctgaactcgccaggacacagtgatatacgaggcgaactgtcgctgcaccatctgtcttc

SEQ ID NO: 91882 - DNA, 663 bp, Homo sapiens
  misc_feature: GYAE6OF02GZJRR.5.57.F02.1.454.CMB.1.raw
  modified_base (630)..(630): a, c, t, g, unknown or other
  misc_feature (630)..(630): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgcccaccctctcctgcgacgggccagtccaagaactagttaggtacgactaaacgttacgccgttacggtaaccaaaaccgaaaaaaccgtggaccaacgtcccctacccgaagtacctcctactaattttacgtcgttacactcccaccgacggcccaactcgactcgtaccccaacgtagtaacttcgaggtcggacaggacgggttcgagggaacacgtactcgtacgtacctacaccgtatcgaagcgaacgtacgtacgtagtcgtagaaaggtacgttggactttaagtttaacgttacgtagtacctaaactagttacggtcgtacgaggttcggaccctacgggtaacgttccccggaccgtaacggacgtaacgtacgtacgaatcgtacgacgggtaacgtcgtaggtcggacncggtaccaccgtgttacgttcgtacgttaaccc

SEQ ID NO: 91883 - DNA, 880 bp, Homo sapiens
  misc_feature: GYAE6OF02IC61T.5.57.F02.1.454.CMB.1.raw
  modified_base (154)..(154): a, c, t, g, unknown or other
  misc_feature (154)..(154): n is a, c, g, or t
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttggggaggaactgctcagttaggacccagacggaaccatggaacgccccagcgcagcttctcttcctcctgctactctggctcccagataccggttgggganatcgtgatgacgcagtctccagccatcctgtctgtgtctccagggganagacgccacctctcctgcagggccagtcagaacnttggancaattgcctggtaccaacaaaacctggccagccctccagactcctctatttactcgtttcacttcccaaccgtacgggccacgtgaacttccggtaccccaaacctagtactttacgaggttcggaccgagggtacggggttccgtacggggaactacggtaaccgttttcgaaggtttccctacccgtaaaccctaacgtttacccgaaggtaccgaacgggtacccggtttaaaccgtaacggtttacccgttaagggtaaaaacggttacccggttttaacggggaccctttttaaaagggtttttttaaccgtttaaaccgtttcggtttaaaccctaaaaacccggttaaaagtttcggggttaaaccgggtttccgtaaaccggggttaccgggttaccccgtttaacccgggggtaaaacccggttttttccccgggggaacccccgtaaaccgggggggtaaaccccctaaaccgggttaagggttaccgggtaaacggtttaaccggtttaaccggtaacccgggggtaacggtaaaacccgggtttcggggttaaccgggtaacccgttcggaccccgtaaacccgtttacggttaacccgtttcccgggtttacccttttaccccgg

SEQ ID NO: 91884 - DNA, 688 bp, Homo sapiens
  misc_feature: GYAE6OF02JA53X.5.57.F02.1.454.CMB.1.raw
  modified_base (202)..(202): a, c, t, g, unknown or other
  misc_feature (202)..(202): n is a, c, g, or t
  modified_base (380)..(380): a, c, t, g, unknown or other
  misc_feature (380)..(380): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganaggagcccacctctcctgcagggccagtcagaacagttggagctaacttgcctggtaaccaacaaaaacctggaccagcctacccagacctcctactatttactcgttctatccctaccgacgggcctaacgtcgactcgtaccccaaccacgtacttcaggtggacaggagggttcnggggtaacagtaccgttacgtacgtcgtaccaccgataccgagcgaacggtaccgtacacggtacgtaggtaaacgtcgtttacgggtacttaggttttaacttacggttacgttacctaaacgtaacgttcggtaggttaccgtagggttaccggtcccgtaccgggtaaacccggtttccgggacccgtaacgggaaccccgtaagtacgggttacggaccttaacggtaccggtaacggtaccggtaacggttacggttcggtacgtccggaccgtacccacgttcgttacgttacctttacccg

SEQ ID NO: 91885 - DNA, 558 bp, Homo sapiens
  misc_feature: GYAE6OF02G6GIS.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (527)..(527): a, c, t, g, unknown or other
  misc_feature (527)..(527): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagccaccctctcctgcagggccagtcagaacattggtagcaacttgcctggtaccaaacaaaaacctggaccagcctcccagacctcctcattttactccgttacacttcccaccgacgggccacgtgattcgtccccaaccagtacttcagtcggcagagggtctgggacaagtacttcaagtcctacaacctactcacgcaacgcgtaacagtctagaaagtacgttggactagtttaattactagtacaactagttgtagtcaggtcgcttacgaacgttcgcccgaaggaccagagtggatacgacgaggactacgtggngactacgccgtaccagtttctgttacttccg

SEQ ID NO: 91886 - DNA, 656 bp, Homo sapiens
  misc_feature: GYAE6OF02J1XMH.5.57.F02.1.454.CMB.1.raw
  modified_base (201)..(201): a, c, t, g, unknown or other
  misc_feature (201)..(201): n is a, c, g, or t
  modified_base (314)..(314): a, c, t, g, unknown or other
  misc_feature (314)..(314): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagacgccaccctctcctgcagggccagtcagaacagttggtagctaacttagcctggtaccaaacaaaaacctggccaacgccctcccgtaagaccctccgtacacttttacncgttccacttacccaccgacgggtccactgaattcgtaccccaacgataacttcaacggtcggacaggtacgggtcgtacgggacacgtacttcgaacgttcctaccacctactaccgagaccgagtccgtaacacggttcctaggaaacgtcgttacggtacttagtttaacgttaacctgttaacctaaaccgtattacggtacggtttcgaagttccggtacccgtacgtaaccggttccggtacccgacgggtaaccacgtagtaggtactaagtccgaacgggccaaggttcgtagtaccgtcgttaccaacctagttccttacggtcctttaaccg

SEQ ID NO: 91887 - DNA, 544 bp, Homo sapiens
  misc_feature: GYAE6OF02GAB0S.5.57.F02.1.454.CMB.1.raw
  modified_base (201)..(201): a, c, t, g, unknown or other
  misc_feature (201)..(201): n is a, c, g, or t
  modified_base (484)..(484): a, c, t, g, unknown or other
  misc_feature (484)..(484): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggagcaacttgcctggtaaccaacaaaaaacctggaccagcctcccagactcctacatttatcgttcatccaccaggccactgatcgtacccaacagtacttcagtggcaggagggtctgggacagactcagtctccacatcacgacagcgtacagtactagaacgtacttcgggactacgtttattacgtgttacaaacgtatgtggtacagtgtcctagtaaccgttcgacccgtaaggccctanacgtgatatcgagggacctaacgtggtcggacgtcgaccaccattccgttgtccttaccg

SEQ ID NO: 91888 - DNA, 709 bp, Homo sapiens
  misc_feature: GYAE6OF02FZK00.5.57.F02.1.454.CMB.1.raw
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagccaccctctcctgcagggccagtcagaacattggancaacttgcctggtaaccaaacaaaaaccgtggaccacgccctacccagacctcctctatttactccgttcactccaccgaggccacgtgactcgtacccaaccagtacttcaaggtcggacagggtagggtccgtagggactacgtaccttacgacgttcctaccaaccgtactacgacgccgaacgtacgtaacacgttacgtagtaacgtacgtttcgggaccttaagtttttaacttacgtagttaacctaaacgttaacgtttaggttacggttacctacggggttaccggtaccccgtttaccggtaaaccgggttttccccgggaacccggttaaccggggaaaccctacgtaacgggttacgggtacttaacgttccgggaaacggtaccggtaaaccggttacgggtcggtaccgtcggtaacctacccgtgttacccggtttacggttacccttaacg

SEQ ID NO: 91889 - DNA, 574 bp, Homo sapiens
  misc_feature: GYAE6OF02I8FJW.5.57.F02.1.454.CMB.1.raw
  modified_base (201)..(201): a, c, t, g, unknown or other
  misc_feature (201)..(201): n is a, c, g, or t
  modified_base (455)..(455): a, c, t, g, unknown or other
  misc_feature (455)..(455): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagcccaccctctcctgcagggccagtcagaacagttggagcaacttgcctggtaaccaacaaaaacctggccacgcctacccagacctcctctatttatccgttcactccaccgacgggccacgtgactcgtaccccaacagtacttcgaggtcggcaggacgggtcgtagggaacacgtaccttacgacgttcctaccacctagtcacgcaacgcgtacagtctagaacgtcgttgactagtttatacgtntactaatatgtgtctagtcgaccgtacgtacggttccgaccgacgggaccacgaggtcgatacgtcgaacggacgtaacgtggtacgtcgtacgccgacctactcgttacgtcttaccg

SEQ ID NO: 91890 - DNA, 732 bp, Homo sapiens
  misc_feature: GYAE6OF02FPH2J.5.57.F02.1.454.CMB.1.raw
  modified_base (152)..(152): a, c, t, g, unknown or other
  misc_feature (152)..(152): n is a, c, g, or t
  modified_base (199)..(199): a, c, t, g, unknown or other
  misc_feature (199)..(199): n is a, c, g, or t
  modified_base (309)..(309): a, c, t, g, unknown or other
  misc_feature (309)..(309): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgtgggganatcgtgatgacgcagtctccagccatcctgtctgtgtctcgaggggngagagcccaccctctccctgcgacgggccagtcaagaactagttggtaagcaaacgttcgcctaggtaacccaaacaaaaaccgtggaccacgccctcccagacctcctnatttactcgttcactccaccgcgggccactgactcgtaccccaacagtacttcgacggtcggacgaggtacgggtcgtaggggacaggtaccttagacggttcctaccgaccctagtaccacgtacgacggtacccgtaactacgtacggtagtaaacgtccgttagggactttaagttttacgttactacggttaacaaacgttagtcggtacggtaccgttaagggaccggttcccgttaacccgggtacggtttcccggaaccccggtaacgggtaacccgtaccgggttaacgggtaggttaactaaccgggttacggaaccgggtaaccggttaaacccggttggggttaccgggtacgttacccgggaaccggtaccccgtttaaggtttcccgtttaccggtttcccgtttaaccc

SEQ ID NO: 91891 - DNA, 549 bp, Homo sapiens
  misc_feature: GYAE6OF02F4IHM.5.57.F02.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
tcagatcagacacgcacgaccggtgctcgatttagctcgatataggttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggganagacgccaccctctcctgcacgggccagtcagaactnttggtancaacttgcctggtaccaacaaaaacctggccagcctcccagacctcctcatttatcgttcatccaccagggccactgatcgtacccaaccagtattcagtggcaggtagggtcgtgggacaggtacttacagtcctcacctatcagcagcgtaangtnagaagcgttggactatttactactntacaanatgtgtcagtcgcctacgtaacggttccgccgaaggacccagtacggtgactgcggaagccgtaacgttggtacgtcgttacggcctaccgtacgttcgtcgtaccttaccg

SEQ ID NO: 91892 - DNA, 684 bp, Homo sapiens
  misc_feature: GYAE6OF02H7VLP.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgccaccctctcctgcagggccagtcagaactgttgganctaaacttgcctaggtaccaaacaaaaacctggaccacgcctacccagtacctcctactaatttactccgtttacactcccaaccgacgggtcccacgtcgactcgtaccccaaacctagtacttccgaagtcggacctaggtacgggtctacgggaactacgacttacgagttcctacgacctatcgacgacgacgtccgttaacgacgttacgtacggtaaacgtacgttacgggcttaagtttaacttaccgttagaccttaaacgtaagtttcggaggtttacgaggttaccgggaccctttaacgggaaccggtttccggaccgttaaccgggaactaaccggtaggttcggacttacggtaccgaacggtaccggtaagttcggtaacggtccgttaacgccgtaaccgtacgttcgttccgtttacttacccg

SEQ ID NO: 91893 - DNA, 679 bp, Homo sapiens
  misc_feature: GYAE6OF02HG09J.5.57.F02.1.454.CMB.1.raw
  modified_base (202)..(202): a, c, t, g, unknown or other
  misc_feature (202)..(202): n is a, c, g, or t
  modified_base (284)..(284): a, c, t, g, unknown or other
  misc_feature (284)..(284): n is a, c, g, or t
  modified_base (473)..(473): a, c, t, g, unknown or other
  misc_feature (473)..(473): n is a, c, g, or t
  modified_base (506)..(506): a, c, t, g, unknown or other
  misc_feature (506)..(506): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgccaccctctcctgccgacgggccagtcaagaactagttggagctaacgttcgccgtaggtaacccaaacaaaaaccncggaccacgccctaccagacctcctctatttacgtccgttactactcccgaaccgcggacccacgtcgaactccgtacccaaccgtacgtaacgttcaggtcggacgagggacggttcgtagggactagtacgttcaacgtcctacacctatcgacgacgagtccgtaacgtagtctaaggtaaacgtnttacgggtactttaaggttttaatccgtttaanaacgtaaacgttagtggtacggttacgtaggttaccggaccggttaccggtaccggttaccgggacccgtaacgggtacccgaagtacgggttacgattaaccgacggtaacgggtaacgtacgtaggtacggacttcggaccgtaaccgagtttccttaggtacctttaccg

SEQ ID NO: 91894 - DNA, 748 bp, Homo sapiens
  misc_feature: GYAE6OF02HT1SV.5.57.F02.1.454.CMB.1.raw
  modified_base (154)..(154): a, c, t, g, unknown or other
  misc_feature (154)..(154): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgaggggagagacgcccaccctctcctgcacgggccagtcaagaactattggagctaacttagccttaggtaacccaaacaaaaaacctggaccagccctacccacgacctccctactattttactcgttacactcccaaccgacgggaccacgtcgatcgtacccaacctagattcgaagtggacaggagggtcgtacgggaacaggtaccttcgacgttctccaaccacttccgaagccgacggtaccgtaacaacgttaccgtaggaaacgttaccgtttgggacttaaacggtttttaacttaaccgttagttaacctaaaacggttaacttacgggtttcggtacgtaacgggttaccgggtacccgtttaaccggttaaaccggggtttccccgggaaccccgggtaaacggggaacccgtaaacggtaacggggtcgggtaacgttaggttacccgggaaacggtacccgggtaaaccgttcgggttacggtaccgttaccggacctaacccggttaccgtttccgttaccggtttaccttaacccg

SEQ ID NO: 91895 - DNA, 903 bp, Homo sapiens
  misc_feature: GYAE6OF02H8P6J.5.57.F02.1.454.CMB.1.raw
tcagatcagacacgcacgaccggtgctcgatttagctcgatatagttgggtttggggaggaactgctcagttaggacccagacggaaccatggaagccccagcgcagcttctcttcctcctgctactctggctcccagataccggttggggagatcgtgatgacgcagtctccagccatcctgtctgtgtctccgaggggagagacgcccaccctctcctgcagggccaggtcaagtaacagtttggtagcctaaacgtttacgccttacgggtaaacccaaaaaccgaaaaaaacccgttcgggaacccaacggacccccttccccgaacggtaacccttccccttaccttaactttttaaccgttcccggttttacctaaccgttacccccgaacccggaacggggtaccccaaaccgttcggtaaccgttacccgtaacccccaaaaccgtaagtaaccgtttacgaacggttcggaccgtaagggtacggggttaccgtacggggaacctaacggtacctttcgaacggttacctacccgtaacccgtacgttaccgaacggtacctaacggtcccgttaaacgtaacggttaccgtaaggtaaacgtaccgtttacggggtaaccttttaaacggttttttaacgttaacgtttcggtaaacctaaaaacgtttaacgttacgggtttacgggtaccgttaacgggttaccgggttaaccccgttacgggttaaacccgggtttcccgggaaccccgggttaaccgggaaaccccgtaacggttaacgggtcgtaacttaaccggtaccggtaacgggtaaccgttacggttacggggtaccgtccggttaacgacccgtaaccgttaacgtttccgtttaccgtttcctttaacccg

SEQ ID NO: 91896 - DNA, 649 bp, Homo sapiens
  misc_feature: GYAE6OF02GINN8.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacagttggtagcaacttagcctaggtaccaaacaaaaaccctggacccacgccctacccagacctcctactattttactcgttccactacccaccgagggcccacgtcgatacgtaccccaaccgagtacttcgacggtggaccgtaggtacggggttctaggggacctaggtacttcacgttcctacgaacctataccgagaccaacgcgtaacacggttctaggaacgtacgttggactagttttacttacgtgttacaaacgtattggtacgtacgagttcggtaccgtacggacgttccggacccgtaacgggaccctaacgacggtcggacttacgtacggaacggtaccgtaaccgttggttaccggacgttccggtaccacccgtacgttccgttacggtacctttaccg

SEQ ID NO: 91897 - DNA, 648 bp, Homo sapiens
  misc_feature: GYAE6OF02HPRFC.5.57.F02.1.454.CMB.1.raw
  modified_base (257)..(257): a, c, t, g, unknown or other
  misc_feature (257)..(257): n is a, c, g, or t
  modified_base (333)..(333): a, c, t, g, unknown or other
  misc_feature (333)..(333): n is a, c, g, or t
tcagatcagacacgcacgaccggtgctcgatttagctcgatatagttggggtttgggggaggaactgctcagttaggacccagacggaaccatggaagccccagcgcagcttctcttcctccctgctactctggctcccagataccggttggggagatcgtgatgacgcagtctccagccatcctgtctgtcgtctccgaggggagagacgcccaccctctccctgccgacgggccaggtcaagaactgttaggtanactaacttacgccgtaggtaaccaaaactaaaaaacctcggccacgcccctacccaagtacctcctctaactttanccgttacactcccaccgacgggccacgtgactcgacccaacagtacttcaggtgcgaggagggtcgtagggacagacttcagtctacaccatcagcacgtcgtacagtctagagtacgttgacttagtttacttactacgtactaaatagttggtacggtacgtagggttcgaccgtaccgtaaccggttccgggacccgtaaacggggacccaacggtacgtaggtaccgttataccggtaagggttacgaacggttgggttccggtaccgttacgacccgtaaccgttgttcccgtttacgttccttaaccgg

SEQ ID NO: 91898 - DNA, 712 bp, Homo sapiens
  misc_feature: GYAE6OF02F1RWJ.5.57.F02.1.454.CMB.1.raw
  modified_base (313)..(313): a, c, t, g, unknown or other
  misc_feature (313)..(313): n is a, c, g, or t
  modified_base (686)..(686): a, c, t, g, unknown or other
  misc_feature (686)..(686): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagcccatccctgtctgtgtcctccgaggggagagacgccacccttctccgtgcagggccaggtcaggaactagttggtacgctaacgttagcctggtaccaaacaaaaaaccctggaccaagcctacccagactccgtnactttatcgttcactccaacgacggccaactgactcgtacccaaccagtacttcacggttcggacaggtaagggttcgtacggggtaacaggtaccttacgaacgtccttaccacccaattaccgacgaccgaaggtacccggtaacacggttaccgttaggaacgttaaccgttagggtacctaaggtttttaacttaaacgttcgtaactaaaccgtaagttggtacgggttacgtacggtaggtaccccggttacgaaccgggtttacggacccggtaacggtacccggaaacgaccggtaggtaccgtaaggtaccgaacgggtaacgaaaccggttcggtacggttaccgcggttaacccaccggttntacccggttaggttaccctttaccgg

SEQ ID NO: 91899 - DNA, 643 bp, Homo sapiens
  misc_feature: GYAE6OF02HWV5C.5.57.F02.1.454.CMB.1.raw
  modified_base (153)..(153): a, c, t, g, unknown or other
  misc_feature (153)..(153): n is a, c, g, or t
  modified_base (251)..(251): a, c, t, g, unknown or other
  misc_feature (251)..(251): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagacgcccacccttctccgtgccgagggccagtcaaggaactgttgganctaacttcgccttacggtaaccaaacgaaaaacctcggaccacgcctcccagacctcctactatttactcgttacactccaaccgacgggtacccacgttcgactcgtaccccaaacgagtacttaccgaggtcggccgtaaggtacgggtcgtagggaactacggtacttacgacgttcctaccacctagtccagcaaggtccgtaacgtacgtctaggtaagtacgttggacttaagtttactacgtgtaacaaactagttggtaggtacgtaggttcggtacccgtacggtacggttcccggaccgtaacgggaccaagtacggtgacgtagtcgaaggtacgtaacgtggttacggctacggccctaacgtctcgttcgttccttacg

SEQ ID NO: 91900 - DNA, 609 bp, Homo sapiens
  misc_feature: GYAE6OF02GAD76.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgccaccctctcctgcagggccagtccagaacattggtagctaacttagcctggtaaccaacaaaaacctggccagcctacccagacctcctcatttatcgttcatccaccagggccactgactcgtccccaaccagacttcagtcggacgagagggtcgtgggacagtacttcagtcctcacactcagcgaagcgtaacagtcgtagaagtacttggactagtttacttactgtacaactaatggtagtctaggtcggacccttacggaaccggtttccggacccgtaacggggaaccctaacggtacggtacggtacgttaacgtaccggtaacgggaccgttaacggtacggttgggtacctacggaccgtaacccgagtttccttcggttcctttaaccg

SEQ ID NO: 91901 - DNA, 712 bp, Homo sapiens
  misc_feature: GYAE6OF02GEYI5.5.57.F02.1.454.CMB.1.raw
  modified_base (652)..(652): a, c, t, g, unknown or other
  misc_feature (652)..(652): n is a, c, g, or t
  modified_base (690)..(690): a, c, t, g, unknown or other
  misc_feature (690)..(690): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagacgcccaccctctcctgcgacgggccagtcagaactagttggagcaaccttacgccgttaggtaaaccctaaaacgaaaaaacctcggacccaacggtcccctaccccgaagtaacctcctactaacgtttttaactccggtttacaactaccctaacccggacgggacccctacgttagaacctttaccgtaacccccgaaaccgtaacgttaacgttacgtaacggttacggaccggtagggaacggggttcggtaccggggaaacttacggaccttacgtaacgtccctaccgaacctacgtaccgacgtccgtaacggtaccgtaaacgacgtttacgaagtaaacggtaacgtttcgggtaacttaaggttttacttacgtaagtacctaaatagttgtacggttagacgtcggtccgtaggtaccgttcggaccgacggtacngtacgtagcgtacgacgaggtaccagtagccgtgaccncgaccgtgtcttacgtcctacg

SEQ ID NO: 91902 - DNA, 686 bp, Homo sapiens
  misc_feature: GYAE6OF02GI8BA.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagacgcccaccctctcctgcagggccagtcagaacattgganctaacgttgccgtggtaaccaacaaaaaccgtggaccacgccctacccacgacctccctactactttactcgttccactcccaaccgacgggccacgtcgactaccgtacccaaccagtacttcgaggttcggacgacgggtacgggtcggtacgggactaacgtaccgttacgacgttcctaccaaccctactacgacgtacacggtaccgtaacgacgttaccgtagaacgtacggttcgggtacttaacgttttacttaacgtcgttaactaaacgtacgttcggtacggttacgtacggtacggtaccgttacgggtaaccgttccgggacccggaaggtacccgtaacggtggtacgtagtacgtaccggaacggtacgtaaccgttggtacggtaccgtacggacctaaccgtcgttaccgttacgtaccgttaccg

SEQ ID NO: 91903 - DNA, 779 bp, Homo sapiens
  misc_feature: GYAE6OF02IMB8T.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
  modified_base (322)..(322): a, c, t, g, unknown or other
  misc_feature (322)..(322): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtcgtctccgagggganagcgcccaccctctcctgccacgggccaggtcaagaacagttggagccaaacttacgcctacggtaaccaaacaaaaacctggaccagtcccctacccagtacctcctactactttacnccgttcactacccgaccgtagggccccacgtagactccgtacccaactactacttaccgagtcggacgaggtacggtcgtacgggacctacgtacttacgacgtcctaccgaaccgtctacgacgtacgtacggtaccgtacgacgtcgtaaggtaaacgtaccggtttagggaccgtttaaacgttttacttaaacgtttacggttaacctaaacttaacgggtttagggtttaaccggttacggttaacgggtttaacccggtcccgttttaaccgggttaaccgggttttcccgggaaaccccgggttaaccgggtaaacccggtaaaccggttaagggttaaccggggtacgtttaccgtaaccggggtacggtaaaccgggtaccgttaacgggttcggttaccggtacggttaccctacggttaccgtccgtttacggttacgtttacccg

SEQ ID NO: 91904 - DNA, 845 bp, Homo sapiens
  misc_feature: GYAE6OF02F2EGI.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgcccacccgtctcctgccgagggccagtcaagaactagttgggtacgactaacgttagccttacggtaacccaaactaaaaaaccgtggaccacgccctacccagtacctcctactactttactcgttacactacccaaccgacgggaccctacgtcgaacgttccgtaccccaaaccgtaacgtacgttcgaacggttcggaaccgaagggtacggggttaccgtacggggtaacctaacggtaccgttacgacgttccctaccgtaaacccgtacgttaccgaacgtaccgtaacggtacccggttaacgaacggttcccgttaaggaaaccgttacggtttacgggaaccgttttaacggtttttaacgtttaaccgttacggttaacctaaaaccgttaacgttttacgggttacgggttaccgtaaagggttcccggggtaccgtttaacccggggttaaacccgggtttcccgggtaacccgggtaaaccgggtaaccccggtaacggttaacggggttaccggtaacgttaacggttaaccggtaaccgggtaaccggtaacggttaacgggttcgttaaccgttcgtaaccggttaacccgtcgtttaccgttaccgtttcgttaaccccg

SEQ ID NO: 91905 - DNA, 755 bp, Homo sapiens
  misc_feature: GYAE6OF02JGF71.5.57.F02.1.454.CMB.1.raw
  modified_base (153)..(153): a, c, t, g, unknown or other
  misc_feature (153)..(153): n is a, c, g, or t
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtcctccgaggggtanagacgccaccctctcctgcagggcccagtccagaacctatttggacgcaacgtttagcccgttaggtaaccaaacaaaaaccgtggacccagcccctcccagtacctccgtactattttagtccgttacctaacgttccccaaccgacgggtccctaacgtcgtaacttcgtaccccgaaactaacgtactttccgaacggttcggaccgacgggtacgggttacgtacggggtaaccaaggttaccttcgaacggttccctaccgaaccgtactcgaacgactaccggtaccgttaacgaggttaccctaggaaacgtccgttacgggacttaacgttttaacgttcgtacgttaaccaaacgtaattcggttacggtacctagggtaccggtcccgtaaggttaacccgggttccggaccccgtaaggggaacccccttaagaaccggttagggtaccttacgtaccgggtaaccggtaaccggaccttttgggccggtaaccgtacggtacccctaacttacccgttggtttccgtacctttacccgg

SEQ ID NO: 91906 - DNA, 630 bp, Homo sapiens
  misc_feature: GYAE6OF02I4O3R.5.57.F02.1.454.CMB.1.raw
  modified_base (201)..(201): a, c, t, g, unknown or other
  misc_feature (201)..(201): n is a, c, g, or t
  modified_base (484)..(484): a, c, t, g, unknown or other
  misc_feature (484)..(484): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtcctcgagggganagacgcccaccctctcctagcagggccagtcagacagttggacgcaacttagccgtaggtaaccaaacgaaaaaccgtggcccaaggccctcccagaacctcctactatttactcgttacactcccacgacggtccactgaatcgtcccaacagtatacgagtcgacaggaggtcctgggactagaccttagacgtaccgtcaacctagtccgagtccgacggtaccgtacgtaagtcgtaacgaaacgtaccgttgggtaccttaaggttttaacgttaacnccgttaacgaaaccgtagttacggtggtactagggttaccgtacccggtacgttaaccggtcggacccgtaacggggaccctaacgacgttgagtactcggacgtacgactaggacgcgtagactaccgtagtccttagttctacg

SEQ ID NO: 91907 - DNA, 785 bp, Homo sapiens
  misc_feature: GYAE6OF02JS9OM.5.57.F02.1.454.CMB.1.raw
  modified_base (154)..(154): a, c, t, g, unknown or other
  misc_feature (154)..(154): n is a, c, g, or t
  modified_base (744)..(744): a, c, t, g, unknown or other
  misc_feature (744)..(744): n is a, c, g, or t
tcagatcagacacgcacgaccggtgctcgatttagctcgatatagttgggtttgggggaggaactgctcagttaggacccagacggaaccatggaagcccagcgcagcttctcttcctcctgctactctggctcccagatacccggttgggganatcgtgatcgacgcagtctccagccatcctgtctgtgtctcccgaggggtagagacgcccgaacccttcctcctcggccgtacggggccctaacggttcaacgaaccgtaggtttacgggaacgtaccgtaaacctttacggaccccgttaaggaaaccccgtaaaaacaaaaaaaccccggttcggaccccgtaacggttacccccctaaccccggtaactaaccccggttccctaccgttaactttttaaccggtttcccgttaaccctaaccgttcccccgaaaacccggtacggggtacccccttaaccggtacgttaccgtaccgggttaacccccaaaaccgttacgtaacctttaccgagggtaccggacctaaggggtacgggtcggttagggaccttaacgtacgttacgacgttacctaccaacccgtataccgacggtacctacggtaccggtaccttaacgtcgtacggtaaacgttcgtacgggtaacttagtttaacgttactcgacgaacgtagtggttacctgtacggcgttaccgtgaacgtcggtacacgactacgagtcgatcgtaacggntacgtacgtcgagtcgtacgacctagtactacgtcgtcacg

SEQ ID NO: 91908 - DNA, 869 bp, Homo sapiens
  misc_feature: GYAE6OF02HAK3Q.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctcgagggganagagcccaccctctcctgcgacgggccaggtcaagaacctagtttgggtaacgctaaaccgttagcccttacggtaaacccaaaaccaaaaaaccccgttcggacccaacgcccctaccccaagtaaccctccctactaacttttacgtccgtttaccaacttaccccaacccgacggggtacccctaacgttcggaacttccgtaacccccaaaccgtaggttaacttcgaaggttacggaccgtaacggggtacggggttacgtacggggaacctaacggtaccgtttcgaacgttccctaccgaaacccgtacgttaccgaacggtaccaacggtacccgttaaccgacggttccgtaggaaaaccggttaccgttagggtaaccttaaggtttttaaccgttaccgtacgtttaaccgaaagttaacgttcggtttacgggttacgtacggttacccgggttacccgtttaaccgggtaacccggggtttacccggacccccgggtaaacggggtaaccctaaccgggttaacgggtaccgggttaacgttaacggcccggtaaaggggttaacccggtaaacggttggggtaccggttaccgtaccgggtaaccccgttaacccgttaacgtttcccggtttacgttttaccccgttaaccgg

SEQ ID NO: 91909 - DNA, 684 bp, Homo sapiens
  misc_feature: GYAE6OF02GPZ4I.5.57.F02.1.454.CMB.1.raw
  modified_base (203)..(203): a, c, t, g, unknown or other
  misc_feature (203)..(203): n is a, c, g, or t
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganaggagccaccctctcctgcagggccagtcagaacattggancaacttacgcctaggtaaccaaacaaaaaccgtggaccacgccctacccagacctcctacatttatcgttacagtccaccacgggccaactgatcgtacccaaccagtacttcacggtgacaggtagggtactgggggaacaggtaccttacgacgtacctactaccacgttacgaggacacggtacgtaacgagtccgtagaaacgtacttcgggactaagtttttacgttaaccttaggtaacctaaactaagttggtttacggattaacgggtccggtaccgttaccgggtaaacgggtttcccggacccgggaaacggggttaaccccaacgtaacggggtacgggtacttaacggacgtaacggggtaccttaaacggtcggtcgggtaccttcggaacccttaaccgactttcggtaccgttacgtttaacccg

SEQ ID NO: 91910 - DNA, 665 bp, Homo sapiens
  misc_feature: GYAE6OF02HGO7Z.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccaggcggaaccatggaagccccagcgcagcttctcttcctcctgctactctggctcccagataccgttgggganatcgtgatgacgcagtctccagccatcctgtctgtgtctccgagggganagacgccaccctctcctgcagggccagtcaagaactagttgggtacgctaacttacgccgtaggtaaccaaacaaaaacctggaccacgccctcccagacctcctactatttactcgttcactcccaccgacgggccacgtcgactcgtaccccaaacgagtacttcaggttcggacaggtagggtcgtagggacaagtaccttcacgtctaccaaccactacgacgcagtaccgtacgagtctagtaacgtcgttaggacttaagtttacttacgtacgtaactaaacgtaagtttcggtacggttacgtagggttcccggaccgtttacggtaaacccgggtttccggaacccgaacgggtaacccaacgtacgggttacggacttagtaccggaacgggtaccgtaacgttggtacggtcgtacggccctaaccgttacgttccgttcgtcctttacccg

SEQ ID NO: 91911 - DNA, 599 bp, Homo sapiens
  misc_feature: GYAE6OF02IKHSJ.5.57.F02.1.454.CMB.1.raw
  modified_base (153)..(153): a, c, t, g, unknown or other
  misc_feature (153)..(153): n is a, c, g, or t
  modified_base (346)..(346): a, c, t, g, unknown or other
  misc_feature (346)..(346): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagacgcccaccctctcctgcagggccagtcaagaactagttggagacaacttagcctggtaaccaaacaaaaacctggaccacgccctcccagacctcctctatttatcgttacatccacacgggccactgatcgtaccaacanattcagtgacaggtacggtcgtagggacagacttcgagtctacgaccatcagcacgtaccgtacagtctaggaagtcgttggacttagtttattcgtagtacaaatagtcggtagtcgaggttcggtaccttacggtaaccgttccggacccgtaacggggaaccctacgtacggttggacttacgtacggaaggtaccgtaaggttcggtacggtacgtcgacgtacctacgttacgttcgttaccttaccg

SEQ ID NO: 91912 - DNA, 556 bp, Homo sapiens
  misc_feature: GYAE6OF02HGPF9.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgcagggccagtcagaacattggancaacttgcctggtaaccaacaaaaacctggaccagccctcccagacctcctctaattttatccgttcactcccacccgagggcccactgactcgtaccccaacagacttcagtggcaggagggtctggggacagacttcagtctacaccatcagcacgcgtacagtctagaagtacttggactagtttattacgtgtacaactagtgtgtcaggtggcctagtaccgttcgaccagggccacgaggtacgactagtcgaggaccgtaagttggtggacctcgaccgtacctacgttcgttaccgtcttacccg

SEQ ID NO: 91913 - DNA, 585 bp, Homo sapiens
  misc_feature: GYAE6OF02IO0AX.5.57.F02.1.454.CMB.1.raw
  modified_base (153)..(153): a, c, t, g, unknown or other
  misc_feature (153)..(153): n is a, c, g, or t
  modified_base (243)..(243): a, c, t, g, unknown or other
  misc_feature (243)..(243): n is a, c, g, or t
  modified_base (279)..(279): a, c, t, g, unknown or other
  misc_feature (279)..(279): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggggaagacgcccaccctctcctgcagggccagtcagaacattggancaacttgctggtaaccaacaaaaacctgaccagccncccagacctcctacatttatcgttacactccaccaggccatgactcgtacccaacgagtacttcaggtacgcaggtacggtcgtagggactacgtacttacacgtctacaaccatcacgtacagtacgtacacgtactgaagtacgttaggactagtttattaccgtatacctaaataagtgtacgtactaggtacgtaccgtacggtaacgtccggacctaacgggaccaccgtagtacgattacgtacggaacggtacgtacgtggtagtaccgtgacccgacctaggtcttcggtccttaccg

SEQ ID NO: 91914 - DNA, 576 bp, Homo sapiens
  misc_feature: GYAE6OF02GX0JO.5.57.F02.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (406)..(406): a, c, t, g, unknown or other
  misc_feature (406)..(406): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccaccctctctgcacgggccagtcagaacngttgganctaacttcgcctggtaaccaaacaaaaaccgtggaccagccctacccagacctcctctatttactcgttcactccaccgacggccacgtgactcgtacccaacgagacttcgaggtgacgaggtacgggtcagggacagtacttcgagtcacaccatcgancgacgcgtacacgtactaggaatacgttggcttaagtttacttactacgacaacgtagttcggtagtacgtaggtcggtacctacggtacgttccggaccgtacgggacacgagtcgatactcgaggtaccagtcggtacggctaggacctacttcgtattcgtacttcc

SEQ ID NO: 91915 - DNA, 626 bp, Homo sapiens
  misc_feature: GYAE6OF02GKDXW.5.57.F02.1.454.CMB.1.raw
  modified_base (151)..(151): a, c, t, g, unknown or other
  misc_feature (151)..(151): n is a, c, g, or t
  modified_base (311)..(311): a, c, t, g, unknown or other
  misc_feature (311)..(311): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgtgggganatcgtgatgacgcagtctccagccatcctgtctgtgtctccgaggggagagagcccaccctctcctgcagggccagtcaagaactagttggtagcaacttgcctaggtaacccaacaaaaacctggccagccctcccagactcctcatttatcgttcacncccacgagggccactgactcgtacccaaaccgtagatttccaggttcggaccaagggtacgggtctaggggaacacgtacgttcaggttctaccgaccctagtaccacggcaagtccgtaacagttacctaggaaacgtacgttgacttagttttataacgtcgtacaactatggtacgtacgtgtcgccgttacggtacgttccggaccgtaggacctaacgaggtagacgttaacgtaccgaagggtaccttaacggttaggtcggtaccgttacggtaccctaacgtcgttacgttcgttaccctttcccgg

SEQ ID NO: 91916 - DNA, 510 bp, Homo sapiens
  misc_feature: GYAE6OF02GFRTN.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgcagggccagtcagaacattggancaacttgcctggtaccaacaaaaacctggccagcctcccagactcctcatttatcgttcatccaccagggccactgatcgtcccaacagattcagtgcagacggtctgggacagacttcagtctcacatcagcagcgtacagtctagaacgacttgggctagtttattacgtgtacaacaattgtagtcaggtcgcctcgaacgttcggaccgagggacccagagtgatatcgaggctaacgtggtcgctgcaccatctgtcttacg

SEQ ID NO: 91917 - DNA, 739 bp, Homo sapiens
  misc_feature: GYAE6OF02HSSEH.5.57.F02.1.454.CMB.1.raw
  modified_base (156)..(156): a, c, t, g, unknown or other
  misc_feature (156)..(156): n is a, c, g, or t
  modified_base (208)..(208): a, c, t, g, unknown or other
  misc_feature (208)..(208): n is a, c, g, or t
  modified_base (256)..(256): a, c, t, g, unknown or other
  misc_feature (256)..(256): n is a, c, g, or t
tcagatcagacacgcacgaccggtgctcgatttagctcgatataggttgggtttgggggagaactgctcagttaggacccagacggaaccatggaagccccagccgcagcttctcttcctcctgctactctggctcccagattaccggttgggganatcgtgatcgacgcagtctccagccattcctgtctgtctctcggaagggganagacgcccaccttctcctgccgagggccagtcaacgactagttcgganctaaacgttgcctacggtaaccaaaaccaaaacgtcggaccacgcctaccaacgacctcctactactttactacgtactactaccaccgtacggacctatacgactccgtaacccaactacgtacttacgacggtacgtacgaagggtacgggtcgtacgggaacgtacgtacgttacgagttccctacgaacccgtagtaccgacgtacacgtacctaacgtagtacgtaaggtaacgtacgttacggtacgttagttttaactacgttacgtaactaaacgttagttggtaacgttacgtacggttaccgtaccgttaacggttaaccggtaccgggttaacccgaaccgggtaacctaacgggtaacggttacggtacgttaccggtacgggtaaccgggaccggtttaacggtacgggttacccggtacgttacccggaccgtaaccgttacgtttccgttaccggttaccttaaccgg

SEQ ID NO: 91918 - DNA, 641 bp, Homo sapiens
  misc_feature: GYAE6OF02J3EHG.5.57.F02.1.454.CMB.1.raw
  modified_base (121)..(121): a, c, t, g, unknown or other
  misc_feature (121)..(121): n is a, c, g, or t
  modified_base (158)..(158): a, c, t, g, unknown or other
  misc_feature (158)..(158): n is a, c, g, or t
  modified_base (193)..(193): a, c, t, g, unknown or other
  misc_feature (193)..(193): n is a, c, g, or t
  modified_base (210)..(210): a, c, t, g, unknown or other
  misc_feature (210)..(210): n is a, c, g, or t
  modified_base (265)..(265): a, c, t, g, unknown or other
  misc_feature (265)..(265): n is a, c, g, or t
  modified_base (510)..(510): a, c, t, g, unknown or other
  misc_feature (510)..(510): n is a, c, g, or t
  modified_base (517)..(517): a, c, t, g, unknown or other
  misc_feature (517)..(517): n is a, c, g, or t
  modified_base (586)..(586): a, c, t, g, unknown or other
  misc_feature (586)..(586): n is a, c, g, or t
  modified_base (596)..(596): a, c, t, g, unknown or other
  misc_feature (596)..(596): n is a, c, g, or t
  modified_base (601)..(601): a, c, t, g, unknown or other
  misc_feature (601)..(601): n is a, c, g, or t
  modified_base (609)..(609): a, c, t, g, unknown or other
  misc_feature (609)..(609): n is a, c, g, or t
tcagatcagacacgcacgaccggtgctcgatttagctcgatatagttgggtttgggggaggaactgctcagttaggacccagacggaaccagtggaacgccccagcgcagcttctcttccncctgctactcgtggctcccagactaccggttgggganatcgtgatgacgccagtcctccagccatcctgtcngtcgtcgccgagggganagcgccctacctcctccgagccgagggtaccagtaccaagtaacctgttcggacncctaacgttcgccgtacggtaaccaaactaaaccgtcggccaacgcccgtaccagcctccctagtactttagcttacacttccacgtacggccacgtcgacgttacgaccccgtaactacgtcttacgacggtagacgaacggtcgggtcgtacgggactacggtactcgtacgtacctcgaacctagcgtaagccaggtaccgtacacggtacagttaacgaccgttagtacgttacgttaacncggttanaccggtaataagttcggtgtacgaccgttcggacctaacgtccgcggtaccgacgactagacgagtacncgtacgcggngtacncggttacncgtacgcgacgtacgtcgtacgttcttaccgg

SEQ ID NO: 91919 - DNA, 608 bp, Homo sapiens
  misc_feature: GYAE6OF02FR460.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (440)..(440): a, c, t, g, unknown or other
  misc_feature (440)..(440): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagccaccctctcctgcagggccagtcagacattggagcaacttgcctaggtaacccaaacaaaaacctggaccacgccctacccagtcctcctactattttactccgttcacttcccaaccgacgggaccactcgactcgtaccccaaccgagtacttcgacgtggacgaggtacggggtccgtaggggaactaggtaccttcgacgttcctccacctatccagcacgccgtaacngtcgtagaacgtcgttagcgtaagtttattactagtactaaactagtgtggtctaggtcgtacccgtacgtaaccgttccggcccacgggacctagagtaggactacgacgagggacctaagttcggtacggtcgtacgacctacctagtccgttacgttccttaccg

SEQ ID NO: 91920 - DNA, 559 bp, Homo sapiens
  misc_feature: GYAE6OF02GZFPQ.5.57.F02.1.454.CMB.1.raw
  modified_base (154)..(154): a, c, t, g, unknown or other
  misc_feature (154)..(154): n is a, c, g, or t
  modified_base (242)..(242): a, c, t, g, unknown or other
  misc_feature (242)..(242): n is a, c, g, or t
  modified_base (352)..(352): a, c, t, g, unknown or other
  misc_feature (352)..(352): n is a, c, g, or t
  modified_base (379)..(379): a, c, t, g, unknown or other
  misc_feature (379)..(379): n is a, c, g, or t
  modified_base (556)..(556): a, c, t, g, unknown or other
  misc_feature (556)..(556): n is a, c, g, or t
tcagatcagacacgcacgaccggtgctcgatttagctcgatatagttgggtttggggggaggaactgctcagttaggacccagacggaaccatggaagccccagcgcagcttctcttcctcctgctactctggctcccagataccgttgggganatcgtgatgacgcagtctccagccatcctgtctgtgtctccaggggagagagccaccctctcctgcagggccagtcagaacattggancaacttagcctaggtaaccaaacaaaaacctggaccacgccctaccccagacctcctactatttactccgttcactcccaccgacgggccactgatcgtacccaaccganacttcagtggcaggagggtcagggacngtacttcgagtctcacctatcacgcagcgtaacagtctagaagtacgtggactagtttacttactcgttacaacgtatcgtggtacaggtcggaccgttcgtaaccgtcggtaccgaggaccaacagtcggactactcgaaggacgacgtgtacggctacgcacctagtcttcgttnttc

SEQ ID NO: 91921 - DNA, 500 bp, Homo sapiens
  misc_feature: GYAE6OF02IKAVW.5.57.F02.1.454.CMB.1.raw
  modified_base (287)..(287): a, c, t, g, unknown or other
  misc_feature (287)..(287): n is a, c, g, or t
  modified_base (434)..(434): a, c, t, g, unknown or other
  misc_feature (434)..(434): n is a, c, g, or t
  modified_base (474)..(474): a, c, t, g, unknown or other
  misc_feature (474)..(474): n is a, c, g, or t
  modified_base (476)..(500): a, c, t, g, unknown or other
  misc_feature (476)..(500): n is a, c, g, or t
tcagatcagacacgcacgaccggtgctcgatttagctcgatatagttgggtttggggggaagaggaagactgacggtccccccaggagtccagagtgcgtcgcaagtattggcagtgtgaaatttgacaccttatatgcagactctgtgaggggccgcttcaccgtgtccagagacaactccaagaacgccgtctatttgcagatggacagcctgagagtcgacgacacgggcatctattattgtacggcggccgagcaatactctcttactttctggagtcagggngtcccggtcactgtctcctcagcctccaccaggcccatcgtcttcccctgccaccctcctccaagacgcaccctcgtcggggcacacgcggccccgtgggcctcgccgtcggtacaacgggtactaccgttcccgtgtcttgatcgngaggccgggtctgggaccgtaagggccgacgtaagtgacngnnnnnnnnnnnnnnnnnnnnnnnnn

SEQ ID NO: 91922 - DNA, 646 bp, Homo sapiens
  misc_feature: GYAE6OF02FHD83.5.57.F02.1.454.CMB.1.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttgggagatcgtgatgacgcagtctccagccatcctgtctgtgtctccgagggganagagccacccgtcncctgcgacgggccagtcagaacattggtagctaacttagcctggtaccaaacaaaaaccgtggaccaacgcctacccacgacctcctcgatttactcgtcactccacctaggccacgtcgatcgtacccaaccagacttcgagtcggaccgtaggacgggttacgtcgggaacaagtaccgttacgacgttacctacaacctatccgagcctagaccgttacagtaccaggtaaacgtacttagggacctagtttaacttacgttagttacaaactaacgttagtcggtacgtacgttcggtacctacgggtaaccgtttccgggacccgaggtaaccctacgtacgtcggtactaggtaccgtaaggacgtaaacccggtggttaccggactacggtacctaaccgtacgttaccgttcgttacccttacg

SEQ ID NO: 91923 - DNA, 655 bp, Homo sapiens
  misc_feature: GYAE6OF02GJBEG.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtcctccgagggganagacgccaccctctcctgcgagggccagtcagaacagttggaacgcaacttagaccctaggtaacccaaaacaaaaaacccgtggaccacgaccctacccacgtacctccctacgtaactttataccgttcactcccaacgacgggccaactgtaactcgtacccaaccagtattacgaggtaggacgaaggagggtctaggggacagtacctcagtccacacatacagcaacgtcgtacgtagttacgagtaacggtacgttaggtacctaaggttttaactactagttacaaactaagttcggtacggttacgacggtacggtacctacgggttaaccgttccgggacccgaacgggtaccaagtaagtacggtactacgtacggaaggtaaccgtaggtacggtacgtcgtacgacccgtaaccgtgttacccgttagtccgtttaccg

SEQ ID NO: 91924 - DNA, 794 bp, Homo sapiens
  misc_feature: GYAE6OF02G296J.5.57.F02.1.454.CMB.1.raw
  modified_base (200)..(200): a, c, t, g, unknown or other
  misc_feature (200)..(200): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctcagccatcctgtctgtgtctccgaggggngagacgccaccctctcctgcgacgggccagtccagaactgttggtaagctaaacgttagcccgttaggtaaccaaaacctaaaaaaccgtcggaccaagcccctcccgagaacctcctactaacttttactcgttcacgttcccaaccgacgggtacctaacgtcgtacttaccggtacccctaaaccgagttaacttacgaacggttacggaccgaagggtacggggttcgtacggggtaactaacgggttaccttacgaacgttcctacccgtaaacctacgtacgacgtacgaaccggtaccgttaaacgaacggttaccgtaagtaaacggttaccgttaggtaaccgtttaacgttttaacggttaaccttacggttaaacctaaacgttaaaggtttacgggtacgttacgtaacgggttaccggtaccgtttaaccgggttaaccggttttacccgggaaccccggtaacggggtaaacccctaaggtacgggttaacgtacgtaacgttaccgggaagggtaaccgtacggtggttacgtccgtacgtacccgaacctaaggtttcccttacggtactttaacccg

SEQ ID NO: 91925 - DNA, 535 bp, Homo sapiens
  misc_feature: GYAE6OF02FRU6N.5.57.F02.1.454.CMB.1.raw
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
  modified_base (394)..(394): a, c, t, g, unknown or other
  misc_feature (394)..(394): n is a, c, g, or t
  modified_base (493)..(493): a, c, t, g, unknown or other
  misc_feature (493)..(493): n is a, c, g, or t
tcagatcagacacgcacgaccggtgctcgatttagctcgatataggttgggtttgggggaggaactgctccagttaggacccagacggaaccatggaagccccagccgcagcttctcttcctcctgctactctggctcccagataccgttggggagatcgtgatgacgcagtctccagccatcctgtctgtgtctccaggggnagagccaccctntcctgcagggccagtcagaacnttggtagcaacttagcctggtaccaacaaaaacctggccagcctcccagacctcctcatttatcgttcactccaccaggccactgatcgtacccaaccagattcagtgcaggagggtctgggacaggacttcgagtctcaccatcagcagtccgtanagtctagaacgtacttggctagtttacttactgttacaactaagtcgtagtcaggtgcctacgtaacgttccggccgacgggaccacgacgtgacttancggacgacgtaacgtgtcggactgaccacgatctcgtcttcc

SEQ ID NO: 91926 - DNA, 754 bp, Homo sapiens
  misc_feature: GYAE6OF02HV28T.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccacccttctccctgccgacgggccagtcaagaacattgatagacaacttacgccgttaggtaaacccaaaccaaaaaccgtgggacccacgcccctacccagacctacctactatttacctcgttcactcccaaccgacgggaccacgtacgacgttccggtacccctaacagtaccttacgacgttggccgaacggtacggggttactacgggaactacgtacttacgacgttcctaccgacctacgtaccgagtccaacgggtccctaacgtacgttaccgtacggtaaacggttaaccgtttgggaactttaacgttttaaactttaccgtacggtaacctaacgtaaacggtttcggttcgggtaacgtacgggtccgggttaaccttccgggtaaacccggtttcccggggtacccgtaaacggggtaacccaaggttaccgggtagggttactacgggtaccggtacgggtaccgtaaacggttttccgggaagcccgttacggtacccctaaccgttacgtcccggtttagtttacccg

SEQ ID NO: 91927 - DNA, 562 bp, Homo sapiens
  misc_feature: GYAE6OF02GYO7W.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagccaccctctcctgcagggccagtcagaacattggtagcaacttagcctggtaaccaaacaaaaacctggaccagcctcccagacctcctctatttatcgttcactccaccgagggccactgatcgtacccaaccagacttcagtggacaggagggtctaggggacagacttcgagtcacaccatcagcagcgtacagtctagaacgtacttggactagtttatactgtacaactatggtgtcagtcggcctacgaacgttccggacccgtagggacccacgaggtacgattacgtcggaaggtaccggaacgtggtacgggtctcggaccgtacctagttccgttcggttcttccg

SEQ ID NO: 91928 - DNA, 644 bp, Homo sapiens
  misc_feature: GYAE6OF02HI4VN.5.57.F02.1.454.CMB.1.raw
  modified_base (153)..(153): a, c, t, g, unknown or other
  misc_feature (153)..(153): n is a, c, g, or t
  modified_base (252)..(252): a, c, t, g, unknown or other
  misc_feature (252)..(252): n is a, c, g, or t
  modified_base (506)..(506): a, c, t, g, unknown or other
  misc_feature (506)..(506): n is a, c, g, or t
  modified_base (514)..(514): a, c, t, g, unknown or other
  misc_feature (514)..(514): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagacgccaccctctcctgcgacgggccaggtcaaggaacagtttgggacnctaaacgttcgcccgtaggtaaccaaaacgaaaaaacccgtcggacctacgccctcccgaacgtacctcctactatttactccgttacactcccaaccgtacggccactgactcgtacccaacagtattcgaggtcgagacggacgggtctagggacacgtacgttcgaatcctacgaccatcgacgctacggacgtacgagtcgtaagaagtcttacggattagtttactacgttgtaactaacgtagttcgnggttacgnggttaccgctaacggtacggttccgaccggtaggaccctaacgacggttagacgtacgtaccgggaacggtccgttaaacggtgttccggaacgttcgacgacccgttgtaccttcggttaccttaccgg

SEQ ID NO: 91929 - DNA, 702 bp, Homo sapiens
  misc_feature: GYAE6OF02GRIVB.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctcagccatcctgtctgtgtctccgagggganagacgcccgaccctctcctcgcagggccaggtcagaactagttggtagctaacttacgcctaggtaaccaaacaaaaacccgtggacccagtcccctaccccaagaccttcctctatttactccgttacacgtcccaccgagggccctactgtactccgtacccaaccagtacttcgaggtcgcaaggtagggtcgagggacaacgttaccgttacaagtttcctaccgaaccacttcgagccgtaacggtcgtaacgtacgtccgtaggtaaacgtaccgttgggtacttaacgttttattaacgttacgtaactaaacgttagtaggttacggtacgtaacggttcggtacccgttacggtaaccggttcccggcccggtaaacggacccgaacgtacgggttgaaccgttacgaacggtaccgggtaacggtaaaccgtgggttaacggaccggttacgacccgtaccgtaccgtttccgttcggtacccgttacccg

SEQ ID NO: 91930 - DNA, 803 bp, Homo sapiens
  misc_feature: GYAE6OF02GPUJ5.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcggtgatgacgcagtctccagccatcctgtctgtgtctccgaggggagagagcccaccctctcctgcgacgggccagtcaagactagtttggagctaacttcgccgtaggtaaccaaactaaaaaccgtggaccacgccctacccagtacctcctactatttactcgttacactacccgaaccgacgggccctacgtcgacttcccggtaccctaaaccgaggtaacttaccgagggtcggacgtagggaggggttcgtacggggacgaacgttaccgttcgtaacgttccgtaccaacctcgtaccgaacgtccggaacggttacccgttaacgtaacggttcccgtagggttaaaaccgtacgtttaccggggtaacgtttaaacggttttttaaccgtttaaaccgttcggttaaacccttaaaacgtttaaacgggttacggtttaacgggtaccgttaacggggacccgggtttaccccggtttaccgggttaaacccgggtttccccgggtaaaccccggtaaacggggtaaccctaaaccgggttggttaccgggtaattacccggtaagggtcgggtaacccgtacggttcgggacggttcttacggaccctacgtacgttccgttcgttcccttaacg

SEQ ID NO: 91931 - DNA, 695 bp, Homo sapiens
  misc_feature: GYAE6OF02I8529.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
  modified_base (327)..(327): a, c, t, g, unknown or other
  misc_feature (327)..(327): n is a, c, g, or t
  modified_base (341)..(341): a, c, t, g, unknown or other
  misc_feature (341)..(341): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgccaccctntcctgcagggccagtcagaacattggancaacttacgcctggtaccaacaaaaacctggccaagcctacccagacctcctctatttatcgttcactccaccgacggccactnatcgtcccaaccanacttcagtcggcagacgggtctagggacaacgacttnagtcctacacctntccagcctagcctacgacgtcgtagtaacgtacttcggaccttagtttaacttagtaccgttaactaaacgtaaagttcggtacgggtactaacgggttcgggtacccgttaaccgtaaccgggtttacccgggaccccggtaaaccggggtaacccgttaaacggtacgggttacgggttaacgttaaccctaacgggttaacccgggtaccggtaaaacccggttaccggtttacgggcccgttttaccgggaaccctaaccgtaacgttttacccgggttacctacccgttttaaacccgg

SEQ ID NO: 91932 - DNA, 624 bp, Homo sapiens
  misc_feature: GYAE6OF02J18ZD.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
  modified_base (295)..(295): a, c, t, g, unknown or other
  misc_feature (295)..(295): n is a, c, g, or t
  modified_base (480)..(480): a, c, t, g, unknown or other
  misc_feature (480)..(480): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcagggccagtcagaacattggancaacttgcctaggtaccaacaaaacctggccagccctaccagacctcctanactttatcgttacactccaccacgggccactgactcgtaccccaaccagtatccagtacggcaggacgggtcgtgggacagtacttcgagtcctacacctatccagcagactacgtacgtcgtagtaacgtacgttacggctaagtttacttacgtacgtaactaactagttcggtacggttacncggttacggcccttacggaaccggtttccggaccgacgggtaccctaaggtacggttacggtacttacgtccgtaacgggtacgaaacggttggtaccgggaacttcggaccaaccgttacgtccgtttacgtaccgtttaccg

SEQ ID NO: 91933 - DNA, 717 bp, Homo sapiens
  misc_feature: GYAE6OF02GXMXO.5.57.F02.1.454.CMB.1.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtcctcgagggganagagcccacccgtctcctgcagggccagtcaagacagttggancctaacgttgccttcggtaaccaaacgaaaaacctggaccacgccctacccagtacctcctctaattttctacgttcactacccgtaaccagggccctacgtcgacttccggtaaccccaaccgtagtaccttacgtacggagaccgtaaggacgggttcgagggtaaccacgtaccgttcgaagttaccaccgtacctactaccgacggacgtacggtacccgtagtacgttaccgtaaggtaaacgtacggttcggtaacgttaacgttttaatttaaccgttagttaaccgtaattaatcggtttacggtacgtcgggttacgtacccggttaacggttaaccggttaccgggtaccccggaagggaccccgtaacgtacggtacgggtactacgttccgaacgggtacgtaaaccgttggtaacggtccacggaaccttcctaggttacccgttgtaccctttaccg

SEQ ID NO: 91934 - DNA, 735 bp, Homo sapiens
  misc_feature: GYAE6OF02H46QS.5.57.F02.1.454.CMB.1.raw
tcagatcagacacgcacgaccggtgctcgatttagctcgatatagttgggtttgggggaggaactgctcagttaggacccagacggaccatggaagccccagcgcagcttctcttcctcctgctactctggctccagataccgttggggagatcgtgatgacgcagtctccagccatcctgtctgtcgtctccgaggggagagagcccaccctctcctgccgaggggcccaagtcgaagaactagtttgggtacgcctaacgttacgccgttacggtaacccaaaactaaaaaacccgtcgggacccacgtcccctaccccgacgtacctccttactatttactcgttcactccaccgacggccacgtcatcgtacccaacagattcaggcggtacgaggacggtacgtagggactagtacttacgacgtctaccaccattaccacgtaccacggtaccgtaacgtacgttacgtacggaaacggttaccttcgggtaccttttaaaggtttttaaccttacgtttaccggttaactaaaaccgttaagttacgggtacggtttacgacgggtttaccgggtcccgtacgggttaaacccgggttccgggacccgtaacgggaaccctacgggtacggttaggacgtttaaccgtcggtaacgggtacccggtaaacgttcgggtaaccgggctacggtccgtaacccgttagtccgtttactacccggtttacc

SEQ ID NO: 91935 - DNA, 691 bp, Homo sapiens
  misc_feature: GYAE6OF02HPYSC.5.57.F02.1.454.CMB.1.raw
  modified_base (156)..(156): a, c, t, g, unknown or other
  misc_feature (156)..(156): n is a, c, g, or t
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (252)..(252): a, c, t, g, unknown or other
  misc_feature (252)..(252): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
tcagatcagacacgcacgaccggtgctcgatttagctcgatatagttgggtttgggggagggaactgctcagttaggacccagacggaaccatggaagccccagcgcagcttctctcctcctgctactcgtcggctcccagataccggttgggganactcggtagatggacgcagtctccagccatcctgtcngtgtcnccgagggganagacncccacctntccngccgaggccagtcaagacagttggancaactgctagtacaacaaactgcanccncgacactctctattatcgttacactccaacacggcacgtacgtatacctaccaaacgacgtaacttaccgtaggtaccggacgaagggtacggtacggtacggaccggtaactaccgtacgttacggctacccgtacacgtttaccgacggtacacggtacgtaaccgtaacggtacttacgaagtaaccggttcgtacggttaatttaacgttaaccgtatacggtaaaccttaagtacgggtcgtaacggtcgttaaacgggttcccaacggttaaccggttccggaacccgtaacgggtaccggaaaccgtttacgggaacgttagggtacctacgggacgtaaccggtaccggacggttaaggtcctacggtaccccgacttaccgacgtttcgtaccgttacccgg

SEQ ID NO: 91936 - DNA, 800 bp, Homo sapiens
  misc_feature: GYAE6OF02HW0B3.5.57.F02.1.454.CMB.1.raw
  modified_base (151)..(151): a, c, t, g, unknown or other
  misc_feature (151)..(151): n is a, c, g, or t
  modified_base (500)..(500): a, c, t, g, unknown or other
  misc_feature (500)..(500): n is a, c, g, or t
  modified_base (777)..(777): a, c, t, g, unknown or other
  misc_feature (777)..(777): n is a, c, g, or t
tcagatcagacacgcacgaccggtgctcgatttagctcgatatagttgggtttgggggaggaactgctcagttaggacccagacggaaccatggaagccccagcgcagcttctcttcctctgctactctggctccagataccgttgggganatcgtgatgacgcagtctccagccatcctgtctgtcgtctcgaggggagagacgcccaccctctccgtgaccgacgggccagtccaagtaactagttacggaacgtacctaacgttacgacccgttacggtaaaacccaaaaaccgtaaaaaccgtcgggtacccacgtacccctacccgaacgtaccttccctacttaagtttactcgttacctacctacccggaccgacggtacctacgtagtacctaccgtaaccccaacgtacgtacgttacgaagggtacggacgtagggtacgggtacgtagggaacctacgtcccgtttagaaccgttctacccaaaccgtntaccgaacgaccgacggtaaccgttaccggattacggtaaggtaacgttacggttacggtagttttagtttaacctacgtaactaacggtaacttaagtcggggtacttacgggtaacggttcggtaaccccggtttaaccggtaccgggttaccccgggaacccgggtaaacgggtaccctaaccgggttaacgggttacggtaaccgttaacggtcggaaacccggggttcttaaacggtccgggtgtaccgttaccgtaccgtaaacccggttntttacccgttcttaccggttccc

SEQ ID NO: 91937 - DNA, 590 bp, Homo sapiens
  misc_feature: GYAE6OF02HHVJ7.5.57.F02.1.454.CMB.1.raw
  modified_base (425)..(425): a, c, t, g, unknown or other
  misc_feature (425)..(425): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagcccacctctcctgccacgggccagtcagaacagttggagctaacttgcctacggtaaccaaacaaaaaccgtggaccacgcctacccagcctcctactatttactcgttcactaccaccgacggccacgtgactcgacccaacacgtacttcgaggtcgacgaggacgggtcgtagggaacagtacttcgacgtctaccactactcacgacgagcgtanacgtactagtaagtacgttggacttagtttattcgtatacaatatgtagtacgtagtcggtccgtacgacgttccgaccgtaacggacctacgaggtacgtagcgtacggtacggaacgtacgtggttcggacgtccgacgtacctacgtcttcgttacttaccg

SEQ ID NO: 91938 - DNA, 597 bp, Homo sapiens
  misc_feature: GYAE6OF02FJ1TW.5.57.F02.1.454.CMB.1.raw
  modified_base (582)..(582): a, c, t, g, unknown or other
  misc_feature (582)..(582): n is a, c, g, or t
  modified_base (587)..(587): a, c, t, g, unknown or other
  misc_feature (587)..(587): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagcccaccctctccctgcgagggccagtcagaacattgggtacgactaacttagcctaggtaacccaaacaaaaacctgggacccaggcccctacccagacctcctctatttactcgttcactccaccacgggccactcgatcgtacccaaccagtacttcgacgtggacaggagggtcgtgggacagtactctagtcctacacctatcagccgagccgtaacagttactagaaacgtacgttaggactaagttttattactgtaacaactaagtgtagtctaggtcgacctcggtaacgttccggacccgtaacggaccaacggtagtagactagtaccgaaggaccgtaacgtggtcgacgtcgacctaccgttancgttntaccgttacg

SEQ ID NO: 91939 - DNA, 775 bp, Homo sapiens
  misc_feature: GYAE6OF02HXGMP.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgccaccctctcctgcgacgggccagtcaagaactagttggtagactaacttagccgtacggtaaccaaaaccaaaaaccgtcggaccacgcctacccacgtaccgtcctactatttacttccgttctaactccgaaccgacggacccgtactacgtacttaccgtaccctaaaccgaacgtacgtttacgacggtacggacgtaagggtaagggtcgtagggaacgaacgtacttacgacgttctaccgaaccgtactcgaacgcaacgggtaccgttaaccgtaacgttacgtacggtaaaacggtacgttacggggttacctttaagttttaacttaaccgtttgaaacgttaaacgttaagttggtttacggtacgtaaccgggttaccggtacccgtaacgggttaaccgggttacccggggtacccgtaaccggggtaaaccaccgggttaaggttacggaacgttaacgaaccggtaaccggggtacctaacggttacgggttaccgggtacgtaccgacccgtaaccccgttagttacccgttttacggttacctttcccgg

SEQ ID NO: 91940 - DNA, 792 bp, Homo sapiens
  misc_feature: GYAE6OF02HLNAS.5.57.F02.1.454.CMB.1.raw
  modified_base (153)..(153): a, c, t, g, unknown or other
  misc_feature (153)..(153): n is a, c, g, or t
  modified_base (744)..(744): a, c, t, g, unknown or other
  misc_feature (744)..(744): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtcccagccactcctgtctgtgtctccgagggagagacgccaccctctcctgcgaggcctagtcagaacattggtagactaacgttagtccgtacggtaaccaaaccaaaacctacggcctaaccgccctacccgtacgtactacccttctaactttacgtaccgttacctacttacccgaacccgtacggggaccctaccttaggtacttacccggtaaccccgaaaccctaaggtactttaccgaacggtcggtaccgacgggtaacgggggttacccgtagggggtaaccacggttaacgtttaccgtaacggttacccttaccgaacccgtacgttaacgaccgactacggtacccgtttaaccaaggttccgtaaacggtaaacgtaccggttaggttacttaagtttattaaccgttgttaaccgaaacttaggtacgttaggtaccgttacggtcggtaacccgttcggtaaacccgggtttccgggaacccggaaacggtacccgaacgttaggacgggtaactccgtaacggtccggggtaaactaccgggtttaggcgggttacccnggtaaccctaccttaggttcctttaacggtccgtttaatacccccggg

SEQ ID NO: 91941 - DNA, 759 bp, Homo sapiens
  misc_feature: GYAE6OF02JNLVW.5.57.F02.1.454.CMB.1.raw
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
  modified_base (268)..(268): a, c, t, g, unknown or other
  misc_feature (268)..(268): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagcatcctgtctgtgtctccgaggggancgacgcccacctctccgngcacgggccagtcagacattggacnctaacgtcgcctaggtaaccaanaaaacctggacacgaccctacccgacgacctcctactacttttacgccttacctacctccctaacccggtaccgggacctaacctacgtacgtacccggtaaccccaaccgaagttaacttcgtacggacggtacaacggggtagggttaccgtagggaaacgtacggtactttacgaacgttacctaccgtaccagtaccgagtacgtacgaccgttaacgacggtttactaacggttaagtacgggtttacgaaccgttacgttttaactaccgttacgttaactaaccggtaatttccgggttagggtaaccgtaggttaccgtaccccgggtacggtaacccgggtttaccggaacccgttacggggaaccctacgttacgggtacgggtactaacgggttacccgtaaacggtacgggtaacggttcggtaacgggttcgtaccggtacctacccggttacttacccggtttgtacccccgtttag

SEQ ID NO: 91942 - DNA, 528 bp, Homo sapiens
  misc_feature: GYAE6OF02HPZAU.5.57.F02.1.454.CMB.1.raw
  modified_base (157)..(157): a, c, t, g, unknown or other
  misc_feature (157)..(157): n is a, c, g, or t
  modified_base (371)..(371): a, c, t, g, unknown or other
  misc_feature (371)..(371): n is a, c, g, or t
  modified_base (497)..(497): a, c, t, g, unknown or other
  misc_feature (497)..(497): n is a, c, g, or t
  modified_base (499)..(499): a, c, t, g, unknown or other
  misc_feature (499)..(499): n is a, c, g, or t
  modified_base (501)..(502): a, c, t, g, unknown or other
  misc_feature (501)..(502): n is a, c, g, or t
  modified_base (506)..(528): a, c, t, g, unknown or other
  misc_feature (506)..(528): n is a, c, g, or t
tcagatcagacacgcacgaccggtgctcgatttagctcgatatagttgggtttggggggaagaggaagactgacggtccccccaggagtccagagtgcgtcgcaagtattggcagtgtgaaatttgacaccttatatgcagactctgtgaggggccncttcaccgtgtccagagacaactccaaagaacgccgtctatttgcagatggacagcctgagagtcgacgacacgggcatctattattgtacggcgccgagcaatactctcttaactttctggagtcgagggtacgtccggtctactgtcgtcctcagccctccaacctaacgggcccagtcggtcttccccctggccaccctcctaccaagacncgacctcgtcggggacacgacgccggcccgtgggctcgccgttcggtacaacggtacctaccgttcccgtacggtccttgactcgtggtacgccggggacttcggacgtacggacgacgtagagtnancnngacnnnnnnnnnnnnnnnnnnnnnnn

SEQ ID NO: 91943 - DNA, 879 bp, Homo sapiens
  misc_feature: GYAE6OF02H1HA6.5.57.F02.1.454.CMB.1.raw
  modified_base (206)..(206): a, c, t, g, unknown or other
  misc_feature (206)..(206): n is a, c, g, or t
  modified_base (228)..(228): a, c, t, g, unknown or other
  misc_feature (228)..(228): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctccagactaccggttggggatatcgtgatgacgcagtctccagccatcctgtctgtcgtcgtcggagggganacgacgccctacccttctccgngccgacgggccaggtacaacgtaacgtagtttacgggagtacctaaacgttacgtcccgtaacggtaaacccaaaaaccgtaaaaaccgtcggacccaacgcccctaccgacgtaccttcctactatttacctccgttactacctaccgaccgacggtacctacgtcggtactacccgtaacccaaacgtatacgttacgaggtcggacgtagggtacgggtacgtacgggaacctaacggtaccttacggtaccgttacctaacctaccgtaacgtaccgacgtacgtaccgtacgtaaccgtacggtacgttaacggtaaaccgttacggttacggtaacgttttaaacgttttaacgtttaaccggtaacgttaaaccgtaaaccgtttaaggtttcgggtaaccgggtttacggttaacccgggttacccggttaccccgggttaaacccggggtttaaacccgggtttcccgggaaacccccggggttaaaccggggtaaaccccgtaaacggggttaaccgggttaacgggtaacttaacccggggtacggtaaacccgggtaaccggtacgggttccggtacggggttacctacccgggtacgtacccgttaacggtttcggttaccgtttacccgttacccgg

SEQ ID NO: 91944 - DNA, 598 bp, Homo sapiens
  misc_feature: GYAE6OF02F4TO7.5.57.F02.1.454.CMB.1.raw
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
  modified_base (530)..(530): a, c, t, g, unknown or other
  misc_feature (530)..(530): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgccaccctctcctgcagggccagtcagaacnttggagcaacttgcctaggtaaccaaactaaaaacctggaccagccctacccagacctcctactatttactcgttcactccaaccagggccacgtgactcggtaccccaaaccgtagtaacttcgagtcggacacggacgggtctacggggacacggtaacttcgaacgtcctacaacctacgtcacgcgaacgccgtaacagtctaggaaactacgttacggtcttaggtttaacttcgtagttacaactaagtcgtggtcagtcgcgtacgtacgttcgccgaggaccanaggtacgatacggtcgaacggcgtaacgtggtcggacgtcggacctaaccgcttcgtcgttacttccg

SEQ ID NO: 91945 - DNA, 776 bp, Homo sapiens
  misc_feature: GYAE6OF02H0LEE.5.57.F02.1.454.CMB.1.raw
  modified_base (155)..(155): a, c, t, g, unknown or other
  misc_feature (155)..(155): n is a, c, g, or t
  modified_base (175)..(175): a, c, t, g, unknown or other
  misc_feature (175)..(175): n is a, c, g, or t
  modified_base (206)..(206): a, c, t, g, unknown or other
  misc_feature (206)..(206): n is a, c, g, or t
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
  modified_base (253)..(253): a, c, t, g, unknown or other
  misc_feature (253)..(253): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagattaccggttgggganatcgtgatgacgcagttccnccagccatcctgtctgtcgtcaccgaggggnagacgcccacctctcnggcgnggccagtcaagaactagttcgggaanacctaaacgttcgccgtacggtaaccaaaaccgtaaaaaccgtcggaccgaacgtcccctaccaacgtccctcctactagttttactaccgttctaacgtaccctaaccggcggtacctaacgtccgtactaccgaacccctaacgtacggtacttcgtacggtaacggccgtagggtaacggggtacgtagggtaacctacggttaccttcgtacgtcccgtacaaccgtctacgaacgtcgacggtaaccgtacgtacgtacgtaacggtaacggtccgttaggtaacgttttattaaccttcggtttactaaccggtaaattcggttcggtaacgggttcgtaaacccgggttcctaaaccggtttaacccggggttacggtacccgggttaaaccccggtacggggaaaacctcgggttacgtaacgggtactttacgaacgggcggttaaacccggtcggtaccggtaccgtcggtacgaacctttacgggtaacctcgttacccgggtttactaccc

SEQ ID NO: 91946 - DNA, 656 bp, Homo sapiens
  misc_feature: GYAE6OF02HPVEQ.5.57.F02.1.454.CMB.1.raw
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggagatcgtgatgacgcagtctccagccatcctgtctgtgtcctccgagggganagacgcccacccgtctcctgcgtacgggccagtacacgaactagttggtagctaacttcgccttaggtaaccaaaacgaaaaacccgtggacccacggtacccctccccgaacgtaccttaccctcttaacgttttactccgttaccacgttaccccaaccgacgggtccacgtagtactccgtaccccaacagtacttccgagtcgcgtaaggtcggtacgtgggaactaggtccttcgaacgtctacaccgaatcacgccgagtaccgtaacgtagacgttaaggaagttacgttcgggattaacggtttacttacgtacgttaccaaacgtagtcgtacgttcgtacggttcgacccgtacggtccgttaccggaccgacggaacacgtagttaggacgtactcggaagtccgacgtaggcgtacgtcgccacttagccttgtccttacg

SEQ ID NO: 91947 - DNA, 767 bp, Homo sapiens
  misc_feature: GYAE6OF02GJPO4.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgcccaccctctcctgcacgggccagtcaagaactagttgggtaagcctaacttagcccgttaggtaacccaaaacgaaaaaaccgtcggacccacgcccctacccagtacctcctactattttactcgttacactacccaccgacgggcccatgacttcgtaccccaactagtacttcgaggtacggactaggacgggttcaggggacacgtacttacgacgtcctaccgacctatacgacgaccgaacggtccgttaaccgagtttccgtaggtaaacgtaccgttcgggtacttaagttttacgttaaccgttaggttaacctaaacgttaagttcggttacggtaacgtacgggttaccggtacccgtttaccgggtaaccggtttcccgggaacccggtaaccggggtaaccctaacgtaacgggttacgggtaacgttaccgtaccgggtaacgggtaaccggttaaacggttcggggttaccgggtacccgttaccggaccccgtttaaacccgttacgtttaccccgggttttacgttcccgttttaaccccgg

SEQ ID NO: 91948 - DNA, 657 bp, Homo sapiens
  misc_feature: GYAE6OF02JDIXJ.5.57.F02.1.454.CMB.1.raw
  modified_base (205)..(205): a, c, t, g, unknown or other
  misc_feature (205)..(205): n is a, c, g, or t
  modified_base (309)..(309): a, c, t, g, unknown or other
  misc_feature (309)..(309): n is a, c, g, or t
  modified_base (631)..(631): a, c, t, g, unknown or other
  misc_feature (631)..(631): n is a, c, g, or t
tcagatcagacacgcacgaccggtgctcgatttagctcgatatagttgggtttggggggaggaactgctcagttaggacccagacggaaccatggaagccccagcgcagcttctcttcctcctgctactctggctcccagataccggttggggagatcgtgatgacggcagtctccagccatcctgtctgtgtctccgagggganagacgccaccctctcctgcgagggccagtccagaacattggtagacaacttacggcctggtaaccaaacaaaaacctggaccagccctacccagaacctcctanacttttactcgttccagtacccaccgtaacgggccacgtgactcgtaccccgaacagtattacgacggtggactagggtacgggtcgtagggactaggtacttcgaagttctaccacctacgtacacggacacggtaccgtacgtaacgtcgtagtaacgtacgttgggacttaagttttacgttaacttcggttaacaacgtaaacgttggtaggtacctaggtccgggtaccgtaccggtaaccggtttccggacccggaggggtaacccgtaaccgtaggtaacggattaacgtcggaacgggttacaacgtggtacgngcgtacaccgtactcgtcgttatccg

SEQ ID NO: 91949 - DNA, 742 bp, Homo sapiens
  misc_feature: GYAE6OF02H0QNO.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgcccaccctctcctgccacgggccagtcagaactattaggtagactaacttaagcctacggtaaccaaaacaaaaaccgtcggtaccacgaccctacccaagccttacctactaatttatccgttacacctccgaaccgacgggacctacgtagaccttaccgtacccaaacacgtactttacgaacgtggacgtaggtacgggtcgtacgggaactacggtaacttcgaagttcctaccaacgtaacgtacgtacgacgacggtacgttaaccgtaacgggttacaagggtaaacgtacggttcggaaccgttttaaagttttaacttacgttacggttaaccaaaacgttaagttcgggtaacgttacgttacgggaaccggttaccgtaccgggtttaaacggttccccgggtaacccgtaacgggaaccctaacgtacgggttaacgtaacgttcctaacgggacgggtaccaacggtttggacggttaccgtacgtaccgtacctaagttcccgtttgttaccgttacccg

SEQ ID NO: 91950 - DNA, 763 bp, Homo sapiens
  misc_feature: GYAE6OF02H4HT9.5.57.F02.1.454.CMB.1.raw
  modified_base (151)..(151): a, c, t, g, unknown or other
  misc_feature (151)..(151): n is a, c, g, or t
  modified_base (755)..(755): a, c, t, g, unknown or other
  misc_feature (755)..(755): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctccagataccgttgggganatcgtgatgacgcagtctccagccatccgtgtctgtgtcctccgaggggagagaacgcccacccgttctccgtgccgacggggccaggtcaagaactagtttcgggtaagacctaaacgttttcggacccttcgggttaaacccaaaaacctaaaaaacccttgggaaccctacggccccgttacccaagaccgttccctactattttacgttcgtttaccacttcccgaaccgacgggtaccacgttacgaacgttcgtacccctaaacgacggtaactttaccggagttcggacgtaaggtacggggttccgtacgggggtacaacggttaaccttccgtaagtcccgttaacccaacgacgttaccgacgcacggtaccgtaacgtacgtcgtaaggtaaacggtacgttacggtacgtaaggttttacttaacgttacgtaaccgtaaacgtaacgttacgtacggtagtacggttcggtaccgttaccgtaaccggttaccgtaccggtacggtaacgtaaccgtacggtagtagttacgtacggtaacggtccgtaacgtggtacggtcgtacgccgtaacgtaccgtacgtacggtnttaacccg

SEQ ID NO: 91951 - DNA, 730 bp, Homo sapiens
  misc_feature: GYAE6OF02H3WLD.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatccctgtctgtgtctccgaggggagagacgcccaccctctcctgccgacgggccagtcaagaacctagttaggtaagacctaacgttacggcccgttacggtaaaccaaaaccgaaaaaacccgtcggacccaacgcccctacccaacgtacctccctactaacttttacttcgttaccactcccaccgacggtaccacttgactccgacccaacgagtacttacgaggtacggccgtaagggacgggtcgtaggggaacctaggacctttacgacgttcctaccaaccgtataccgaagccgaacgtaccgtaaccgtaacgtacgtagtaaacgtcggttacggtacctttaaggttttaacttacgttacgtaacctaaaagttgttcggttacggtctagggttaccggcccgttaacgggtaacccggttccggaacccggtaacggaccgtaaggtacggttagacgttagtacggcgggaaaccgttacggtcgggtacgtccgtacgtaccgtaacctacggttccgttcggttacccttccg

SEQ ID NO: 91952 - DNA, 727 bp, Homo sapiens
  misc_feature: GYAE6OF02HW696.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (249)..(249): a, c, t, g, unknown or other
  misc_feature (249)..(249): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcgagggccagtcaagaactgttgggtanacctaacgttagccttacggtaaccaaaaccaaaaaccgtcggaccacgccctcccacgtaccttcctactactttattccttcactccaccgacggccacttcgactaccgtacccaaacctagtacttacgacggtacggcgaagggtacgggtacgtacgggactaacggtaccttacgacgttcctacaccctacgtacgacggacgtacggtaccgttaacgtacgttcgtaaggtaacgttacggttacggtaccgtttaaagtttttacttaacgtttcggtaacctaaacggttaagttggttaccggttacgtaggttccgggtacccgttacggttaacccggttccgggtacccgaacggggtaaccctaaggtacggttacgtagttaacgtaccggaacggtaccggtaaacgtggtaccggtaccgttcgtaccgaaccgttagtttccgtacgttcccttacg

SEQ ID NO: 91953 - DNA, 762 bp, Homo sapiens
  misc_feature: GYAE6OF02HLEYQ.5.57.F02.1.454.CMB.1.raw
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagactaccggttggggagatcgtgatgacgcagtctccagccatcctgtctgtcgtctcgagggganagcgcccacctctcctggcgacgggcctaggtacaagaactagttgggacgacctaacttacgccgtacggtaaaccaaaaccgtaaaaaaccgtcggaccaaccgcccctacccacgtaccctccttactaacttttacttccgttacctacctacccgaaccgaccgggtacctacgtagacttcccgtaacccaaccagtaacttcgaggtcggacgtaggacgggttcgacggggaactacgtaccgttacgacgttccgtacaccctagtacgaccgacgtacgtacgtaaccttggtaccgtaaggtaacggtacgtttagggaaccttttaaggttttaacgttaacctcggttaaacgaaaccgttagttcggttacggtacgttcgggttaccggtacccgtacgttaacccgggttaccgggacccgttaaacgggaccgaacggtacgttcgggtactaacggtacggtaacggaccggttaacggtcggttacgggccgttacggacccgtacttaacggtttccgttaccgtttccgttaacccg

SEQ ID NO: 91954 - DNA, 561 bp, Homo sapiens
  misc_feature: GYAE6OF02IZGFL.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
  modified_base (406)..(406): a, c, t, g, unknown or other
  misc_feature (406)..(406): n is a, c, g, or t
  modified_base (516)..(516): a, c, t, g, unknown or other
  misc_feature (516)..(516): n is a, c, g, or t
  modified_base (546)..(546): a, c, t, g, unknown or other
  misc_feature (546)..(546): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgaggggganagacgcccacctctcctgcgagggccagtcaagacagttggancaacttagcctggtaaccaaaccaaaacctcggaccaagccctacccagactcctctatttatccgttcatccaccacgggccactcgatcgtcccaaacagtacttcagtgacaggagggtctagggacagtaaccgttctagtcctcacctatacgnacgtacgcgtaacagtctagaagtcgttagctagtttactacgtagtacaacattgcggtcagtcgccgtacgtaacggtcggaccacggaccagacggtagactgtacngggacctacgtgtgacgttcgacctaacgngttcctgttccgtac

SEQ ID NO: 91955 - DNA, 632 bp, Homo sapiens
  misc_feature: GYAE6OF02G127E.5.57.F02.1.454.CMB.1.raw
  modified_base (402)..(402): a, c, t, g, unknown or other
  misc_feature (402)..(402): n is a, c, g, or t
  modified_base (571)..(571): a, c, t, g, unknown or other
  misc_feature (571)..(571): n is a, c, g, or t
tcagatcagacacgcacgaccggtgctcgatttagctcgatatagttggggtttggggggtagggaacgtgctcagttaggacccagacggaaccatggaagccccagcgcagctctcttcctcctgctactctggctcccagactaccgttgggagatcgtgatgacgcagtctccagccatcctgtctgtctctccgaggggagagacgcctaccctctcctgccgagggccaggtcagtaactagttggagactaacttgcctaggtaaccaaacaaaaacctcggaccacgcctacccgagacctcctactattactcgtactactccacgacggacctactgactctacccaactagattacagtcggacaggacggtcgtacgggactagtacctntaaccggtctacgaaccttatacgactagtaccgacgtaccgtagtacgtagaaacggttcttacggtaacgtacttttacgtaccgttagtaaccgaaactaggtttcggtacggtacttaggccggttacctaacggttacgtccggtaccacgggacaacgtacgngtatacgacgaaggaccgtaccgtaggtccgagttcgaccaggttctacgttgtaccgtac

SEQ ID NO: 91956 - DNA, 686 bp, Homo sapiens
  misc_feature: GYAE6OF02IKFNR.5.57.F02.1.454.CMB.1.raw
  modified_base (153)..(153): a, c, t, g, unknown or other
  misc_feature (153)..(153): n is a, c, g, or t
  modified_base (216)..(216): a, c, t, g, unknown or other
  misc_feature (216)..(216): n is a, c, g, or t
  modified_base (251)..(251): a, c, t, g, unknown or other
  misc_feature (251)..(251): n is a, c, g, or t
  modified_base (291)..(291): a, c, t, g, unknown or other
  misc_feature (291)..(291): n is a, c, g, or t
  modified_base (334)..(334): a, c, t, g, unknown or other
  misc_feature (334)..(334): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtcgtctccgaggggagagcgcccaccctntccgtgcacgggccagtcaacgaacagtttggganacctaaacttcgccgtacggttaaccaaaacctaaaaacncggaccaacgcctacccgagacctcctctatttactcgttacncttaccgaccgtaggaccccatcgactccgaccctaacactattaccgaggtcgcctaggacggtcgtaggactacgtactcgtagttccacgtaccgtatcacgactaggactacgtagtctaggaagtccgttagaccttagtttaacttacgtacgttaacaaacttacgtggttaacgtcgtaaacggtcggtacccgttaacggtaaccgtttccggaaccggtacggaccctaacgtaaggttacggtaagtaccgtccggtaaacgacccggttacgtaacggttccggtaccgttacggacccgtaaaccgttacctaccggtttaccttacgtttaaccccgg

SEQ ID NO: 91957 - DNA, 760 bp, Homo sapiens
  misc_feature: GYAE6OF02FU3QT.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgcgacgggccagtcaagaacattgggtacactaacttgcctaggtaacccaaacaaaaaccgtcggccacgccctacccagacctcctactatttactcgttcactcccacgacgggccacgtgatcgtacccaacagtacttcgagtcggacaggtacgggtcgtagggacacggtacttacgacgttcctaccgaccgtactaccgacgtacgaacggtaccgtaaccgtaggttacccgtaggtaaaccggtaccgtttagggtacccttaaaggttttttaaccttaacgtttaccggtttaaaccctaaacgttaaacgtttcgggtaacgggttccgtaaacgggttccgggttaaccccggttacgggttaacccgggtttacccgggacccccggtaacgggtaacccctaacggtaacggggttacggtaacgttacgtaccgtaaaccgggggtaccgtaaacggttcgggttacggtaccgttaccggacctaacccgttacgtcccggtttacgtttaccctttaccgg

SEQ ID NO: 91958 - DNA, 846 bp, Homo sapiens
  misc_feature: GYAE6OF02F0GS1.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtcctccgaggggagagacgccaccctctccctgcagggccagtcaagaactattggtacgctaacttacgcctaggtaacccaaaactaaaaaccgtcggacccacgtcccctacccacgacctcctactaatttactccgttacactcccaaccgacgggtccctacgtcgtactaccgtaccccaaaccgtacgtacttaccaagggtcgggaccgagggtaacggggttccgtaacgggggacctaacggtaaccgttcgaacgtttccctaaccgaaccctacgtaccgacggtaccgtaaggtacccgtaaacgtacggttacccggttaaggaaaccgggttacgtttacgggtactttaaacggttttttaaaccgttaaccggttacggttaaaccgtaaaccttaagggtttcggttaccgggtaacggttacggttacccggggtacccgttaacgggtaaacccgggtttcccgggaaccccgggtaaacggggtaccctaacgggtaacgggttacggtacttaacggtacccgggtaacggggtaaccggttaaccgggttagggttaccgggtcccgtacgggttaaccccctaaacccggttacgttttacccggttttcggttaaccccgttttaccccg

SEQ ID NO: 91959 - DNA, 834 bp, Homo sapiens
  misc_feature: GYAE6OF02H7YXG.5.57.F02.1.454.CMB.1.raw
  modified_base (202)..(202): a, c, t, g, unknown or other
  misc_feature (202)..(202): n is a, c, g, or t
  modified_base (266)..(266): a, c, t, g, unknown or other
  misc_feature (266)..(266): n is a, c, g, or t
tcagatcagacacgcacgaccggtgctcgatttagctcgatatagttgggtttggggaggaactgctcagttaggacccagacggaaccatggaagcccagcgcagcttctcttcctctgctactctggctccagataccggttggggacatcgtgatgacgcagtctccagccatcctgtctgtcgtcctccgaggggtanacgacgcccaacccttctcctggccgagggccctaggttaccaacgtaacgttgtttcgggaancctaaacgtttcgccgtacggtaaccaaaaccgaaaaaccgtggtaccaacgtccttacccgaacgtacccttactacttaacttttacgttccgtttaccaaccgttaccccaaccggtacgggtacccctaacgttcggtaaaccgttcccggttaaccccaaaaccgtaagttacctttacgtaacggttaaccggacgttaaacgggtacggggttccgtaacggaaccgtacggttaacctttcggtaacgttacctaaccgtacccgtaagttcgaaccggtacgtacgtaccggtttaacctaacgttcgtaacggtaaccgttaaccgttcggggtaacttaacggtttttaccgtaaacgttcgttaaacctaaaccgtttaagtcggtacgttaacgtagggtcccgtaccgtttacggaaccggtttccggaaccgtaccgggaactaccgtagttacggaccttaaggtccgtaacggtaccggtaaccgttacggtaccggtaccgttcgaaacccgtttccgaaccgggttaccttttacggtaccctttaacg

SEQ ID NO: 91960 - DNA, 476 bp, Homo sapiens
  misc_feature: GYAE6OF02FOVQR.5.57.F02.1.454.CMB.1.raw
  modified_base (433)..(433): a, c, t, g, unknown or other
  misc_feature (433)..(433): n is a, c, g, or t
  modified_base (448)..(448): a, c, t, g, unknown or other
  misc_feature (448)..(448): n is a, c, g, or t
  modified_base (450)..(453): a, c, t, g, unknown or other
  misc_feature (450)..(453): n is a, c, g, or t
  modified_base (455)..(476): a, c, t, g, unknown or other
  misc_feature (455)..(476): n is a, c, g, or t
tcagatcagacacgcacgaccggtgctcgatttagctcgatatagttgggtttgggggggaagaggaagactgacggtccccccaggagtccagagtgcgtcgcaagtattggcagtgtgaaattttgacaccttatatgcagactctgtgagggggccgcttcaccgtgtccagagacaactccaagaacgccgtctatttgcagatggacagcctgagagtcgacgacacgggcaatctattattgtacggcggccgagcaatactctcttaactttctggagtcagggagtcccggtcactgtctcctcagcctccaccaaggcccatcgtcttccccctgcaccctcctccaagacgcacctctgggggcacagcggccctgggctgcctggtcaaggactacttcccgtgtctgatctgacgcgggcnggcaaggcgcagtgntnnnngnnnnnnnnnnnnnnnnnnnnnn

SEQ ID NO: 91961 - DNA, 802 bp, Homo sapiens
  misc_feature: GYAE6OF02FQTHC.5.57.F02.1.454.CMB.1.raw
tcagatcagacacgcacgaccggtgctcgatttagctcgatatagttgggtttgggggaggaactgctcagttaggaccagacggaaccatggaagccccagcgcagcttctcttcctcctgctactctggctcccagataccggttggggagatcgtgatgacgcagtctccagccatcctgtctgttgtctccgaggggagagacgcccaccctctccgtgaccgagggccagtcaaggaactattgggtacacaacgtttagcctcggtaaccaaacaaaaacctggaccacgcccctacccaacgtacctccgtactacttttacgtccgttacctactccccgaaccgtacggggaccctaaccgttgacgttccggtacccccgaaaccctaaggtaactttaccgaacggttcggtccggtaagggtacggggttccgtagggggtaaccaacggttacctttacggtaaccgtccgtacccaacccgtaactttacgacggacctaaccgggtacgttaccgtacggtcgttaacggaaaacggttaccgtttaagggtacccgtttaaagtttttaaccgttttaaccgtacggttaaaccaaacgttaaagtttcgggttccggttaacgtacgggttacgggttacccgttacgggtaaacccggtttcccggggtacccgtaaacgggaccccgtaacggtaacggttacgggacttacggacgtaccggggaacctaggtccggtacggtcggtaacggcctaaccgtcgtacgtttcgtacgttaccc

SEQ ID NO: 91962 - DNA, 606 bp, Homo sapiens
  misc_feature: GYAE6OF02JEEAK.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (364)..(364): a, c, t, g, unknown or other
  misc_feature (364)..(364): n is a, c, g, or t
  modified_base (378)..(378): a, c, t, g, unknown or other
  misc_feature (378)..(378): n is a, c, g, or t
tcagatcagacacgcacgaccggtgctcgatttagctcgatatagttgggtttgggggaggaactgctcagttaggacccagacggaaccatgggaagccccagcgcagcttctcttcctcctgctactctggctcccagataccgttgggganatcgtgatgacgcagtctccagccatcctgtctgtgtctccgaggggganagacgccaccctctcctgcagggccagtcagaacnttggancaacttcgcctggtaaccaaactaaaaaccgtcggaccacgcctacccagacctcctactatttactcgttcactaccaccgacgggaccactgactcgtcccaaccagtacttcaggnggcgagcgggtcgngggacagtacttctacgtctacacactcagctacgacgtactacgtcgtagactacgttcggacttagtttacttacgtgtacaactagtgtacggtacgaggtcggtaccgtacggtaaccggtccggacccgacgggtccaacgtacggtacggtacttacgacgggtacggtaccggtaacgtggttacggtcgtaccggacacgtacttcgttcggtcttaccg

SEQ ID NO: 91963 - DNA, 784 bp, Homo sapiens
  misc_feature: GYAE6OF02G2269.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (254)..(254): a, c, t, g, unknown or other
  misc_feature (254)..(254): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganacgacgccctaccctctcctgcgacgggccagtccaagaacctagttggtanctaacttgcctaggtaccaaacaaaaaccgtggaccagcctcccagacctcctacacttttactcgttcctactacccaccgacgggccctacgtgtacgtccgtaccccaaaccgtacgtacttaccgaaggttacggaccgtaacggtacggggttacctacggggtacctaacggtacctttacgaacggttccctaaccaacccgtaacttaccgaacgtaccgtaacggtacccgttaacgaacggttccgttaaacgggaaacgttaaccggtttacggtaaccgttaaggtttttaacttaacccggttcgttaaaccgtaaacttaaggttacggttaacggttccgtaagggttaccggacctttaacgggtaacccggttttcccggaaccccggttaacggggaaacccaccggtaagttcgggaacttcgtaacggtaacgggtaccgtaaacggttcgggtaccggttactaccggtacctaccgtaaccggttcgttaccggttacctttacccgg

SEQ ID NO: 91964 - DNA, 824 bp, Homo sapiens
  misc_feature: GYAE6OF02HL8I4.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccgttggggagatcgtgatgacgcagtctccagccatctgtctgtgtctcgagggganagacgccacctctccgtgccgagggccagtacaacgtaactgttaggagacctaaacgttacgcccgttacggttaacccaaaacctaaaaaaccccgtcggaaccccgaacgtaccccttacccccgaaggtaacccttaccccgtacttaacttttaccgttaccggtttaccctaacctttacccccgaacccgtaaccgggggacccctaacccgtttacgtaacgttaccccggtaaccccctaaaacccggtaacgttaaccgtttaccgtaggggttacgacccggtaggggtaacggggttcccgtaacggggtactaacggttaccgttacggaccgtttcccgtaaccaaccctagttacccaggtacccgtaacggtccgttaacggtaccgttcgtaacgggtaaacgttaccggttacgggtactttaaacggtttaatttaccgtactaactaacgtaagttcggtacgttacgtacggtaccgtaccgtaacgggtaccggttcccgacccgtaacgggtaccctaacggtaagtcgtaacgtgtaccggtaaggaccctagtaccggtggacctacggtcaccgttagtccttagttccgttacccg

SEQ ID NO: 91965 - DNA, 698 bp, Homo sapiens
  misc_feature: GYAE6OF02HGSRG.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (240)..(240): a, c, t, g, unknown or other
  misc_feature (240)..(240): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagngccacctctctgcaggccagtcagaacagttgganctaacttgcctaggtaaccaaacaaaaacctggaccagccctcccagacctcctactatttactcgttcactccaccgacgggcctactagactcgtaccccaactgtacttcgaggtcgacgaggtagggtctagggacaggtacttcgagttcctacgaacctattccgaagaccgtacgacgttaacgtacgtaccgtaggtaaacgttacggttacggtacgttaacggtttttacttaaccgtttacggtaactaaacgttaacgttggttacggtacgtaacgggttcggtacccgttacggtaaaccggtttcccgggaacccgtaacggggaaccctaacggtacggttacggtacgttacgttaacccggaagggtaaccggtaacggttcgggtaccgggtacgtacggtaccctaaccgtacgttaccgttacggttaccttacccg

SEQ ID NO: 91966 - DNA, 514 bp, Homo sapiens
  misc_feature: GYAE6OF02GEYYE.5.57.F02.1.454.CMB.1.raw
  modified_base (486)..(486): a, c, t, g, unknown or other
  misc_feature (486)..(486): n is a, c, g, or t
  modified_base (491)..(514): a, c, t, g, unknown or other
  misc_feature (491)..(514): n is a, c, g, or t
tcagatcagacacgcacgaccggtgctcgatttagctcgatatagttgggtttggggggaagaggaagactgacggtccccccaggagtccagagtgcgtcgcaagtattggcagtgtgaaattttgacaccttatatgcagactctgtgaggggccgcttcaccgtgtccagagacaactccaagaacgccgtctatttgcagatggacagcctgagagtcgacgacacgggcatctattattgtacggcggccgagcaatactctcttactttctggagtcagggagtcccggtcactgtctcctcagcctccaccaagggcccatcgtcttccccctggccaccctcctccaagcgcacctcgtcggggcacgacgccggccctgggctcgccttcgggtcaacgggaccttaccttcccggtgtaccgttgacgttcgtggacggtcgggtcgtcggacgaagggccgacgtagtagagtcnctagnnnnnnnnnnnnnnnnnnnnnnnn

SEQ ID NO: 91967 - DNA, 737 bp, Homo sapiens
  misc_feature: GYAE6OF02JYFK2.5.57.F02.1.454.CMB.1.raw
  modified_base (154)..(154): a, c, t, g, unknown or other
  misc_feature (154)..(154): n is a, c, g, or t
  modified_base (212)..(212): a, c, t, g, unknown or other
  misc_feature (212)..(212): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganattcgtgatcgacgcagtctccagccatccgttgcttgtcgtcctaccggaggggganagacgtccccacccgttcgtcccgtgccgacgggccctaggtacaagtaacctagtttgggaacacctaaaacgttgccgttacggtaaccaaaccgaaaaaccgtcggaccaccgcccctacccgaacgtacctaccgtcttattttacgtaccgttactacctacccgaaccggtaccggaccctacctcgaccttacccgtaaccccaacgtaacttaccgttacgaaccgttacggacgtaacgggtacgggttcggtacgggaacctaacggtactttacggaccgttcctacctactacgtacgacgtaccgacggtcgtactagttacgagaccgtagttacggattacgtttattaccgtacgtacgtaacgttagtcgtacggttcgtacgtaccggttccgttaacggttaacccgttccgggaaccgtaccggtactacgggacgtagacgttaacgttacggaggttaccgtacgtggtacgtcgtacgacaccgtagttcgttcgtacctac

SEQ ID NO: 91968 - DNA, 917 bp, Homo sapiens
  misc_feature: GYAE6OF02JZ7GH.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagataccgttggggagatcgtgatgacgcagtctccagccatcctgtctgtgtctccgagggganagacgccctaccccgtctccgtcggccgaggggcccctagtaccgaagtaaactagtttgggtaacgtacctaaacgtttaccgtccgtacgggtaaacccaaaaccgtaaaaaacccgttgggaacccctacggtacccctaccccgaaggtacccctttaccgtaccttaagttttaacctccggttaccctaacttacccgaacccggtaccgggtaccctaaccgtacggtaaccgttaccggtaaccccccaaaccgtaagtaccttacggtaaggcggtaacctaaggggtacgggttacggtacggggtaacttacggttaaccttacggaaaccgtttaccgtaccccgtaaaccgttacgtaaccgtaacgggacgttaaaccgggtaccggtttaaaacttaccgggttacgtaaacgggttaaaccgttaacgggttaccgggtaaccctttttaaacggtttaaccgtttaacggtttaaccgttaaaccgttaaaacctaaagttttcgggtacgggtttaacccgtacggttacggtaaccccggtttaacgggtaacccgggtttcccccggggaaccgttaaaccggggaaacccgttacccggtaagggtacgttacgtagttaccgggaacggttaccggtaacggttaggttaccgacgttcgacccgtaacgttatccggttacgttattacccgg

SEQ ID NO: 91969 - DNA, 779 bp, Homo sapiens
  misc_feature: GYAE6OF02GXU7S.5.57.F02.1.454.CMB.1.raw
  modified_base (154)..(154): a, c, t, g, unknown or other
  misc_feature (154)..(154): n is a, c, g, or t
  modified_base (261)..(261): a, c, t, g, unknown or other
  misc_feature (261)..(261): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctggctcccagataccgttgggganatcgtgatgacgcagtctcagccatcctgtctgtgtcctccgaaggggacacgacgcccacccttctcccgtgccgagggtcccaggtcaaggaacctagttggacnccgtaaactttaggcccttagggtaacccaaactaaaaaacccgtcgggaccaacgcccctaccccgaagtacccttaccctacgtaacttttaacgttccggtttaccaattccccgaacccgtacggggtccccaaccgttcggaaccttacggttaacccccaaaccggtaacgttacgtttaccgtacggtacgggaccgtaaggggtacgggttccgttacggggaacctacgggtacctttacgaaccggttccctacctaacccgtactccgacggactaacggcccgtttaacgacgttacgttacgaaacggtacttacgggtcttaacggtttttattaaccgttggtacctaaacgtaatcggttacggtacgtaggttccggtaccgtacccgttaacggttccgggacccgtaacgggacctaacgaggttacgacgtacgtacggaacggtccgttaacgtcggtgtaccgtcgtaccaccgtagttcgtaccgttgttacccg

SEQ ID NO: 91970 - DNA, 593 bp, Homo sapiens
  misc_feature: GYAE6OF02GL0XM.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgccaccctctcctgccgagggcccagtccagaactgttggagcaacgttgcctaggtaaccaaacaaaaacctggaccacgccctaccgacgtacctcctactatttactcgttacactccacgtacggcctacgtgactcgacccaacagtacttcgagtcggacaggacggtcgtagggacagtactcgacgtccacactatacgagcgagtacgtacagtactagaacgtcgttggacttagtttactacgtcgtactaactagttgtagtacaggttcgaccgtacgtaaccggtccgaccgtaacggaccgaagtcgtacggactacgtacgacggtactacgtgtacgcgtacgacaccgtagtccgttacgtcgttaccg

SEQ ID NO: 91971 - DNA, 672 bp, Homo sapiens
  misc_feature: GYAE6OF02HLX3G.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccacccttctcctgacgagggccagtccagaacngttggagctaaacttgcctaggtaaccaaacaaaaacctcggaccagcctacccagactcctactatttactccgttacactccaccgacggccactgactcgtaccccaacgatacttacgaggtcggactaggacgggtcgtacgggaacacgtacttcaacgtcctacaccataccagcacgtcgtaactagtactaggaagtcgttaggacttaggttttaacttacgttgtaactaaagtagttaggtacgttacgaagggttaccggccctttaaccgggtaaccgtttacccgggacccgtaaaccgggggtacccaacggtaacggttacggacttaacgtaccggtaacgggacggtaaacgttcgggtacggtaccgttcgaccgaaccgtttaacgttccgttaccgttcctttaaccg

SEQ ID NO: 91972 - DNA, 671 bp, Homo sapiens
  misc_feature: GYAE6OF02H2C29.5.57.F02.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttgggagatcgtgatgacgcagtctccagccatccctgtctgtcgtctccgagggganagagcccacccttctcctgccaagggccagtcagaacngttggancaacttgcctggtaccaacaaaaacctggaccagcctcccagacctcctctatttactcgttcactccaccaggcccactcgatcgtaccccaacgagacttacgacgtggacctaggaacgggttcgtacggggacaaggtacctttcgacgttacctacgtacccagtaccgacgcaacggtaccgttacaagtaccttaggaaacgtacgttggactttacgtttaacgttaccgttagtaacctaaacgaagttacggttcggtacgtaagggtccgtacccgttaccgggttaaaccggtttcccggcccgttaaacggggacctaaccgtagtacgggactacgttaccgaacggtactaacggtcggtacgtccgttacggccctaaccgtacgttccgttaccgtttcttaacccg

SEQ ID NO: 91973 - DNA, 846 bp, Homo sapiens
  misc_feature: GYAE6OF02H4VOR.5.57.F02.1.454.CMB.1.raw
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (238)..(238): a, c, t, g, unknown or other
  misc_feature (238)..(238): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctccagataccgttggggagatcgtgatgacgcagtcctccagccatcctgtcctgtcgtctccgagggganagancccaccctncctgctagggccagtcagaacngttaggagcaaacttagcctaggtaacccaaaactaaaaaacccgtcggaccaagtccctaccccgagtaccttacccgtctaatttaacgttcgtttacctaactaccccgtaccgaagggtcccaacgttgtactacgaccccaaacgacggtaactttcgaacggtggaccgtaaggtaacggggttaccgtacggggtaaacgtaacgtaaccgttaacgtacgttcccgtaaccgtaaccccaacgttacgtaaacgccgtaacggtacccgtaacgtaagggtttaccgttaacggaaaacgttaaccgttaggggtaaccttaacgggttttttaaacttaaccgtttaccggttaacaaaacttaaacggtaggttaaccgggtttacgaagggttacccgggttacccgttaaccgggttaaacccggtttaccggggttaaaccccgaaaccggggtaaccccgtaaccgttaaagggtacgggtaacttaaccggtccggttaaaacgggggtcccgtaaaaacggtttcggggtacgttacccgttacgggtaccctaacccacgtttacccggtttaccgtttaccgttaacccg

SEQ ID NO: 91974 - DNA, 740 bp, Homo sapiens
  misc_feature: GYAE6OF02IPO6S.5.57.F02.1.454.CMB.1.raw
  modified_base (154)..(154): a, c, t, g, unknown or other
  misc_feature (154)..(154): n is a, c, g, or t
  modified_base (190)..(190): a, c, t, g, unknown or other
  misc_feature (190)..(190): n is a, c, g, or t
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagactaccggttgggganactcgtgatgacgcagtctccagccatcctgtctgngtctacgagggganagacnccctacctctcgtgcgacgggcctagtcaacgaacgtagtttcggacactaaacgttcgccgttaacggaaaccaaaacgtaaaaccgtcgggaccacgtacccctaccgaacgtacctcgtacttagttctacgtacactaccgacgacggacctacgtagtactccgtaaccaacgtagttactacgtacggtcggacgtaacgggtacgggtcgtaaacgggacgtaacgttaccgttacgactttaccgtacccgaacgtaactttcggaaccgacgacggttaccttaacgacgtctaaggtaaccgtaggtttccggaactttaacggtttacttacgtacggtaactaaacggtggtttacgacgggttctaacggtttacggaccgttacggttaaacggtccgacggtaaccggtactaacggaagttacggtactaacggtgtaaccgggtacgtaccggttacggttagacccgttacgtacgtaaacccgttcgggtccttttacggtaccgttaaccg

SEQ ID NO: 91975 - DNA, 737 bp, Homo sapiens
  misc_feature: GYAE6OF02F5W17.5.57.F02.1.454.CMB.1.raw
tcagatcagacacgcacgaccggtgctcgatttagctcgatatagttgggtttggggaggaactgctcagttaggacccagacggaaccatggaagccccagcgcagcttctcttcctcctgctactctggctcccagataccgtggggagatcgtgatgacgcagtctccagccatcctgtctgtgtctccgaggggagagacgccaccctctccgtcgcaggggccaggtcaagaactagttaggtacgctaacgttacgtcctgggttaacccaaacgaaaaacctcggacccagcccctacccgagtacctcctcgtaacttttactccgttcaacttccccaccgacgggtccctaacgtcggacttccggtaccccaacctagtactttccgaagtcggactagggtacgggtacgtcggggaacctacggtaccttacgacgttccctaactacccgaataccgaacgaccgaaacggtccgtaaacgaggttaccgtaaggaacggttacttgggaactttacgttttaacgttacttaggtaaccaaacgttgtcggtaggttaccgagggttccggtacccgttacgggtaaaccggtttccccgggacctaaaccgggacctaacggacggtttaggaacgttacgtacggtacggggaccttaacgggtgtaccgggtactacggaccgtaacccgtatttcccggttaacgttacccttaccgg

SEQ ID NO: 91976 - DNA, 679 bp, Homo sapiens
  misc_feature: GYAE6OF02I1O5F.5.57.F02.1.454.CMB.1.raw
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
tcagatcagacacgcacgaccggtgctcgatttagctcgatatagttgggtttggggagaactgctcagttaggacccagacggaaccatggaagccccagcgcagcttctcttcctcctgctactctggctcccagataccgttgggagatcgtgatgacgcagtctccagccatcctgtctgtgtcctccagggganagacgcccaccctctcctgcagggccagtcagaacnttggancaacttgcctggtaaccaaacaaaaccgtgccagccctacccgagacctcctctattttactccgttcacttcccaccgtagggacctacgtgatccgtaccccaacctagactttcgagttcggacgaagggtacgggtcgtcgggaactacggtaccttacgaacgtctaccaaccgtactcgaagccgaaacgtcggtaacagttccgaagtaacgtacgttacgggacttagttttacttaacttgtacctaaacgttagttaccgtacggtctaaaggttcgggacccttagggtaacccgttccggtacccgaaggggacccctaggtaccgggttagtacctttagacgggtaacgggttacccgaaggttaccggttcggtaccgtaccggtaccgaacccgttagttcccgttacgttcccgttacccg

SEQ ID NO: 91977 - DNA, 918 bp, Homo sapiens
  misc_feature: GYAE6OF02H5FB9.5.57.F02.1.454.CMB.1.raw
  modified_base (912)..(912): a, c, t, g, unknown or other
  misc_feature (912)..(912): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctcggcctcccaagacttaccgggttggggatactcggtgatcggacgcacgttccaccaggcctacttccgtggttacgtcgttcgtaccgtaccgggaagggggacgaacggaccgcccccttaaccccgttccgttacccggtaggacccgggtaacgggggtacccctaaggttaaccgaaaacggtaaaccgttaagggtttttaccggggaaacgtaaaccccgtttaaaacggttttccggtaaccccggttaaaaccgggttaaaaaccccaaaaaaacccggttaaaaaaccgttcccggggaacccctaacccgggtaccccccttaaccccggaaaacggttacccccctttaccttaaccgttttaacgttttaaccccgtttaccgttaccaaccccggttaaccccgaaccggtaccgggtacccctaacggttcggtaaccttacccggacccctaaacgtaacgtttcgttaacggaacggtcggaacggttacgggtaacgggttaccgaagggactacgttaacctcggtaacttacccgacgtaacctgaccaggacctacggtacgtacgttaagacgttacggtagtcgtacggtaattgtttaactacggtactaaagtacgtacgtgtaccgtcgtaggaccttaccggtacgtacccgggtccggaacaaccgggactaacgggtcgtcgacttaaccgggtcgaacggtaaccggttgaccggtctaccggctaacgttccgtattcccttaacggtntacccg

SEQ ID NO: 91978 - DNA, 716 bp, Homo sapiens
  misc_feature: GYAE6OF02JEEBD.5.57.F02.1.454.CMB.1.raw
  modified_base (154)..(154): a, c, t, g, unknown or other
  misc_feature (154)..(154): n is a, c, g, or t
  modified_base (171)..(171): a, c, t, g, unknown or other
  misc_feature (171)..(171): n is a, c, g, or t
  modified_base (250)..(250): a, c, t, g, unknown or other
  misc_feature (250)..(250): n is a, c, g, or t
tcagatcagacacgcacgaccggtgctcgatttagctcgatataggttgggtttggggaggaactagctcagttaggacccagacggaaccatggaagccccagcgcagcttctcttcctcctgctactctggctcccagataccgttgggganatcgtgatgacgcagtntccagccatcctgtctgtcgtctccaggggacagtagccacccgtctccgtagcagggccaggtccaagacattggtanctaacgttagcctggtaccaactaaaaacctggacctaggccctaccccagacctccgtctatttactacgttcattcccacgacgggaccaccgttgaactgtcccaaccagtacttcacgtggactacggaggtcgtagggacaggtaccttactagtcgttaccaccgtatccgtacgcctagtaccgttacgaacgtcgtacgtaaacgtaccgttaggtaccgtacggtttaacgttaccgtacgttaacgaaccgttaaaacgttcgggttaacgggtttccgaaggttaccggggtaccccttaacggttaaaccggtttccggggtacccgtaagggtaacccctaacgtaacgtcgggtaacgttacgtacggtcgggtaccgtaaaccggttcggttacgggtaccgttcggtaccgtaaccgtacgttcccgttaccgggttcctttaacccggg

SEQ ID NO: 91979 - DNA, 648 bp, Homo sapiens
  misc_feature: GYAE6OF02FQDT0.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtcctccgaggggagagagccaccctctcctgcagggcccagtccaagaactagtttgggtaagctaacgttagcccttggtaacccaaacaaaaaaccctggaccagccctcccagacctccctcacttttactcgttcatcccaccgacgggccacgtgactcgtacccaacagtacttcgacgtcggacaggagggtcgtagggacacgtacttcgacgttccacaccataccgacgcgaacgtcgtaacacggtctagaacgtacttggactagttttaacttacgtgtaactaaagtagttggtcggttacaggtcgtcccgttaccgtaaccgggttccggacccgtaacgggtaccctaacggtagtacggtacttacgacggtaacggtaccgtaaacggtcggtacggtctacggaccctaccgtaaccgttcttacggttcccttaaccg

SEQ ID NO: 91980 - DNA, 733 bp, Homo sapiens
  misc_feature: GYAE6OF02HE1ZV.5.57.F02.1.454.CMB.1.raw
  modified_base (154)..(154): a, c, t, g, unknown or other
  misc_feature (154)..(154): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggganatcgtgatgacgcagtctccagccatcctgtctgtgtctccgaggggagagagccaccctctcctgcagggccagtcaagaacattggagcaacttagcctaggtaaccaaacaaaaaccgtggaccagccctccacgacctcctactactttatccgttaccacttacccaccgacgggtccccaacgttcgacttccgtaccccaaaccagtactttaccgaggttacgggactaaggggtacggggttaccgtagggggaacctaacggtaccgtttacggaacggtttacccttacccaaacccgtattacccgacggtaccgaacggtaaccggttaacgtacggttaccgttaacggaaacgttacggttacggactttaacggtttacttacgtacgtaactaaactaagttcggtaggtctacggtcggtacccgttacggaaccggttccggacccggtaacggacccgtaagttacggtaggaacttacggaccgaaggggtacctaaacggttgggtacggtacgttcgtaccgaccctaagtttcccgtacgtttaccttaacccgg

SEQ ID NO: 91981 - DNA, 1040 bp, Homo sapiens
  misc_feature: GYAE6OF02HGFA3.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagatcgtgatgacgcagtctccagccatcctgtctgtgtctccgaggggagagacgcccaccctctccgtgcgacgggcccaagtcgaacgaactagttagggtaacgactaacgttacgccgttaacggtaacccaaaaacaaaaacccgtcgggaacccacgtccccctacccaaggtaccctacccttacgttaacttttacgttaccgttaccaacgtccccaaccggtacggggtacccctaacgttacggtaccttacccgttaccccgaaaaccgtacgttaacgttaccgaacggttacggtacgtaaacggggtacggggttccggtaacgggaaccgtaacggttaccgtttaaccggtaacggttacccctacccgtaaacccgttaaccgtaccgtaaacgggtacccgtaaacgggttaaccccggttaaaaccggtaacgggtttaaccctaagggggttaaaaccgtttaacccgggttttaagggggttaaaccccgtttttaaaaacggttttttttaacccggttaaaccgttttaacccggggttaaacctttaaaaccggtttaaggttttccgggggtttaaccggttacccgggttaaaccgggttaccccggggtttaacccggttttacccggggttaaacccccgggggttttaccccgggaaaccccgggggttaacccggggttaaaaccgtaaccccggggttaaacgggtaccggggttaaaccgtttaacgttaacccggggggtaaaccggttaacccgggtttaacggttaaaccggggtttcggggtaacccgttacgtaaccccggttaccccgttaaaggttttcccggttttacccggttacccttttacccgg

SEQ ID NO: 91982 - DNA, 576 bp, Homo sapiens
  misc_feature: GYAE6OF02HC8U7.5.57.F02.1.454.CMB.1.raw
  modified_base (153)..(153): a, c, t, g, unknown or other
  misc_feature (153)..(153): n is a, c, g, or t
  modified_base (478)..(478): a, c, t, g, unknown or other
  misc_feature (478)..(478): n is a, c, g, or t
  modified_base (548)..(548): a, c, t, g, unknown or other
  misc_feature (548)..(548): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccaggggagagagccaccctctcctgcagggcccagtcaagaacagttggtagctaacttagcctggtaaccaaacaaaaacctggaccagcctcccagacctcctcatttactcgttcacttacccaccgacgggaccacgtaggactcgttaccccaacctagactttcgacggtggaccaggagggtcgtagggacagacgtttcgaagtctacaccgtatcgagcagtcgtaacagtctagaagtacttgggactagtttatctagtacaactatgtgtacnggtcgcgtacgtacgttcgcccgtaggaccagacgtagactcgtacgaacggccgtaagttggcggtacncgacctacctaggttctgttaccttccg

SEQ ID NO: 91983 - DNA, 659 bp, Homo sapiens
  misc_feature: GYAE6OF02FQGXY.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgccaccctctcctgcagggccagtcagaacattggagcaacttgcctggtaaccaaacaaaaacctgaccagcctcccagacctcctcatttactcgttcactccaccagggccactgactcgtacccaaccagtacttcgagtcggactaggaggtctagggacacgtacttcgagtctacgaccactacgagccaagtccgtaacacgtctagaacgtacgttggacctagttttaacttactacgttaactaaacgtaagtttcggtacggttacgacggttcggtacccgtttaccggtaaccggttccgggtacccgaaacggggtacccctaacgtaacggttcggtaactacgtaccggtaagggtaccgtaaaacccggttggttaccggtacccggttacgaccctaaacccgtacgtttccgttacgttaccctttaacccgg

SEQ ID NO: 91984 - DNA, 711 bp, Homo sapiens
  misc_feature: GYAE6OF02G4P6W.5.57.F02.1.454.CMB.1.raw
  modified_base (153)..(153): a, c, t, g, unknown or other
  misc_feature (153)..(153): n is a, c, g, or t
  modified_base (189)..(189): a, c, t, g, unknown or other
  misc_feature (189)..(189): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtntctccgaggggagagacgccaccctctcctgcgacgggccagtcaagaactattggtagcctaacttaggccttaggtaacccaaaacctaaaaaaccgtcggaccaacggtcccctacccgaacgtaccttcctactacttttactccgttaccacgttacccaccgtacggacccctaacgtacgtacttacccgtaaccccaaacgtacgtaacttacgaggttacggaccgtaagggtacggggttccgtaggggaacctacggtacctttacgacgttaccctaccgaacctctacgacgtcaacgtaccgtacgaacgttcgtaaggaaacgttccgttaggtacttaggtttaacttacgtcgtaacaacgtatcggtggtcgtagggttccgacttaaccgggtaacggttccggacccgtaagggtacctaacgacggtgtacgtagtacggacggtaccgaacgtttggaccggtcgtacggaccaccgttacgttcttacgtcccttaacg

SEQ ID NO: 91985 - DNA, 806 bp, Homo sapiens
  misc_feature: GYAE6OF02FXYVD.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagcccagcgcagcttctcttcctcctgctactctggctcccagactaccggtgggganatcgtgatgacgcagtctccagccatcctgtctgtgtctcgagggganacgacgtccaccctctcctgacgagggcctaggtccaagaacctgtttacgggacgacctaacgttacgccttacggtaacccaaaacgtaaaaaccgtcggacccaacgtcccctaccccacggtaccttccctatacttttaacttccggttcaactcccgtaacccgacgggcccaacgttcgacttccggtaccccaaacgtaacgtacttacgaacggttcggacgtacggggtacgggttccggtacggggaactacggtttacctacgtaacgttcccgtacgttaacccgtacttaaccggacgtacccgaacggtacccgttaacgacgtttaacccgaaggtaaacccggttacttcgggttaacctttaagttttaaacgtttaaccgtagttaacccgtaaatttaacggtggtttacggttacgtacgttccgggtaacccgtttacgggtaaaccgggtttcccgtaaccccgggaacggtaccgtaccgtagggttaccgtactacggtaccggtaacgggaccttaaccgggtcggttaccgacggttaccgacttacccgttaggtcctttacggtacctttacccgg

SEQ ID NO: 91986 - DNA, 545 bp, Homo sapiens
  misc_feature: GYAE6OF02GHH0T.5.57.F02.1.454.CMB.1.raw
  modified_base (242)..(242): a, c, t, g, unknown or other
  misc_feature (242)..(242): n is a, c, g, or t
  modified_base (356)..(356): a, c, t, g, unknown or other
  misc_feature (356)..(356): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagcccaccctctcctgcagggccagtcagaacattggancaacttagcctggtaccaacaaaaacctggaccagcctcccagacctcctctatttactcgttcactccaccagggccactcgatcgtaccccaaccagattcagtcggcaggnggtctgggacagacttcagtcacacatcgagcagcgtacagtctagaagacgttggactagtttattactgtacaactatgtaggcagtcgcctagaccggttcgcccagggaccacgtagtaggactagtacgtaggaccgtaacgttggacggtctacggacctaccgagtcttacggttccttacg

SEQ ID NO: 91987 - DNA, 809 bp, Homo sapiens
  misc_feature: GYAE6OF02F7T4X.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggganagagcccaccctctcctgcagggccaggtcagaactagttggtacgactaacgttagcccttaggtaacccaaaacaaaaaacccgtgggaccctaagcccctaccccgaacgaaccttccctactacttttaacttccgtttacacttaccccgaccgaacgggtaccctaacgtgtaacttcggtacccctaaaccgtaagtaactttacgaggttccggaccgtagggtaacggggttccgtacggggacctaacggacctttacgacggttcccttaaccgaaccgtactaccaaggaccgtaagggtacccgttaaaccgacgggttacttaaagggaaaccgttacggtttaacgggaccgttaaaggtttttaaacgttaccgttaggttaaccaaaacgttaaacgttcgggtttaggttaccgtaacggggttacggaccccgtttaacggttaacccggtttacccggggacccgggtaaacggggacccctaaacggtacgggttacgggtaattacgtaccggaacgggtaccgtaaaccggtggtaccggtacgtcggacctaacccgtagttcccgttagttcccgttaaccg

SEQ ID NO: 91988 - DNA, 721 bp, Homo sapiens
  misc_feature: GYAE6OF02HE1G8.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgtgggagatcgtgatgacgcagtctcagccatcctgtctgtgtcctccgaggggtanagacgcccaccctctccgtgcgacgggtaccctagtacaagaacctagttagggtaagtacctaaacttcggccgttacggtaaccctaaacctaaaaaaccgtcggaaccctacgacccctaccccgtaacgaccctacctactactttaacgttccgttacctactacccgaacccgtacgggacctacgtacgtacgtaccgtaaccccaaaccgtacgtattaccgaaggtcggaccgtaggaacgggttcgtacgggactaacggtacttacgcgttactaccaccgtatccgactacgcgtaccgtaagtacgtacgtagtaacgtacggttagtacgttacgttttaacgtacgtacgtactaacgtagttggtaccgttagtacgtacggaccgtaccggtacggttacccgaccggtaaggacctacggagttaccgtacgtacgtacggacggaaccgtacggttggtacggtctccggtaacctacgtcgttaccgttcggtacttccg

SEQ ID NO: 91989 - DNA, 721 bp, Homo sapiens
  misc_feature: GYAE6OF02JEINI.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (254)..(254): a, c, t, g, unknown or other
  misc_feature (254)..(254): n is a, c, g, or t
  modified_base (280)..(280): a, c, t, g, unknown or other
  misc_feature (280)..(280): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtcctcgagggganagcgcccacctctccgtgcgacgggccaagtccaagtaactagttgggtacnctaaccttgccctaggtaacccaaanaaaaacccgtcggaccacgcccttacccagacctccgtactatttactcgttcaacgtccaccggacggccaacgtcgaactcgtaccccaactagtacttcaggtcgacgaggtacgggtcgtacgggacaaggttccttacgacgttacctaccgaaccgtactaccgaacgtctaacggtaccgaacgtacggtacttacggaaacgttacggtttcggacctttaaggttttaaaccttacgttacggttaccaaaacgtcgtttaggtccgggtttaacgaacgggttaccggttacccggtaaccgttaaccgggttcccggggtaaacccgtacggggaaaccctaccgggaggttacggacttacgacggtaacggtacggtaacgtcggtacggtcgtacggcctaaccgtcgttctacctttcgttacccg

SEQ ID NO: 91990 - DNA, 730 bp, Homo sapiens
  misc_feature: GYAE6OF02HYHIT.5.57.F02.1.454.CMB.1.raw
  modified_base (151)..(151): a, c, t, g, unknown or other
  misc_feature (151)..(151): n is a, c, g, or t
  modified_base (254)..(254): a, c, t, g, unknown or other
  misc_feature (254)..(254): n is a, c, g, or t
  modified_base (425)..(425): a, c, t, g, unknown or other
  misc_feature (425)..(425): n is a, c, g, or t
  modified_base (577)..(577): a, c, t, g, unknown or other
  misc_feature (577)..(577): n is a, c, g, or t
  modified_base (697)..(697): a, c, t, g, unknown or other
  misc_feature (697)..(697): n is a, c, g, or t
  modified_base (706)..(706): a, c, t, g, unknown or other
  misc_feature (706)..(706): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctgctccagataccggttggganatcgtgatgacgcagtctcagccatcctgtctgtgtcctaccgagggagagacgccacccttctccgtgaccgacgggtccagtacaagtaactagttagganaccgtaaactttacggccttacggtaaaccctaaaaccaaaacgtcggacccacgccccgtacccagtacctcctactaactttacgtcgttcactccaacgacggtacctagtcgtaacttccgtaaccccaacgtagtacgttgacggttcgaccgtaggacgggtacngggaacctacggtaccttcgaacgttcgtacccgtaacgcttacccggaagtccgaacggtaccttaaaccgtacgtaccgtaaggaaccggttacgttcgggtaacctttaaagttttaccgtacggttaccttaacgaaaccgtttaagnggtttccggttaaatacgggggttcctcccgtttaaaggtcccgttaccgggcgtaaaccgggcctaaccgttaggtcgtaacgtccgtaaagcgggaacgttaacgcggtcggtacccncggttaccnccgtacctggttaccctagttccg

SEQ ID NO: 91991 - DNA, 800 bp, Homo sapiens
  misc_feature: GYAE6OF02J0M6T.5.57.F02.1.454.CMB.1.raw
  modified_base (758)..(758): a, c, t, g, unknown or other
  misc_feature (758)..(758): n is a, c, g, or t
  modified_base (791)..(791): a, c, t, g, unknown or other
  misc_feature (791)..(791): n is a, c, g, or t
tcagatcagacacgcacgaccggtgctcgatttagctcgatatagttgggtttggggaggaactgctcagttaggaccagacggaaccagtggaacgccccgagcgcagcttctcttcctctgctactctggctcccaggtataccggttggggactatcggtagagttcggacgctaggttcctacccgaaggcccaacgttcccgtgttccgtggttcgtccgtaccggagggggacgaggaaccggtcccaacccgttctccggttagaccggaacgggtccctaaggttcccaaaggtaaaccttacggttttacgggaaccgtacctaaaccggtttacgtaccggtacggtaaccaaaaccgtaaaaccgtcggacctacgtcccctacccgaaggtacctacctactagtttaccgcgtaccgtactaccgaccggacggtacctacggtacgtacgttaccgtaacccaacgagtaccttcggtagtcggacggtagtaccgggtacgtacgggactacggtacttacggtacgttacctacgtaccgtagtccgaggtaccgacgttcgtaacggtacgtcgtaacgaacggttcgtacggtacttagttacttacggcttagaacttagttcgtacggttcgaccggttacggtacccgttaacgggtaccggttacccggacggtaccggaccgtacacgggttacgaacgttctaccggacgggttaccacggttggaccggttanacctaaccgggtccttaacggtcgtttacccgngttaacccg

SEQ ID NO: 91992 - DNA, 614 bp, Homo sapiens
  misc_feature: GYAE6OF02GABCA.5.57.F02.1.454.CMB.1.raw
  modified_base (202)..(202): a, c, t, g, unknown or other
  misc_feature (202)..(202): n is a, c, g, or t
  modified_base (332)..(332): a, c, t, g, unknown or other
  misc_feature (332)..(332): n is a, c, g, or t
  modified_base (349)..(349): a, c, t, g, unknown or other
  misc_feature (349)..(349): n is a, c, g, or t
  modified_base (575)..(575): a, c, t, g, unknown or other
  misc_feature (575)..(575): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgccaccctctcctgcagggccagtcaagactagttggagacaacgttcgcctaggtaaccaacaaaaacctgaccacgcctcccagacctcctcatttactcgttcactccgaccgacggccactnacgtcgtacccaactanattcaggtggacgaggaggtcgtagggacagtacttacacgtctacacctatacgacgactacggctaacgtacgtactagtaacgtacgttcgacttacgtttacttacgttacgtacgtaacagttaggttcggtacgacggttcgtacccgttacggttaaccgttcccggaccgtaaccggaccgtacgaggtcgtagtactcggtaacggtacgtaacggngttcggacgttcgaccgtactacgtcgttcttccttacg

SEQ ID NO: 91993 - DNA, 711 bp, Homo sapiens
  misc_feature: GYAE6OF02GA9VZ.5.57.F02.1.454.CMB.1.raw
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgccaccctctccgtgcgacgggcccagtccaagaaacctagtttcgggtagcctaaacgttacgcccttacggtaacccaaaaccaaaaaaccgtcggacccaacgcccctaccccaacgacctccctctaattttactcgttacactcccaccgtacggccactgactcgtacccaaccagtactcgagtggcaggagggtcgtaggacagtacttcgagttctaccacctactcgagtccgacggtacgtactacgtactaaggaacgttacggttgtacctagttttacttacgttgtaacaaactagttcggtagtacgtagttcggtaccgtacgtaaccggttcccggaaccggtacggtaaacccgtacggtaacggttacgggtacttaaccggtaccggtaaacggggtacccgtaaacgggttcgggttacgggtacccttacgggtaccccgtaacccgtaacgtttccgtttaccggttcccgttttacccg

SEQ ID NO: 91994 - DNA, 704 bp, Homo sapiens
  misc_feature: GYAE6OF02HH2T2.5.57.F02.1.454.CMB.1.raw
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
  modified_base (408)..(408): a, c, t, g, unknown or other
  misc_feature (408)..(408): n is a, c, g, or t
  modified_base (521)..(521): a, c, t, g, unknown or other
  misc_feature (521)..(521): n is a, c, g, or t
  modified_base (680)..(680): a, c, t, g, unknown or other
  misc_feature (680)..(680): n is a, c, g, or t
tcagatcagacacgcacgaccggtgctcgatttagctcgatatagttgggtttgggggaggaactgctcagttaggacccagacggaaccatggaagccccagcgcagcttctcttcctctgctactctggctcccagactaccggttggggagatcggtgatgacgcgagtctccagccattccgtgtctggtcttcgtccgagggganagacgccctaccgtctcgngcgacgggaccagtaccaggaactaggttaggtacgacctaacgtttacggtaccgttacgggtaaaccaaaaccgaaaaaccgtcggaaccacgccctaccgacgtaccctcctactatttactccgttacactacccgaacgacggcctacgtcgtacgtcccgtacccgaaaccgngtaaccgttcgaaggtcggtacgtaagggtacgggtacgtacgggtaacgacgttacgttacgtacgttacctaacccgtacgtaactccgaacgacgaagtacccgttaacncgggttaactacggtaattacggttaacggtacgtttaacgtttacgtttaccgtgtaaacctaagttacgttggtagtccgtaaggtcccgttacgtaccggtaccggtccgacgacgacgtagagtacgatcggtacaccggtgaactggtacgacncgaacaccttgactgttaactccg

SEQ ID NO: 91995 - DNA, 558 bp, Homo sapiens
  misc_feature: GYAE6OF02FSPRI.5.57.F02.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (390)..(390): a, c, t, g, unknown or other
  misc_feature (390)..(390): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccacctctcctgcagggccagtcagaacattggtagcaacttagcctggtaccaanaaaaacctggaccagcctacccagacctcctcatttatccgttcatccaccagggccactgatcgtacccaacagacttcagtcgcagaggtctgggacagacttcaagtctcacatcagacagcgtanagtctgaagtactggctaagtttcttaactgtactaaacattcggtagtcacggtggaccttacggaaccgttcgggacctacggaccacgacgtagatacgactagggaccgtaaccgtggtacggtacttcggacctacccgtaacgtccgttacgtacttacccg

SEQ ID NO: 91996 - DNA, 769 bp, Homo sapiens
  misc_feature: GYAE6OF02I901A.5.57.F02.1.454.CMB.1.raw
  modified_base (187)..(187): a, c, t, g, unknown or other
  misc_feature (187)..(187): n is a, c, g, or t
tcagatcagacacgcacgaccggtgctcgatttagctcgatatagttggggtttgggggaggaactgctcagttaggacccagacggaaccatggaagccccagcgcagcttctcttcctcctgcctactctggctcccagatacccgttggggagatcgtgatgaccgcagtctccagccatcctntctgtgtctccgaggggagagagccaccctctctgccagggcctagtcacgtaacagttggagacctaacgtttacgcccgttacggtaaacccaaaaccgtaaaaaacccgtcgggaccccacgtaccccctaccccgtaacggtaccttcccctactaactttttacgtccgtttacacttaccccaaccgacgggtacccctacgtaggtacttaccggtacccccgaaaccgtacgtacttacgagtcgggactacgggtaacgggttcgtacggggactaacgtccgtttacgcggttaccctccgtaacctacgccgaagaccgtaccgtaccgtaactacgggttacctaaggaacctacggtttagacgtttagttttacgttacgttactacgtaaaatacggtttgtaccggtagttacgggtcccgtaccggtttaccgggtaaccggttacccgggaccggtacgggtaaccctacgtaagggtcggaccttaaagtcccggaaggtaccgtacgttaggtccggtacttacgggaaccttacctaggttctttaccgttcgttaccccg

SEQ ID NO: 91997 - DNA, 620 bp, Homo sapiens
  misc_feature: GYAE6OF02HN6EI.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
  modified_base (254)..(254): a, c, t, g, unknown or other
  misc_feature (254)..(254): n is a, c, g, or t
  modified_base (301)..(301): a, c, t, g, unknown or other
  misc_feature (301)..(301): n is a, c, g, or t
  modified_base (309)..(309): a, c, t, g, unknown or other
  misc_feature (309)..(309): n is a, c, g, or t
  modified_base (420)..(420): a, c, t, g, unknown or other
  misc_feature (420)..(420): n is a, c, g, or t
tcagatcagacacgcacgaccggtgctcgatttagctcgatatagttgggtttgggggaggaactgctcagttaggacccagacggaaccatggaagccccagcgcagcttctcttcctcctgcctactctggctcccagataccgttgggganatcgtgatgacgcagtctccagccatcctgtctgtgtcctccgagggganagacgcccacccgtctccgtgcgaagggccagtacagaaacngttggaancaaacttgacctgtaaccaaacaaaaacgtggaccagcctacccganacctcctntatttatcgttcactccactaggaccactgatcgtacccaactagtactcgagtgcgaggacggtctaggactaggacttcgagtctacacactacgagcacgtacgtaanacgtcaggtaaacgtacgttcggtaacttagtttaacttaacgtacgtactaaagtagttacggaggtttacaggtacgtacccgtacgtaaccggttcccgtaccgtaacggggaccaacggtagacggtagtacgacgtaacggcgtaaccgtgggttacacgttacgacctaccgtacgtctttacggtccttaacg

SEQ ID NO: 91998 - DNA, 630 bp, Homo sapiens
  misc_feature: GYAE6OF02HQ5V5.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (246)..(246): a, c, t, g, unknown or other
  misc_feature (246)..(246): n is a, c, g, or t
  modified_base (563)..(563): a, c, t, g, unknown or other
  misc_feature (563)..(563): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctcagccatcctgtctgtgtctccgagggganagagccctaccctctcctgcgagggccagtcaagaacattggtancaacgttagccgtagtaaccaaacaaaaacctggaccacgcctaccagacctaccgtctaatttactccgttacaacttcccaaccgacggaccctaccgtagactacgtccccaaacgagtacttacgacgtggacaggtacgggtcgtagggacagtacgttcgagttacctacgaccgatcgacgactacggactaacgtagtactaggtaacgtacgtagtacgtaagtttacttacgtgtaactaactagtacggtagtcaacggtcgtaccgtagtaaccgtcgaccgtaacggaccaagtagtaccggtntaacggtccggaaggaccgtaacggtgtacggtgtaaccgctaccgactttcgttctaccgttaccg

SEQ ID NO: 91999 - DNA, 810 bp, Homo sapiens
  misc_feature: GYAE6OF02G6XSF.5.57.F02.1.454.CMB.1.raw
  modified_base (154)..(154): a, c, t, g, unknown or other
  misc_feature (154)..(154): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctcagccatcctgtctgtcgtcctaccgaggggagagacgcccaccctctcctgccgacgggccagtacaagtaactagttggaacactaaacgttacgccgttacggtaaacccaaaacaaaaacccgtcgggacccaccggacccctaccccgaacgtacccttcccttacttaacttttacgtcccgtttaccaaccttaccccgaacccggtaacgggtcccctaacgttacggtaccgtacccgtaaccccaaaccgtaacggtaacttaccggaaggttcgggacgtaaggggtacggggtacggtacggggaacctaacggttaccttaccggtaacgttacccgtaccgaaacctacgtaaccgacgtaccgtaaccgtaccggtaacgtacggttacgtaaggaaacgttacggttcggtaactttaacggttttaacttaacgtacggttaaaccaaacgttaggttacggtacggttaacgaacgggttccgtaacccggttaccgggtaaaccggttcccggaaccccggtaaagggtacccaaggtacggtaacgactacgtacggaacggtaacgtacgttcggtacggctaccggactaaccgtacgttcgttcgttacccttac

SEQ ID NO: 92000 - DNA, 542 bp, Homo sapiens
  misc_feature: GYAE6OF02IU9YO.5.57.F02.1.454.CMB.1.raw
  modified_base (152)..(152): a, c, t, g, unknown or other
  misc_feature (152)..(152): n is a, c, g, or t
  modified_base (201)..(201): a, c, t, g, unknown or other
  misc_feature (201)..(201): n is a, c, g, or t
  modified_base (455)..(455): a, c, t, g, unknown or other
  misc_feature (455)..(455): n is a, c, g, or t
  modified_base (525)..(525): a, c, t, g, unknown or other
  misc_feature (525)..(525): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagataccgttgggganatcgtgatgacgcagtctccagccatcctgtctgtgtctccgagggganagagccaccctctcctgcacgggccagtcaagaactagttggtagctaaacttacgccttaggtaaccaaacaaaaaacctcggaccaagccctcccagactcctctatttatcgttcatccaccagggccactgatcgtacccaacagtattcagtcggcaggacgggtctgggacaggtacttacgagtctacgaccatcagcagtcgtaacagtctagaagtacgttgacgtagttttatactgtactaanattgtagtcaggtcgccgtagaacgttcgaccaggaccacgagtgatatacgacggacacgtcgtggtcngacaccatctctcgtac

SEQ ID NO: 92001 - DNA, 804 bp, Homo sapiens
  misc_feature: GYAE6OF02H4PZM.5.57.F02.1.454.CMB.1.raw
  modified_base (155)..(155): a, c, t, g, unknown or other
  misc_feature (155)..(155): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggcctcccagactaccggttgggganatcgtgatcgacgcagtctccagcctatcctgtctgtcgtccgtaccggaggggagaacgacgccctaccctccgtctcgccggacgggaccagtacacgaacgtagttaggtacgacgtaacgttacgccgttaacggtaaaccaaaaccgtaaaaccgcggaccaaccgacccgtaccccgaacgtaccccttacctaactttacgtttaccgttaccgttacctaaacctacccgaaccggtaccggtaccctacgtacgtactacccgtacccaaacgtgtaactacgacggtacggacgtacggtcgggtacgtacggactaacgtacttcgtaaccttccacgtacctaagtacgagtaacctacggttacgtaaaccggttgtaaccgtaacgtaacggttacggtcggttaacttttaaaggtttaccgttaaccttaacggtaattaaacgttacgtgggtacgtacggttaacccgggttccgtacccggttaaccgggtaacccgggttaccgaaacccgggttccgaaacgtaaccgtaagggtaccggttaactaccgggttaccggaacgtaacgggtaccgttcggtacgacgttaccgacgtaccgttacgtccgttaccgttcttaacccgg

SEQ ID NO: 92002 - DNA, 716 bp, Homo sapiens
  misc_feature: GYAE6OF02HUXAB.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcggtgatgacgcagtctccagccatcctgtctgtcgtccgtccgaggggagagacgcccacccttctcctgcgacgggccagtcgaagaactagttgggtacacctaaacgtttgcccgttacggtaaacccaaaaccaaaaaccgtggacccacgaccccctacccgaagtaccctccctacttaacttttactccgttactacctacccgaaccggacgggacctacgtacgtactccgtacccaaaccgtagtacttcgaaggtcggacgtaaggggtacgggtcggtacggggaactaagtaccgttacgtacgtaccctaccaacctacgtaccacggacctacggtaccgtaacgtagttaccgaagtaacgttcgttacggtacttaagttttaacgttaccgtacgtaactaaacgtagttacggttacggtacgtacggttccgtaccgttaccgggtaaccggttcccgggaccgtaacgggaccacggtaggtacgactgaccgaacggtacgacgtggacgtctcgacaccgtactcgtgtacttccg

SEQ ID NO: 92003 - DNA, 608 bp, Homo sapiens
  misc_feature: GYAE6OF02HMU24.5.57.F02.1.454.CMB.1.raw
  modified_base (303)..(303): a, c, t, g, unknown or other
  misc_feature (303)..(303): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagcccaccccttctcctgccagggccagtccagaaccatttggagcaacttgcctggtaaccaaacaaaaacctggccagcctccagactctcatttancgttcatcccaccgaggccactgactcgtaccccaacagattcagtggacaggacgggtctggggaacaggtacttcgaagtctacacatcagcagctacagtctgaaagcttggactagtttacttactcgtactaaactagtcgttaggtcaggttacgggaccgtacggtaacggtttccgggaccctaaggggacccaacggtaggttcggatttacgtaccgtaacgggtccggaaacgttacgggtacggaccttcgggaaccctaaccgtacgttcccgtttcggtaccctttacccg

SEQ ID NO: 92004 - DNA, 775 bp, Homo sapiens
  misc_feature: GYAE6OF02HTA7U.5.57.F02.1.454.CMB.1.raw
  modified_base (154)..(154): a, c, t, g, unknown or other
  misc_feature (154)..(154): n is a, c, g, or t
  modified_base (159)..(159): a, c, t, g, unknown or other
  misc_feature (159)..(159): n is a, c, g, or t
  modified_base (205)..(205): a, c, t, g, unknown or other
  misc_feature (205)..(205): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccgttgggganatcgngatgacgcagtctcagccatcctgtctgtcgtctccggaggggganaggacgcccacccgttctcccgtggccgacggggtcccaaggttacaacggaaactagtttcggggaaacacctaaacgttcgtacccgttacggtaaaaccccaaaaaccgtaaaaaccgttcgggaaccccacgtacccccttaccccgaacgttaacccctccttaccgttatttttaaccgttccgttactaaccttccccgacccggtaacgggtaccctacgtagtaacttcccgtacccaactacgttactacgacggtagtaccgtaaggcgggtcgttacggggactacggtacttcgtatcgtaccacctagccagtccgtaggaccgtactaggtcctaggaactcggttagtactttaagtttcttaacgtacgtaacaagttagttcgtaccgggttcgacggtttaccggaccggttaaaccgtcgggttaccgaaccccgaacgggtactacgtaagtcgggtaattccgtaggaaccggtacggttaacctaggggttaccgccggtaacggttccccgaaactttaccgtcggttttcccctaaggtttcccc

SEQ ID NO: 92005 - DNA, 956 bp, Homo sapiens
  misc_feature: GYAE6OF02IR3SF.5.57.F02.1.454.CMB.1.raw
  modified_base (156)..(156): a, c, t, g, unknown or other
  misc_feature (156)..(156): n is a, c, g, or t
  modified_base (210)..(210): a, c, t, g, unknown or other
  misc_feature (210)..(210): n is a, c, g, or t
tcagatcagacacgcacgaccggtgctcgatttagctcgatatagttgggtttgggggaggaactgctcagttaggacccagacggaaccatggaagccccagcgcagcttctcttcctcctgcctactctggctacccagataccggttgggganatcgtgatgacgctacgtcctcagccattcctgtctgtcgtctccggagggganacgacgccctaccctctaccgtgaccgaacggggccctaacgtacgaaacgtaaacgtacggttcggggtaaacgtaccctaaaacgtttaccggaccccgttaacggggttaaaaaccccaaaaacccgtaaaaaaaaccccggttcgggtaacccccgaacccggttaaccccctaaccccccgtaaaccggtaaacccgtttacccccttaaccgtttaaaaccggtttttaaccttaccccggtttttaaccctaaaccgttaacccccggtaaaccccggttaaacccgggggtaccccttaaccggttacggtaaccgtttacccggttaaaaccccctaaacccggaaacgttaacgttaccggaacggttacggaccgtaaacggggtcgggttacgggtacgggtaacaacgttaccgtacgtacgtacctaccgtaacctagtaccgtaacggtaccgtaacggttacccgtaacgttacggttaacccgttaacggaaacgtttacgggttaccggtaattttaaaccgggttttaacttaaccgggtaaccttaacgttaaaaccgttagttacggaacggtttacgtaagggttcccggttaaccggttaccggttaaacccggttccggaaccccggttaagggtaccctaagtacgtacggtactacggtacgacggtaactaaggtcggtagtccgtacgaacgtacgactttacggttcgtacttaccg

SEQ ID NO: 92006 - DNA, 672 bp, Homo sapiens
  misc_feature: GYAE6OF02GY0OP.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (516)..(516): a, c, t, g, unknown or other
  misc_feature (516)..(516): n is a, c, g, or t
  modified_base (639)..(639): a, c, t, g, unknown or other
  misc_feature (639)..(639): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgcccaccttctccgtggacgacgggccaggtcaagaactagtttgggacactaacgttcgacctaggtaacccaaacgtaaaaccgtggaccacgcctacccgacgtacctcctactactttactcgttacactccaaccgacggacctacgtacgtactccgtaacccaaccgtagtacttacgaggtacgacgtacggtacggtcgtacgggactacgtacgttctaacggtcctaccaccgtagtacacgacaacggtaccgtaagacgtctaacggacgtacgttacggacttaacggttttaanaccgtttagaacctaaacgttagtcggttacggtactcggtaccggtcttacggtaaccgggttccgaaccgacggtaacacgtagtcgtatactacggaaggtaccgtacggttgacgggtntaccgactaccgtaatcgtaccgttctaaccgg

SEQ ID NO: 92007 - DNA, 588 bp, Homo sapiens
  misc_feature: GYAE6OF02JE7R8.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
  modified_base (243)..(243): a, c, t, g, unknown or other
  misc_feature (243)..(243): n is a, c, g, or t
  modified_base (366)..(366): a, c, t, g, unknown or other
  misc_feature (366)..(366): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtcctccagggganagacgccaccttcncctgcagggccagtcagaacattggancaacttgcctggtaaccaaacaaaaacctggaccacgcctcccagacctcctctaatttatcgttcactccaaccagggaccactcgaatcgtacccaaacagacttcagtgacagagggtcngggacagtacttcgagtctcaacatcagacagccgtacagtcagaagtacgttaggactaagttttactacgtagtaacctaaacaacgttagtacgggttcaaggttccgtacctaccggtaacgtttccggaccacgggtaaccacgagtacggattacgacgtaaggaccgtaacgtcggtaggtaccgtcgaccaaccgtactacttcgtcttaaccg

SEQ ID NO: 92008 - DNA, 717 bp, Homo sapiens
  misc_feature: GYAE6OF02IVYZ8.5.57.F02.1.454.CMB.1.raw
  modified_base (156)..(156): a, c, t, g, unknown or other
  misc_feature (156)..(156): n is a, c, g, or t
  modified_base (216)..(216): a, c, t, g, unknown or other
  misc_feature (216)..(216): n is a, c, g, or t
  modified_base (232)..(232): a, c, t, g, unknown or other
  misc_feature (232)..(232): n is a, c, g, or t
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
  modified_base (655)..(655): a, c, t, g, unknown or other
  misc_feature (655)..(655): n is a, c, g, or t
tcagatcagacacgcacgaccggtgctcgatttagctcgatatagttgggtttgggggaggaactgctcagttaggacccagacggaaccatggaagccccagcgcagcttctcttcctcctgcctactctggcctccagactaccggttgggganatcgtgatgaccgctagtctccagccattccctgtcttcggtcgtcctaccggagggganaggacgccctaccctntccgtaggccgacgggctacgtacgaagaactagttgggacactaacttacgccgtaacgtaccgaaaacaaaaccgtcggaccacgtcccctaccgacgtacctcctacttacgttacgtaccgttacacctcccgaaccgtaaccgggacctacgtcgtacgtacccgtacccgaaactacgtacttccgaggtacgcgaaggtacgggtcgtacgggaacacgttactactcgttaccnctaaacncgtacgcgtaccgtagtaccggtaactagttcgtaagaccggtaagttacggtaacgtttaacgttaatttaccgattaaacgtaaccgtagttcggtacggtctaggtaccgggtccgttaccggtaaccggttcccgccggttaaaggaccccgagtcgggtaatacgttanaccgggttagaaccggtcgttaggtcgctaccgacttaccgtgtcccggtaattccgtaacc

SEQ ID NO: 92009 - DNA, 690 bp, Homo sapiens
  misc_feature: GYAE6OF02I87XN.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcccaccctctcctgcagggccagtcaagaacngttggancaacttagcctaggtaaccaacaagaacctggaccagcccctacccagacctcctactattttactccgttcaattcccaaccgagggaccctaacgtgaacttccgtaaccccaaacgtagtacttaccgaaggttcggacctaagggtaacgggttcgcgggaactaacggtactttacgaagttcctacctaacccgtactaccgtaacggacctaacggtaccgtaaaccgtaagttacccgttaaggaaaaccgttaccggtttaggacttaaggttttaacttacgttagtaacctaaacgtattcggttagtacgtacggtcggtaccgttacggtaaccgttccggacccgtaacgggacctacgtaggtagacgttacgtacgaaggtaccgtaacgtcggacgtcgtacgaccgtaccgtattacgtcgttaaccg

SEQ ID NO: 92010 - DNA, 722 bp, Homo sapiens
  misc_feature: GYAE6OF02IA6EB.5.57.F02.1.454.CMB.1.raw
tcagatcagacacgcacgaccggtgctcgatttagctcgatataggttggggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggggacaggacgccacccttctcctgcacgggccagtccaagaacagttgggtaagcaacgtttaacgccgttacggtaaacccaaaaacaaaaaaccgtcggaaccctaacggcccctacccaagaccttaccctactatttaacttcgttactactacccaaccgacgggccaacgtgaactcggtaccccaaacagtacttacgaggtacggaccgtaggtaacgggtcgtacggggaaacgtacgtaacgttcgaagttccgtacctaacctacgttaccgaagtacgaacggtacgttaaccgagttaccgtaaggaacgtacgttaggaccttaaggttttaacttaacgtgttaaccaaagttaaacgtggttacggatacgggtacggtaccgtaccgtaaaccggttcggaacccgtaacgggacctaaacggtcgtaggtaacttacggcgtaacgggaacctaggtcggtacggcgtacgtaccctaacgtactcttaccggtcttaaccg

SEQ ID NO: 92011 - DNA, 708 bp, Homo sapiens
  misc_feature: GYAE6OF02GTYKT.5.57.F02.1.454.CMB.1.raw
  modified_base (194)..(194): a, c, t, g, unknown or other
  misc_feature (194)..(194): n is a, c, g, or t
  modified_base (255)..(255): a, c, t, g, unknown or other
  misc_feature (255)..(255): n is a, c, g, or t
  modified_base (450)..(450): a, c, t, g, unknown or other
  misc_feature (450)..(450): n is a, c, g, or t
  modified_base (701)..(701): a, c, t, g, unknown or other
  misc_feature (701)..(701): n is a, c, g, or t
tcagatcagacacgcacgaccggtgctcgatttagctcgatatagttgggtttgggggaggaactgctcagttaggacccagacggaaccatggaagccccagcgcagcttctcttcctcctgtctactctggcctcccagataccggttggggagatcgtgatgacgcagtctccagccatctgtctgtgtcnccgaggggagagacgccctacctctcctgcgacgggccaggtacaacgaactagttggtanactaacttagcctacggtaaccaaaacgaaaaaccgtcggaccacgtaccctaccgacgacctcctactagtttactaccgttcacctacccgaaccgacggtcccagttcgacgtacccgtaccccaaacgagttacttacgaggtcgagacggtaacggtcgagggtacacgtacttacgcgttacacacctnacgcgaccaggtacctacgtacgtagtacggaaagttcgttaggtacccgtttagtttaaccttacgtttaccgacttaaaacgtaggtttcgttagggtccgtagggttacccggtaaccttccggggaaaccggtttcccggaacccgtaacggggtaccaaggttagacggttaactaccggtaggaacgggtacccgtaaggtcggttacggtacctacgacccgtactaacctttcggttaccgtnttaaccg

SEQ ID NO: 92012 - DNA, 627 bp, Homo sapiens
  misc_feature: GYAE6OF02H5J7B.5.57.F02.1.454.CMB.1.raw
  modified_base (171)..(171): a, c, t, g, unknown or other
  misc_feature (171)..(171): n is a, c, g, or t
  modified_base (201)..(201): a, c, t, g, unknown or other
  misc_feature (201)..(201): n is a, c, g, or t
  modified_base (244)..(244): a, c, t, g, unknown or other
  misc_feature (244)..(244): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtcnccagccatcctgtctgtgtctccagggganagacgccaccctctcctgccagggccagtcagaactattggancaacttagcctaggtaccaaacaaaaacctggaccagcctcccagactcctctattactcgttcatccaccgagggccactgatcgtacccaacagattcagtggacaggtaggtccgagggacaggtacttcgaagtcctacgaccatcagcacggtacgtaacagtctaggaacgtacgttcggacgttaagtttttaactacgtttagtactaaactaagttcggtaggtccgtaggtcggtcccgttacggtaaccggttccggaaccccgtagggaaaccctacgtacggtagtacgttaagtaccggaagggtacccgaagttcggttacggtaccgttcggaccgaaccgtacgtttcgttaccggttcttacccg

SEQ ID NO: 92013 - DNA, 764 bp, Homo sapiens
  misc_feature: GYAE6OF02HH3BY.5.57.F02.1.454.CMB.1.raw
  modified_base (153)..(153): a, c, t, g, unknown or other
  misc_feature (153)..(153): n is a, c, g, or t
  modified_base (189)..(189): a, c, t, g, unknown or other
  misc_feature (189)..(189): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtntctccgagggganagacgcccacccttctcctagccgagggcctagtcaacgaactgttggacgactaaacgttgcctacggtaaccaaaacaaaaaaccgtcggtaccaacgtacccctacccgaacgtaacctcccgtactaacttttacgtccggtttacaactaccccgaaccggacggggtaccctaacggtcgtactaccgttaccccaaaccgtagtacttacgaacggtcggaaccgtacgggtacgggttcgtacggggactaacgttaccgttacgtaacggtccttaccgaaccgtaacttccgaacgtacgtacggtaaccggttacgtaacgtacgttaaggaaacgtcggtttacggacttttaagtttaacttacgtacggttaaacaacgttaacgttcgggtaggttaaccgtagggttacccgtaccggttacggtaaacccgggtttccgggaccgtaaaccgggtcctaaccgtaacggttcgagtttaccgacggtaacggacgtaacggttcgtacggtcgtacgacctaacgtacgtttctcgttacttccg

SEQ ID NO: 92014 - DNA, 695 bp, Homo sapiens
  misc_feature: GYAE6OF02HOX0G.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgaggggagagacgcccaccctctcctgcgacgggccaggtacaagaacagttggtagactaacttacgcccgtaggtaaccaaaaccgaaaaacccgtcggaccaacgcccctacccaacgacctcctactatttactacgttcactcccgaaccgacgggcccactacgactaccgtaccccaaccgtagtactacgaggtcggaccgtagggacggggttccgtacggggaacctaggtacctttcgacgttcccgtaccaccctacgtcaacgacctacggtactaaccgtagtccgtaagtaacgtacgttggacttaagtttattacgtcgtaactaacgtaagttggtacgtacgtacggttccggtaccgttaccggtaccggttccgggacccgtaacggggaccctaaggtacggttggacttagaccggaaggtacccggtaagtcgggtacgcgtacgccgtaacgtcgttacgttcgttccttaaccg

SEQ ID NO: 92015 - DNA, 724 bp, Homo sapiens
  misc_feature: GYAE6OF02GJ9ZZ.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctcgaggganagacgccacctctccgtgcgagggccagtccaagaactagttaggacgactaacgttacgcccgttacggtaacccaaaacaaaacccgtggaccacgcccctacccgagtacctccttatactttactccgttcactacccgaaccgacggcctactagacttaccgacccaacgagtacttacgagtcggacgaggtacgggtcgtagggacacggttactcgtacgttcctacgacctagtaccgacgaccgtaacggtaccgttacgtacggttacctaaggtaaaccggttacggttacgggaaccgttttaagtttttaacgttaccgttaggtaaaccctaaacggttaaggtttcggttacggtaccgtttaaacgggtcccgggttacccgttaacccgggttacgggttccccggaaccggaaccgggtaccacggtagggttacgtactaacgtcgggaacggtaacgttacggtggcgtcgtcgtacctacgtattcggttacgtctaccg

SEQ ID NO: 92016 - DNA, 545 bp, Homo sapiens
  misc_feature: GYAE6OF02GFUGW.5.57.F02.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (390)..(390): a, c, t, g, unknown or other
  misc_feature (390)..(390): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccagggganagagccaccctctcctgcagggccagtcagaacattggancaacttgcctggtaccaacaaaaacctggccagcctcccagacctcctcatttatcgttcactccacaggccatcgatcgtacccaacagacttcagtggacaggagggtcgagggacagtacttcgagtctcacactcagcagctacngtctagaagtcttggctagtttattactgtacaacaagttgtacgtctaggtcggcctacgtaacgttccggaccgaacgggacccagacgtgtatacgtacgaaggccgtaaactggttcggtactacgccaccgtactcgttacttcgttacc

SEQ ID NO: 92017 - DNA, 663 bp, Homo sapiens
  misc_feature: GYAE6OF02H7CNW.5.57.F02.1.454.CMB.1.raw
  modified_base (155)..(155): a, c, t, g, unknown or other
  misc_feature (155)..(155): n is a, c, g, or t
  modified_base (170)..(170): a, c, t, g, unknown or other
  misc_feature (170)..(170): n is a, c, g, or t
  modified_base (190)..(190): a, c, t, g, unknown or other
  misc_feature (190)..(190): n is a, c, g, or t
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (338)..(338): a, c, t, g, unknown or other
  misc_feature (338)..(338): n is a, c, g, or t
  modified_base (345)..(345): a, c, t, g, unknown or other
  misc_feature (345)..(345): n is a, c, g, or t
  modified_base (363)..(363): a, c, t, g, unknown or other
  misc_feature (363)..(363): n is a, c, g, or t
  modified_base (382)..(382): a, c, t, g, unknown or other
  misc_feature (382)..(382): n is a, c, g, or t
  modified_base (425)..(425): a, c, t, g, unknown or other
  misc_feature (425)..(425): n is a, c, g, or t
tcagatcagacacgcacgaccggtgctcgatttagctcgatatagttgggtttggggaggaactgctcagttaggacccagacggaaccatggaacgccccagcgcagcttctcttcctcctgctactctgctccagactccgtggggatatcgngatcgacgcagtccncactcatcctgtctgtgtcncgagggagacnccacctctcngacgtacggcctagtacagaactagttcggaagacctaacgttacgaccgtacggtaaaccaaaaaccgtaaacgtggcccacgccctacgaacgtacttctattattactctcaacctccaaccgngccctanacgtagccctaaccactntacttacgagcgacgttgngggtacgagactacgtaccgttcgatccgtaccacgtatacgngtaccagtacccgtatacgtacgtaacgaaacgttcggttacgtacttacgtttaataaccggttacaacttaacgttagttacggtcggttaacgttcggttaacggttaccgtaccggttaccgtaaccggtaccggggtaactcggtaaagaccgttaggtacgtttaaggccgtaaggacccgttaagtccggttacggctacggacgttacgtagttaccgtcttaacttccg

SEQ ID NO: 92018 - DNA, 626 bp, Homo sapiens
  misc_feature: GYAE6OF02F8PIY.5.57.F02.1.454.CMB.1.raw
  modified_base (202)..(202): a, c, t, g, unknown or other
  misc_feature (202)..(202): n is a, c, g, or t
  modified_base (273)..(273): a, c, t, g, unknown or other
  misc_feature (273)..(273): n is a, c, g, or t
  modified_base (382)..(382): a, c, t, g, unknown or other
  misc_feature (382)..(382): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagagccacccttctcctgcagggccagtcagacattggtataactgcctggtaccaacaaaacctgaccancctaccagactctacatttactcgttcactccaccgagggccagtgatacgtacccaaacagtattcagtgacaggaggtctaggacagacttcagtccacacatcgancagtcgtacacgtctagaacgtacgttacggacttaagtttacttacgttagtacctaaactaattagggtcgttacgtaaggttcggttacccgttacggtaaaccggtttccggtaacccgaacgggaaccctacggtaacggttaggtacgttacgtacgtacggtaaccggtaacgttagggtcggtaccgtacggtcctaacccggtacttaccggtttcgttaccttacgttaacccg

SEQ ID NO: 92019 - DNA, 853 bp, Homo sapiens
  misc_feature: GYAE6OF02GPK0J.5.57.F02.1.454.CMB.1.raw
tcagatcagacacgcacgaccggtgctcgatttagctcgatatagttgggtttggggggaggaactgctcagttaggacccagacggaaccatggaagccccagcgcagcttctcttcctcctgctactctggctcccagataccggttggggagatcgtgatcgacgcagtctccagccatcctgtctgtcgtctccgaggggagagcgcccaccctctccgtgcacggggccacgtcaagaacctagttgggtacgactaaacgttacgccgttacggtaacccaaaacgtaaaaaccgtcggaccacggtacccctacccgaacgtaccttccctacttacttttacgttaccgttacacctacccgaacccggtaacgggtaccctaacgtacggtacgttacccgtaaccccaaaccgtacgttacttaccggtaagggtacggacgtaacggggtacgggtacggtacgggaacgtaacggttaccttacggtacttcctacccgtaacctagtacccgaacgaccggtacggtaccgttaacggtacgttacgtaacggtaaaccggttacgttacgggtaaccgtttaagtttaaccgtttaacgtacggttaaacttaaaccggttaagtttacggttaccgggtacgttaaccgggttaccggttacggtttaccccgggttaacgggttaccccggtaacccgggtaacgggaaccctaacgggttacggttacggtacgtttaaccggacggttaaccggaacgggttaccgttacggtacccggtacggtaccgaacccggttaccgttaacgtttcccggtttacgttcccgttaaccg

SEQ ID NO: 92020 - DNA, 780 bp, Homo sapiens
  misc_feature: GYAE6OF02GUM2F.5.57.F02.1.454.CMB.1.raw
  modified_base (154)..(154): a, c, t, g, unknown or other
  misc_feature (154)..(154): n is a, c, g, or t
  modified_base (210)..(210): a, c, t, g, unknown or other
  misc_feature (210)..(210): n is a, c, g, or t
  modified_base (215)..(215): a, c, t, g, unknown or other
  misc_feature (215)..(215): n is a, c, g, or t
  modified_base (745)..(745): a, c, t, g, unknown or other
  misc_feature (745)..(745): n is a, c, g, or t
  modified_base (768)..(768): a, c, t, g, unknown or other
  misc_feature (768)..(768): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtagatcgacgcagtcctccagccactcctgtcttgtgtcctaccgagggganagacnccctaccctctccgtgcgacgggcctaagtaccgaacgtaactaggtttcgggaacaccttaaaccttacggtacccgttaccggtaaaacccaaaaaccgtaaaaaaacccgtcggggtaaccccaaccgacccccgtaaccccgaacggtaccctaccccgttaaccttaacgttttaaccgttaccgtttaaccgtacccttaacccccgaacccggacggggtacccctaaccgtagtacctaacccgtacccctaaaccgtaagtaccttacggtaacggtaggaccgaaggggtacgggtaccggtagggacgtaacggtacttacgtacgtcctacgaaccatacgacgacgtacgtacacgtacgtcgtaacgaacgtcgtacgtgtaacgtttacttaactacgtaactaattagtacgtagtacgtaggcgttaccgttacgtacccggtaccgaaccggtaaccgactaaggtacgtacgacttacggtacggtaacggtaacgtacggtacggaccgngtaccgaccgaccttagtttccnccgttaccgtcg

SEQ ID NO: 92021 - DNA, 707 bp, Homo sapiens
  misc_feature: GYAE6OF02JX409.5.57.F02.1.454.CMB.1.raw
  modified_base (204)..(204): a, c, t, g, unknown or other
  misc_feature (204)..(204): n is a, c, g, or t
  modified_base (250)..(250): a, c, t, g, unknown or other
  misc_feature (250)..(250): n is a, c, g, or t
  modified_base (492)..(492): a, c, t, g, unknown or other
  misc_feature (492)..(492): n is a, c, g, or t
tcagatcagacacgcacgaccggtgctcgatttagctcgatatagttgggtttggggaggaactgctcagttaggacccagacggaaccatgggaagccccagcgcagcttctcttcctcctgctactctggcctccagataccggttgggagactcgtgatgacgcagtctccagccatcctgtctgtgtcctccgagggganagacgacccacctctcctgcacgggccagtccagaactagttgganactaacgttagccgttaggtaaaccaaaacgtaaaaccgtcggacccacggtacccctaccgtaagtaccttcctactatttacgtccgttactacgaccctacgacggtcctaagtcgtaactcgtacccgaacgtagtacttacgacggtcgacgacgggtcggtcgtaacggacgaagttaccgttacgagttccaacgaccgtaagtccgagaccgtaacgtaccgtacgtaccggtnttaacggaacgttacgttacggaccgtttaagtttacgttacgtacggtaacaaacgtgttccggtagtacgtagttcggccgtaacggtacgttcccggaccgttacggtaccaggtacgtacggtacttaacggtacggtacgggaacttacggttacggacggttcctaaccggtacctaaccgtcgtttaaccgttcggtacccgttaccg

SEQ ID NO: 92022 - DNA, 731 bp, Homo sapiens
  misc_feature: GYAE6OF02F4SQE.5.57.F02.1.454.CMB.1.raw
  modified_base (159)..(159): a, c, t, g, unknown or other
  misc_feature (159)..(159): n is a, c, g, or t
  modified_base (219)..(219): a, c, t, g, unknown or other
  misc_feature (219)..(219): n is a, c, g, or t
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (679)..(679): a, c, t, g, unknown or other
  misc_feature (679)..(679): n is a, c, g, or t
tcagatcagacacgcacgaccggtgctcgatttagctcgatatagttgggttgggggaggaactgctcagttaggacccagacggaaccatggaacgccccagcgcagcttctcttcctcctgcctactctggcctcccagacgtaccggttggggganatcgtgatgacgcagtctccagccatcctgtctgtcgtctcgagggagagcgcccacctntccgtgccagggccagtcaagaacngttagganactaacgttagcctagaaccaaactaaaccgtgcacgccaccacgtctaccctattacgtttatccgttacactccaacgtaccggactacgcacctctaacccgaactagtacttcaggtcgtacggacgtagggttcgagggtacaaggtacttaccgagtacctaccgaaaccgtctaaccggagtaccgaacggtcccggtaaacgttacggtaaggtaacggaaacggtttcgttgggtaacccgttaaacggtttttaacttaaccgggttataacccggttaaaaacgtaaggttcgggtaacggttagttaaccggggacgttacccggtacgggttaacgtacccggggaacccgtaacgaaaccggttacggaacggttcgtaactcggtaaccgcggggtaaaccttaaccggggngttaccggtaccgacctaccgtaaccgttaggttcgtaccgttacgttaccc

SEQ ID NO: 92023 - DNA, 728 bp, Homo sapiens
  misc_feature: GYAE6OF02HWHWY.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (247)..(247): a, c, t, g, unknown or other
  misc_feature (247)..(247): n is a, c, g, or t
  modified_base (326)..(326): a, c, t, g, unknown or other
  misc_feature (326)..(326): n is a, c, g, or t
  modified_base (440)..(440): a, c, t, g, unknown or other
  misc_feature (440)..(440): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtcctcgagggganagacgccacctctcctgcagggccagtcaagaactagttggtanactaacgttagcctaggtaccaaaacaaaaaacctcggaccagcctacccgaagtacctctactaatttactccgttanactccaccacggccactcgactacgtacccaaccagattcgagttggaccgaaggagggtcttagggacacgtacttagacgttctacgacctatcacgacgagaccgttaacncgttactaacggtaaacgtacgttcggaaaccgtttacgtttttaaattaacccgttagttaaaccgtaaaacgttaaacggttcggttacgggttaacgaacgggtttaccggtacccgttaacggttaaacgggttccccggtaaccccgggtaacggggaaacccttaacggttaacgggtacgggttaacgttacggaaccgggtaacgggttacccggaaacgttcgggttaacggaccgttacggtaccctaacgacgtttacgttcgttaccgtttaaccg

SEQ ID NO: 92024 - DNA, 630 bp, Homo sapiens
  misc_feature: GYAE6OF02FIEBZ.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtcctccgagggggnagagccaccctctcctgcagggccagtcagacattggancaacttgcctggtaccacaaaacctggccacgcctccagactccctcagtttatcgttcactccaccaggccactgactcgtacccaaccacgtattcacgtggacaggagggtctagggacacgtactcgagtctcaccatcacgcagactcaagtctagacgtacttggactagtttacttactgtacaaacctaatcggtagtactacggttacggacccttacgggtaaaccggttccgggtaacccgaacgggtaaccgtaaccgacgggttcggtaacgtacgttaccggtaaccgggtaccggtaaaaccggttcggtacggggtaccgtacggtacccgtaacccgtacgtttaccgttccggtttaccctttaaccccg

SEQ ID NO: 92025 - DNA, 661 bp, Homo sapiens
  misc_feature: GYAE6OF02HJ4X7.5.57.F02.1.454.CMB.1.raw
  modified_base (154)..(154): a, c, t, g, unknown or other
  misc_feature (154)..(154): n is a, c, g, or t
  modified_base (190)..(190): a, c, t, g, unknown or other
  misc_feature (190)..(190): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttcgggtttggggaggaactgctcagttaggacccagacggaaccatggaagcccccagcgcagcttctcttcctcctgctactctggctcccagataccgttgggganatcgtgatgacgcagtctccagccatcctgtctgtntctccgaggganagacgtcccaccctctcctgcgaggtccagtcagaactagttggtagactaaacgttcgccgtaggtaacccaaaactaaaaaccgtcggacctacgcccctacccagtaccttccgtctatttactccgttacactcccacgacggccacgtgactccgtaccccaacgacgtactcaggttcgacgtaggtacgggttgacgggaactacgtacttacgtaagttccctaccaacgtactacgaacgtcgaaccgtcgtaacgtacgtcgtaagtaacgtcgttaggactttagttacttactacgtaacctaataagtcgttacggtaactcggttaccgtaccctacgtaacccggtccgaacccgaggtacccaacggtgtacgacgtacgttccgtaacggaccgtaactcggtacgtacctacgacctaccgtattcccgtcgtacttaccg

SEQ ID NO: 92026 - DNA, 706 bp, Homo sapiens
  misc_feature: GYAE6OF02H9MLU.5.57.F02.1.454.CMB.1.raw
  modified_base (156)..(156): a, c, t, g, unknown or other
  misc_feature (156)..(156): n is a, c, g, or t
  modified_base (263)..(263): a, c, t, g, unknown or other
  misc_feature (263)..(263): n is a, c, g, or t
  modified_base (531)..(531): a, c, t, g, unknown or other
  misc_feature (531)..(531): n is a, c, g, or t
  modified_base (668)..(668): a, c, t, g, unknown or other
  misc_feature (668)..(668): n is a, c, g, or t
  modified_base (677)..(677): a, c, t, g, unknown or other
  misc_feature (677)..(677): n is a, c, g, or t
tcagatcagacacgcacgaccggtgctcgatttagctcgatatagttggggtttgggggaggaactgctcagttaggacccagacggaaccatggaacgccccagcgcagcttctcttctcctgctactctggctccagtagtaccggttgggganatcgtgatgacgctacgtctaccacgcctactcctgtctgtcgtcctccggaaggggagacgacgcccacctctccagcgacgggtcagacaagaacgtgttcggancaacgttacgccgtacggtaaaccaaaaccgtaaaaaccgtcggaacctaccgccccgtaccaaacggtcctaccctactaactttactccgtacctactacccacggtacgacctacgtactacgtaccgtacccaaactagtactacgtaggcgtaacgagggtacggtcggacgacacgtactagtacgtcctacacgtatacgtacagtacgactacgtacgtaccggtaggaaacttggtaacgttacgttactttaaacgtnttacggaaactaacgttaagtcggtacgtacggtacggtaacgggtcccgttaacggtaaacccggttcccgaccggaacgggtaacaccgggaggttagagttaacgtcggaacggtaccgtaacgtacgggtcgnggttacccncgtaaccgttatacccggttctcttaccg

SEQ ID NO: 92027 - DNA, 850 bp, Homo sapiens
  misc_feature: GYAE6OF02F7BDB.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtcctccgagggagagacgccctacccgtctccgtagcgacgggcctacgtccaaggtaacctagtttgggtaacgacctaaaccgtttacgcccgttacggtaaaccccaaaaccgtaaaaaaccccggttgggacccctaacggtcccccttaccccgaacgtacccttcccctaccttaattttaaccgtcccggtttacaaccttccccgacccgacgggaccccacgttaggtaccttaccgtaacccccgaaacctaaggtacttacgacggtcggacgtacggggtacgggttcgtaacggggaacctaacgtaccgttacgtaacgttcccttaccgaaccgtactaccggacgtaccggaaccgtaccggttaaccgtacggttaccgttaacggtaaacgttacggtttcggaaccggtttaaacgtttttaaccgtttaaccgttagttaaccctaaaacgttaagtccgggtttacgggtacccgtacggttaccgggtacccgtttaccggaacccggtttcccgggacccgtaacgggacccgtaacggtacgtagggtacctaccggtacgtaaccggggtacttaacgggtcggttcggtaccctcgtaccgtaaccgtcggtttccggttcgttccgttaacccg

SEQ ID NO: 92028 - DNA, 842 bp, Homo sapiens
  misc_feature: GYAE6OF02IYJF1.5.57.F02.1.454.CMB.1.raw
  modified_base (150)..(150): a, c, t, g, unknown or other
  misc_feature (150)..(150): n is a, c, g, or t
  modified_base (155)..(155): a, c, t, g, unknown or other
  misc_feature (155)..(155): n is a, c, g, or t
  modified_base (164)..(164): a, c, t, g, unknown or other
  misc_feature (164)..(164): n is a, c, g, or t
  modified_base (171)..(171): a, c, t, g, unknown or other
  misc_feature (171)..(171): n is a, c, g, or t
  modified_base (211)..(211): a, c, t, g, unknown or other
  misc_feature (211)..(211): n is a, c, g, or t
  modified_base (636)..(636): a, c, t, g, unknown or other
  misc_feature (636)..(636): n is a, c, g, or t
  modified_base (749)..(749): a, c, t, g, unknown or other
  misc_feature (749)..(749): n is a, c, g, or t
tcagatcagacacgcacgaccggtgctcgatttagctcgatatagttgggtttggggagaactgctcagttaggacccagacgaacatggaagccccagcgcagcttctcttcctcctgcttactctggactccagataccggttggganatcgntatgaccgnagttccncagcctagtcctgtcctgtacgtccgtccggaaggggtanacggtacgaccctaccgttctcccgtaggacgtacggggacctacggccgtaaacggtaaccggttaatttcgggggaaacacctaaaacccggttttcgtacccggttaacgggtaaaacccctaaaaacggtaaaaaaaccccgttcgggaaaccccgttaacggacccccggttaaaccccaacggtaacccttaccccttacggtttaaaactttttaaccgttccggtttacctaaccgttaccccgtaaccgggtaaccgggtaccctaaccgggtagtaacccgtttaccggtaaccctaaaccgttacgtacttacgaacggtcggtaacaaggggtcgggttacacgggactaacgctttacgacgttacctacgtaacctagacacggtttacgacgtaccgttacaacggtttnacggtaaactgtaacggtaccttagtttaactactacggtaactaacgtagttccgtagtgtacggtaccgttacgtacggacggttcccgtacggaccgttaccgtaaacgngtttaccgaagtaacggttccgaagggttaacccgtaagttcgtacggtaacgtactacccgtaagtaccggttactttaccggtttaccgtc

SEQ ID NO: 92029 - DNA, 767 bp, Homo sapiens
  misc_feature: GYAE6OF02JW21Z.5.57.F02.1.454.CMB.1.raw
  modified_base (142)..(142): a, c, t, g, unknown or other
  misc_feature (142)..(142): n is a, c, g, or t
  modified_base (218)..(218): a, c, t, g, unknown or other
  misc_feature (218)..(218): n is a, c, g, or t
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
tcagatcagacacgcacgaccggtgctcgatttagctcgatatagttgggtttgggggaggaactgctcagttaggacccagacggaaccagtggaagccccagcgcagcttctcttcctcctgctactctgcctcccagtntaccggttggggagatcgtgatggacgctagtcctccagccctagtcccttgtcttgtcgtcctccggaggggganagccgaccctacccctntaccngccgaccgggcctacgtcgaagtaacctagttcgggtaacgacgtaaaccttcggtaccctacgggtaaacccaaaaccgtaaaaccgtcgggtaaccccacgtacccccgtaccgacgtaccccttaccttacttaccgttttaccgtccttacctaccgtaccccgtaacgtaaccgggtcccttacgtaggtacccttaccggaacccaaacgtaccggtatttaccgagggtcgacgtagggtaccgggtacgcgggtaaccgaatttccgtacgtccgttaccaaccgacgtacgtcgacgtacgacgacgtactaagtaccgaggtaccgtagttcgattacgtttatctacgacgttaagtactggtacgtacgtggtaccgttaccgtccggttaacccggtccggtaaacccggtacgggtactaacggggtctaacggttccgaggttaaccgcgggttaccgtacgttaggccgtaaggcccgtacgtaccgtgttacgttcgtacccgtttaccg

SEQ ID NO: 92030 - DNA, 818 bp, Homo sapiens
  misc_feature: GYAE6OF02JYGDE.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctctgctactctggctcccagactaccggttggggagatcgtgatgacgcagtctccagccatcctgtctgtgtctaccgaggggagagacgccacctctccgtgcgacgggccagtcaacgaactagttggtacgcctaacgttcgtaccgtacggtaacccaaacgtaaaaaccgtcggtaccacgccccttacccgacgtaccttaccgtacctaagtttacgtaccgttaccaccgttacccaaccggtacgggtacccctaacggttagtaaccgttccggtaacccccaaaccgtaacgttaaccttaccggtaacggttcggaccggtaacgggtaccgggttaacggtacgggggtaaacccaacgggttaacctttaccggtaaccgttcccgtaacccaccggttaactacccgaacggtaccgtacggtacccgttaacgtacggttaacgtacggtaacgtacgttacgtactttaacggtttaccgtttacgttacgtaacctaagtacgttaggtaccgggttatacggttaccgtcccggtaacggttaacccggttacggaaccccgttagggaacccctaaggtacgttaacggtacgttaaccgtcggtaaaccggtacggtactaccggggttacgtaccgtacgtaccggacctttaacggcgtttaccttacgttcccgg

SEQ ID NO: 92031 - DNA, 774 bp, Homo sapiens
  misc_feature: GYAE6OF02I40HJ.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagccacctctcctgcagggccagtcaagaactattggtacgactaacttaggcctaggtaacccaaacgtaaaaaccgtggaccagccctacccgagtaacctcctactaacttttaactccgttacaaccttaccgaaccgaacggggacctaaccgtacgtaacgtacccgtaacccgaaacctacgtactttaccgaagggttacggacgtacggaacgggttacgtacggggaactaggtacctttacgaagttccctaacaccgtaattaccgaacgggttaccaggtaccgtaaactaggttaccctagggtaaaaccgtcgtttacgggaaccgtttaagttttaacgttacttaggttaaacctaaacgttaaagtaggttacgtaacgttaccgggtacggtacccgtacggttaaaccggttcccggaacccggacggtaaccctaagtaccgtacgggtatttaacggccggtaacgggtaccgtaaaggttccggttacggtaaccgtaccggtaccggaaccttaacggtttaccctacggtttacccttaacccgg

SEQ ID NO: 92032 - DNA, 512 bp, Homo sapiens
  misc_feature: GYAE6OF02FX7UB.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (433)..(433): a, c, t, g, unknown or other
  misc_feature (433)..(433): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcccaccctctcctgcagggccagtcagaacattggancaacttagcctggtaccaacaaaaacctggaccagcctcccagacctcctcatttactcgttcactccaccagggccactgatacgtcccaacagtatcgagtcggcagagggtctgggacagacttcagtctcaccatcagcagctacagtctgaagacttggctagtttattactgtacaanatgngtnagtgctgacgttcgacctagggaccagagtggtatacgtcgaggacgtactggtgcgtgccaccgtatcgtcgtcgtac

SEQ ID NO: 92033 - DNA, 683 bp, Homo sapiens
  misc_feature: GYAE6OF02GXH95.5.57.F02.1.454.CMB.1.raw
  modified_base (248)..(248): a, c, t, g, unknown or other
  misc_feature (248)..(248): n is a, c, g, or t
  modified_base (451)..(451): a, c, t, g, unknown or other
  misc_feature (451)..(451): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttggggagatcgtgatgacgcagtctccagccatcctgtctgtgtcctccgaggggagagacgccaccctctcctgcagggcccagtcagaacattggacnctaactacgcctaggtaccaaaccaaaaccgtcggaccacgccctaccccagacctcctactactttacgtccgttacactacccgaccgaccgggtaccacgtcgtacgtccgtaaccccaaaccgtagtacttacgacggtggacgagggtacgggtcgtagggacacgtacgttcgaagttctaccaactctacgagacncggtacctaacgtggtacctaggtaaccgtacgttcgggtaactttacgtttattacgtagtaactaacgttgtaggttggtacgtaaggttccggaccgttccggtaaaccggtttcccgggaacccgtacggggaccctaacggtagtaccggataccgtcgggaacggtacgttaccgggtgtaccggtccgtcgtaacccgtagtccctttcgttacgttccttaccg

SEQ ID NO: 92034 - DNA, 827 bp, Homo sapiens
  misc_feature: GYAE6OF02FUNBL.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtcctcgagggganagacgccaccctctcctgcgagggccaggtcaagaactgttggacgctaacgttagccgtacggtaaacccaaaactaaaaacccgttcggacctacgccccctacccacgtaaccttccctactaacttttaacgttccgttaccaacgttacccctaacccggacggggtacccctaacggtagtaaccgttaccgtaacccccgaaacctaggtaaccgttccgaacggttaccggactaaggggtacggggtccgttaaggggaacctacggttaccttacgtacggttaccctaccgtaacctacgtacgacggtacccgaaaggtacccgtttaacgtacggtttacgtaaaggaaacgttccgttaagggtacccttaaagttttttaaccgtacgttaagtaaccaaacgttaaggttcggtacggttaacctagggtaccgttacccggttaacccgggttaaaccgggttccccggacccggttaaaccgggacctaaaccggtaggggtaccgttaagtaccgtaaccgggtaacgggaaccgttaaaccggtcggttcggtaaccgtcgtaaccccgtaccgtactttcggtttacccgttccctttaaccgg

SEQ ID NO: 92035 - DNA, 753 bp, Homo sapiens
  misc_feature: GYAE6OF02GQ4SE.5.57.F02.1.454.CMB.1.raw
  modified_base (153)..(153): a, c, t, g, unknown or other
  misc_feature (153)..(153): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagaggacgcccaccctctcctggcgacgggccaggtacaacgtaactagttgggtacgacctaaacgttcgccgttacggtaaacccaaaacctaaaaaccgtcggacccacgtaccccctacccgaacgtaccctccctacttaacttttacgtccgttacctactacccgaaccggacggcctactgactcgtacccaacgtagtacttcgaggtcggactaaggggtacgggtacgtacgggaactaacggtacgtttacgaacgttccctaaccgtaccctacgtacgacgtaccgtacggtaccgtaacgtacggtcgtaaacggtaacgtaccgttaaggtccctttaagttttaacttccgtagttaaccaaacgttagttcggttacgtacgacggttccggtaccttaccgggtacggttcccggaccgaaaccgggtaccctaaggtacgggttacgtacgttaactaccgggtaacggtaccgtaacgttcgggtaccgcgttaccgaccctaacgtacgtttccgtcggtttaccctaccg

SEQ ID NO: 92036 - DNA, 770 bp, Homo sapiens
  misc_feature: GYAE6OF02H42PV.5.57.F02.1.454.CMB.1.raw
  modified_base (161)..(161): a, c, t, g, unknown or other
  misc_feature (161)..(161): n is a, c, g, or t
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
  modified_base (212)..(212): a, c, t, g, unknown or other
  misc_feature (212)..(212): n is a, c, g, or t
  modified_base (276)..(276): a, c, t, g, unknown or other
  misc_feature (276)..(276): n is a, c, g, or t
  modified_base (608)..(608): a, c, t, g, unknown or other
  misc_feature (608)..(608): n is a, c, g, or t
tcagatcagacacgcacgaccggtgctcgatttagctcgatatagttgggtttggggaggaactgctcagttaggacccaggacggaaccagtggaacgccccaggccgcagcttctcttcctcctggctactctcggctcccagattaccgttggggganatcggtgactgacgcagtctccagccatccngtcngtgtctccgagggganacgacgcccgaccctcgtccgtgaccgacgggtcctagtacgaacgaaactagtttcggggaancgttaaacttcggtcccgttaggtaaacccaaaaccgtaaaaaccgtcggaccaccgacccttaccaagacccttcctacttaagttttaacgtcgttaaccactacccgtaaccgacgggcctaacgtcgaactccgtaaccctaaccgtagtacgttaccgtaaggccggtaacgacgggttacgggtcgttacggaaccgtagttacctaccggtaatccgtacctacggacttaccgacgacgttcggaacccgacgttacggtactacggtaaagtccggtttaaggcgttaacgttttacgaacgttttcaaacggtactttacgnggtagtacgaaccgtcggtacccgttacgggtaccggtacccgtaaccgtcgggtaaaccgtacggtacgtagtccgtaaacggtccggtaacggcttaaggttccggaccggtacgtacccgtacggaacctttccggttacttacggttacccgttaacc

SEQ ID NO: 92037 - DNA, 538 bp, Homo sapiens
  misc_feature: GYAE6OF02GJU0E.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (389)..(389): a, c, t, g, unknown or other
  misc_feature (389)..(389): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagacgccaccctctcctgcagggccagtcagaacattggagcaacttgcctaggtaaccaacaaaaacctggccagcctcccagactcctcatttatcgttcatccaccaggccactgatcgtcccaaccagattcagtgcagagggtctgggacagtacttcgagtctccgacatcagcagcgtacngtctagagtacttgctagtttatactgtacaactatgtgtactaggtcgtcgtacgacgttccggaccctagggacccagagtggtactgtaccgaagggtacgtaaaccgtggtacggcgtacgcaccgtactcgttacgtctttacg

SEQ ID NO: 92038 - DNA, 642 bp, Homo sapiens
  misc_feature: GYAE6OF02I9O77.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgccaccctctcctgcagggccagtcagaacattggagcaactagcctcggtaccaacaaaacctggcctagcctcccacgtaccgtcctactactttacgtccgttacaactccgaccgagggcccacgtcgacttacgtaccccaacgtacgtactcgacgtggaccgtagaacgggttcgtagggtacacgtcgttacctacgtctaccgacctacctcgacgcgacgtacgtaccaggtcctaaggtacgtacgttggaccttacgttttacgtttacacggttaccaaagtacgttacgttacgggtctacggttccggtaccgtacggtaacccggttccggaccgtaacggaaccgtacgtacgaggtactagtacgtaacggtactacgtggtcgttagtcgacctaccgagtccttagtccgttaccg

SEQ ID NO: 92039 - DNA, 755 bp, Homo sapiens
  misc_feature: GYAE6OF02FIV7U.5.57.F02.1.454.CMB.1.raw
  modified_base (205)..(205): a, c, t, g, unknown or other
  misc_feature (205)..(205): n is a, c, g, or t
  modified_base (657)..(657): a, c, t, g, unknown or other
  misc_feature (657)..(657): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtcctccagccatcctgtctgtgtcctccgagggganaggacgcccacccgtctccgtgacacgggcccagtcgaagaactagttcgggaacgactaacttacggccttacggtaacccaaacgtaaaaacccgtggacctacgtacccctccgaacgtactccccgtagttacttttacgttccttaccacttaccccaaccggacgggaccacgttagccttaccgacccaaccagtactacgtagtcggcgtacgggacgtcggtacggtacacggttactacggacttccgtacctacaacgtcgagacctaacggtccgtaacgtacgtacgtaacgtaacgtaccgttacgggtacttaagggtttttaactccgttaacgttaacccgaattaacggttggtacggttaccgaaccgggtttcggacccgtttaacggtacccgggttacccggacccgggtaaacggtacccttaacgggngtttaccgggtaatacggttacgggaaaccggttacgaaaccgggttccggtacgaccggttacgccctaaccgttatccgttacgtttcccctaacg

SEQ ID NO: 92040 - DNA, 813 bp, Homo sapiens
  misc_feature: GYAE6OF02FTYFD.5.57.F02.1.454.CMB.1.raw
  modified_base (152)..(152): a, c, t, g, unknown or other
  misc_feature (152)..(152): n is a, c, g, or t
  modified_base (207)..(207): a, c, t, g, unknown or other
  misc_feature (207)..(207): n is a, c, g, or t
tcagatcagacacgcacgaccggtgctcgatttagctcgatatagttgggtttgggggaggaactgctcagttaggacccagacgggaccatggaagccccagcgcagcttctcttcctcctgctactctggctcccagataccgtgggganatcgtgatgacgcagtctccagccattcccgtgtctggtgttcctccgagggganaggacgcccacccgttctcctgaccgacgggccctagtaccgaagaacctgttttacggaacgacctaaacgttacgacccgttaggtaaaccccaaaacaaaaacccgtcggaccccaacggtcccctaccccgaacgtaccttccctacttacgttttaaccgttccgttacctaccctacccgaacccggtaccgggaccctaacgttcgacgttcccgaacccccaaccgtagtaaccttcgtaacggtacggtaccgtaaggggtacgggttacggtacgggtaacctaacggttacccgtttacgtaccggtttaccctaccgtaaaccgtctaaccggtacgacggtaccgtaaccgtcgtaacgttacgtaggtaaaccgttcgtaaggtaccggttaaagtttttaccgtaacgttaccgtaacgtaaagttacgtttagggtccgtacggttaaacgtcggtcccgttaaaccgggtaaccgttcccgggaaccctacggggtacctaacggtacggttaggtacgacgttacggaggtaccgacgggttcgtaccggtcacggtcctaacgttactccggttccgtcttaacccg

SEQ ID NO: 92041 - DNA, 604 bp, Homo sapiens
  misc_feature: GYAE6OF02F9UW0.5.57.F02.1.454.CMB.1.raw
  modified_base (153)..(153): a, c, t, g, unknown or other
  misc_feature (153)..(153): n is a, c, g, or t
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgaggggagagagccaccctctcctgcagggccagtcagaacattggancaacttgcctggtaccaacaaaaacctggccagcctcccagactcctacactttancgttcatccaccacggccactgatcgtccccaacagacttcaaggtggacaggtacgggtcgtgggacagtacttacagtctccacatcagcaacgctaacgagtcctagaacgttcgttaggccttaagtttattaaccgtgtacaaactaacgtcgttaggtctagggttacggtcctaccggtaaccggttccgggacccgtaaacgggccaaccgtaggtacggtacgtacgtaccgaagggaccgtaacgttcggtacggcgttacgaccgtaaccacgttacgttacgttacgtttaccg

SEQ ID NO: 92042 - DNA, 661 bp, Homo sapiens
  misc_feature: GYAE6OF02G9I23.5.57.F02.1.454.CMB.1.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (242)..(242): a, c, t, g, unknown or other
  misc_feature (242)..(242): n is a, c, g, or t
  modified_base (494)..(494): a, c, t, g, unknown or other
  misc_feature (494)..(494): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctcgagggganagagccaccctctcctgcagggccagtcagaacnttggtanctaacttagccctggtaaccaaacaaaaacctggaccacgcctacccagacctcctactatttactcgttacacttcccaccgtacggcctacgtgactcgtaccccaacgtacgtacttcaggtcggctacggaggtcgtaggggacacggtaccttcgacgtctccaacctatacacgctaggacgtacagtacgtagaagtaactttggttacgtttattaccgttagtacaaacttatgtacggttanaacggttcggaccttacgggaaccgtttccggacccgtaacggaacccgacgtggtaacgggtactacgttaccggaacgggttaccggtaaaccgttcgggttacggtaccggttacgaacccgttacgttaacgttcgtttacccggtttacccttacgttaccc

SEQ ID NO: 92043 - DNA, 748 bp, Homo sapiens
  misc_feature: GYAE6OF02IVDOE.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagcgcccaccctctcctgccgagggcccagtccgaagaactagtttgggaacgacctaacgttacgccgttaggtaaaccccaaaacaaaaaccgtcggacccagcccctaccccgagacctcctacttaatttacgtcgttctactcccgaccgacgggccctaactggtaactcccgtacccaacgtagtacttcgacggtcgacgaaggtacgggtctagggactacggtactttaccaggttcctacccaacgtactaccgagaccgacgtaccgtaacgtacgttacgtacggtaaacggtccggttaggtaaccgttaacggtttttaacgttacgtacgtttaaccaaacggttacgttcggtacggtacgtaaccgggttcgtaacccggttacggtaacccggttccggaccccgggtaaaggggtacccctaacggtacggttacggtacgttacgtaccgggtaaccggtaccgtaacggttcggtacggtacgtacggtacgacccttaggtaccgttccggttattaccccgg

SEQ ID NO: 92044 - DNA, 869 bp, Homo sapiens
  misc_feature: GYAE6OF02HF6SC.5.57.F02.1.454.CMB.1.raw
  modified_base (153)..(153): a, c, t, g, unknown or other
  misc_feature (153)..(153): n is a, c, g, or t
  modified_base (171)..(171): a, c, t, g, unknown or other
  misc_feature (171)..(171): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtcnccagccatcctgtctgtcgtctccgagggganagacgccaccctctacctgcgagggaccagtccaacgaactagttggtaacgctaaacgttacggacccttacggtaaaccctaaaacctaaaaaacccgttcgggacccctaacggcccccgtaccccgaacggtacccttcccttacttaacttttaacgtaccgttttaccaaccgttacccgaaccccggtacgggacccctaaccgttacggtacgttaccggttaccccaaacctacgtaacctttacgacgggtcggacgtaacgggtcgggttacgtacgggactaacggtaccgttcgtaacgtcctaacccaccgtaacttccgacgtacgtaacggtacgttaccgtaacgttcgttaacggtaaacggttacgtttacgggtaacttttaacgggtttttaaactttaccgttaacggttaacctaaaaccgtttaacgttcggggttacgttaccgggtaacgggtttaaccgggttccccgtttaaccgggggtaaccccgttttccggggaacccccggtaaggggtaacccccgtaaacggttagggttacccggtagtaaccggttacgggaccgggtacggttaacgttaccgggtaccgttaggacccgtaccgtaccgttcgtcccggttttagaccccttttacg

SEQ ID NO: 92045 - DNA, 744 bp, Homo sapiens
  misc_feature: GYAE6OF02IHAP7.5.57.F02.1.454.CMB.1.raw
  modified_base (201)..(201): a, c, t, g, unknown or other
  misc_feature (201)..(201): n is a, c, g, or t
  modified_base (252)..(252): a, c, t, g, unknown or other
  misc_feature (252)..(252): n is a, c, g, or t
tcagatcagacacgcacgaccggtgctcgatttagctcgatataggttgggtttggggaggaactgctcagttaggacccagacggaaccatggaagccccagcgcagcttctcttcctctgctactctggctcccagataccgttggggacatcgtgatgacgcagtctccagccatcctgtctgtgtctccgagggganagacgcctaccctcgtcctgcacgggccagtcaacgaactagttgggtacnctaacttagccttaggtaacccaaactaaaaaccgtgggacccacgtcccctacccacggtaccttccaccttacttttactccgtttacacttcccaccgacggaccctaacgtcgacttacgtcccctaaaccgagtactttaccgaggtcggacctagggacgggtcgtaggggaccaacggtaaccttcgaacgtcctaccgaccgtaacgtttccgaacgacggtacgtacccggttaactacgggttaccaggtaaaacggttcgttacgtacgttaacggttttactaacgttacgtaactaaaccttagtcgtcggttaacgacggttaccgtaccgttaccggtaccggtttcccgggaccgtacgggtacccaggtaacgttccggaaggtttaccacgggtaacggtaccggttagtaacggggttcggaccctttacgggactaaccccggttacttcgggtttcttaccggtttaaccc

SEQ ID NO: 92046 - DNA, 897 bp, Homo sapiens
  misc_feature: GYAE6OF02GOXCO.5.57.F02.1.454.CMB.1.raw
  modified_base (154)..(154): a, c, t, g, unknown or other
  misc_feature (154)..(154): n is a, c, g, or t
  modified_base (190)..(190): a, c, t, g, unknown or other
  misc_feature (190)..(190): n is a, c, g, or t
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagactaccgttgggganatcgtgatgacgcagtctccagccatcctgtctgtntctcgaggganagacgccaccctntcctgacgacgggccaggtcaagaacctagttcggagacctaacgttgacctcggtaacccaaacgtaaaaaacccgtcggaccacgcccctacccagtacctcctactactttacttctctactccaccgtacggtacctactacgtacgttccgtaacccaacgtagtaacttcgacgtggacccgtagggtacggggttacctacggggtaaacgacggttaaccgttaccgtaacggttacccctaccgtaacccgttacgttaaccgtacggtacccgtaaccgggtaccgttaacccggtaacggtttccgaaacggttaaaccggttaccggtttaacgggttaacccgtttaaaggttttttacctttaaaccggttacggtttaaccgtaaaacccgtttaagggtttaaccggtttacggggttaacgtttaccgggtaacccgggtttacccggttaaaccccggggttaaacccggggtttccccgggttaacccccgggtaaaccggggtaaccccgttaaccggggtaacggtaccggggttaacttaaccgggtaacccgggtaacggggttaacccggttaaccgggttaccggggtacggttccgggtaacccgtccggtaaacccggtacgtttccccggtttagtttaccccgttttaaccccg

SEQ ID NO: 92047 - DNA, 838 bp, Homo sapiens
  misc_feature: GYAE6OF02IFCZ6.5.57.F02.1.454.CMB.1.raw
  modified_base (151)..(151): a, c, t, g, unknown or other
  misc_feature (151)..(151): n is a, c, g, or t
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
  modified_base (249)..(249): a, c, t, g, unknown or other
  misc_feature (249)..(249): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctccagataccgttgggganatcgtgatgacgcagtctcagccatcctgtctgtgtctccgagggganagacgccacccttncctgctacgggcctagtcgaagaactgtttagggancctaaacgttacgccgtacggttaaccaaacctaaaaaacctcggaccacgtaccctcccaaggaaccttcctactaacttttactaccgtttacacctttacccaaccgtacgggaccctactacggtacttaccgtaccccaaacgtacgtagtttaccgaacggtacggtacgtaggtacggggttaccggtacgggtaaacctaacgggtaccgtttaccgacggtttcccgtttaacccaacccgtatccgtaacgacctacggtaccggtaaccttacggtaccttaggtaaaccgtacggtttacgggacctttaaaggttttaacttaccgtttacgtaacgaaaaaccgtttagtacggttaaccggttcgtaaacgggtttccgggaacccgtttaaccggggttaaaccgggtttccccggaaacccgggtaaccgggtttaaacccgaaccggtaaggggtttaaccggtacgtaacggtttaccggaaacgggtaccggttaaccggtttaggacccgggttaccgtccggaaccgttacccggttacgtacggttacccttacgtttaaccccgg

SEQ ID NO: 92048 - DNA, 710 bp, Homo sapiens
  misc_feature: GYAE6OF02F9H7E.5.57.F02.1.454.CMB.1.raw
  modified_base (209)..(209): a, c, t, g, unknown or other
  misc_feature (209)..(209): n is a, c, g, or t
  modified_base (228)..(228): a, c, t, g, unknown or other
  misc_feature (228)..(228): n is a, c, g, or t
  modified_base (557)..(557): a, c, t, g, unknown or other
  misc_feature (557)..(557): n is a, c, g, or t
tcagatcagacacgcacgaccggtgctcgatttagctcgatatagttgggtttgggggaggaactgctcagttaggacccagacggaaccatggaagccccagcgcagcttctcttccctcctgctactctggcctcccagactaccggttggggagatcgtgatgacgcagtctccagccatccctgtctgtgttcctccgagggganagacgccctaccctctccnggcgacggcctagtacaacgtaactagttgggtacactaacttacgtacccgtacggtaaacccaaaacctaaaaaccgtcggacccaccgccctaccccacgtacctccctaccttactttaactccgttcactcccaaccggcggacctactcgtaactccgtacccaacctagtacctacgacggtcggacgtaagggtacgggtcggtacgggaacctaaggtacttaccgtaacgttcctacccaacgtactacgacgactacggttacgtaacctaggtaacctacggtaagtaccgtttaggactttagttacttaaccgtntaataccttaaggtcgttagggacgtacgtaccggttaccgaccggtttaaccggtccgggaacccggtaaggaacccgacgtaggttagacgtctacggaacgggtactacggtacgtgactacgccgtaagtctccttaggtactttcccc

SEQ ID NO: 92049 - DNA, 682 bp, Homo sapiens
  misc_feature: GYAE6OF02HI1V4.5.57.F02.1.454.CMB.1.raw
  modified_base (155)..(155): a, c, t, g, unknown or other
  misc_feature (155)..(155): n is a, c, g, or t
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagactaccggttgggganatcgtgatgacgcagtctcagccatcctgtctgtgtctcgagggganagcgccacctctcctgcgaggccagtcagaactgttgganctaacttgccgtaggtaaccaaacgaaaacctcggaccacgtccctaccgacgtaccttcctctatttactcgttacacgtccaccgacggccactgactcgtacccaaccgagtacttacgaggtcggacgtaggtcgggttccgagggtacacggtaccttcgacgtccgtacaccgtactcgagtaccgtacgtacgtaacaggttactaagtaacgtcggttaggtacttaagttttacgtacgttgtaaacctaacgtagtttacggtacggttacgtacgggttaccgtacccgtacggttaaaccggttcccgggaccgtaacgggtaaccctacggtacggttacgtaacgtctacgggtaacggtccggttaaagtcgggttaccgtacggttcgacctaaccgtcgttaccgttggttaccctttacccg

SEQ ID NO: 92050 - DNA, 790 bp, Homo sapiens
  misc_feature: GYAE6OF02FNT5B.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccagggganagagcccaccctctccgtgcagggccagtcagaacagttggtagactaacttacgcctaggtaaccaaacaaaaacctggaccacgacccctacccgagacctcctactaatttactcgttacacttcccaccgacgggaccacgtcgtactcgtacccaacctagtacttcgagtcggacacggagggtacgtaggggaactacggtaccttcgaacgttcctaccgtaacctacgttacgacgtaccgaaggtaccgttaaccgaaggtttaccgtaacggtaaacgtaccggtttacgggtaaccgtttaacggtttttaactttaaccgttacggttaaacctaaacgttaaaggtttcggtttaacgggttaccgttaaggggttacccgggacccgttttaaccgggtaaacccggggtttcccggtaacccgggtaacggggtaccccgtaacggttaagggtacccggttaagttaccggtaaccgggtaacgggtaaccggttaaccggttcggtaccgggtacgttaccggaccgttaaacccgttcggtttaccggttacgtttacccggtttacccg

SEQ ID NO: 92051 - DNA, 965 bp, Homo sapiens
  misc_feature: GYAE6OF02GJDV7.5.57.F02.1.454.CMB.1.raw
  modified_base (155)..(155): a, c, t, g, unknown or other
  misc_feature (155)..(155): n is a, c, g, or t
  modified_base (161)..(161): a, c, t, g, unknown or other
  misc_feature (161)..(161): n is a, c, g, or t
  modified_base (169)..(169): a, c, t, g, unknown or other
  misc_feature (169)..(169): n is a, c, g, or t
  modified_base (941)..(941): a, c, t, g, unknown or other
  misc_feature (941)..(941): n is a, c, g, or t
tcagatcagacacgcacgaccggtgctcgatttagctcgatataggttggggtttgggggaggaactgctcagttaggacccagacggaaccatggaagccccagcgcagcttctcttcctcctgctactctggctcccagactacggtgggganagtcgngatgacgnacgtctaccagccattccgtgtctgtcgtccgtcggagggggacaggaccgccctacccttcgtccgtcggacgaccggggacctaggtaccgaacggtaaaccgttaggtttacggggaacctaccgttaaaccgttacggtccccggttaaacgggtaaaaccccaaaaacggtaaaaacccgttcgggtaccccaaccggtacccccgttaaccgtaaaacggtccccctttaccttaacgttaaccggtttttttaaccgccccggttttaaccaaccctacccccgggttaaaccggaccgggtaacccttacggttaaccgtaccgttaacccggtaaccccaaacgtagtttcgttaccgacggtaccggaggttaaccggtacgggggttaccgtaccggtaacgtaacggtttaaccttccggggttaccgtttaacccgacccgttaaacggtttaccaagggtaacccggacccgggtaacgggttttaaccgaaccggtttccggtaacgttaaacgggtaaccgttttaaaccgggtttcgggtaaaccgtttaaacggtttttaccgttaaccgggtaaaccttaccgtaaaaagttcgggtttaccgtttcggggtaacgttacgcccgggttaaccggttaccggacggttacccgaaccggggtaccggaacccttaacggacggggttaactaccggacgttccggaaacggttcggaaccttcgggttacgaccgttacgaccgtttacccgnggttaacccgttgttacccgtacg

SEQ ID NO: 92052 - DNA, 681 bp, Homo sapiens
  misc_feature: GYAE6OF02FXA2I.5.57.F02.1.454.CMB.1.raw
  modified_base (203)..(203): a, c, t, g, unknown or other
  misc_feature (203)..(203): n is a, c, g, or t
  modified_base (480)..(480): a, c, t, g, unknown or other
  misc_feature (480)..(480): n is a, c, g, or t
  modified_base (499)..(499): a, c, t, g, unknown or other
  misc_feature (499)..(499): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgccaccctctcctgccgacgggccagtcagaactagttaggacgactaacgttacgccgtacggtaaaccaaaaccaaaaaccgtcggacccaaccgtccccgtacccgacgtaccttaccctactaagtttttacctccggtttaccacgttaccccaacccggaccgggacctacgtacggacttaccgaccccaacgtaagtacttacggacggtcggacgtagggtacgggtaccgtacggggaactacggtacttcgacttccaccanactacacgcacgtcctaanacgtcgtagaactcgtggtacttagtttacttacgtacgtaactactagtgtacgtcgaaggtcgtctacgggttaccggtcggaccgtacgggaaacctgaccgtagtacgtacgtcgtaaggtacgtaccgtgggtacgtccgtacgaccgtaccttgtacccgttggtcccctttaacg

SEQ ID NO: 92053 - DNA, 906 bp, Homo sapiens
  misc_feature: GYAE6OF02GB8LI.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganacgacgccctaccccgtctccgtagccgacggggccctaaggtccaagtaaacctagtttgggtaacgacctaaacgtttcgacccgttacggtaaacccctaaaaccgtaaaaaaccgtcgggaccctaaccggccccttacccccgaagtacccttccccttacttaacttttaaccgtcgttaccaccttaccccgaaccgacggggtaccctaacgttaggtaccttaccggtaacccccaaaccgtacggttaccgtttaccggaacggtcgggtaacgtaaggggtaacgggggttcggttaacggggaaccgtaacggttaccgtttacgtaaccgttcccttaaccgaaccctagtaccgaacggcctaaccgggtccgttaaccgtaacggtttacgtaagggttaaacgttacccggttacggggtaaacttttaacgggtttttaaccttttacggttacgttaaaccaaaaccggtttaggttacgggtttaacgggttaccgttaacgggttccggggttaaccccgtttaccgggtaaacccgggtttccccgggaaccccgtaacggggtaaaccctaaacggttacgggtaagttacgttaacgtaccgggtaacggtaaccggttaacggtcggtacggtaccgtacgtaccgtaccgttacgtaccgtttccggttactttacccg

SEQ ID NO: 92054 - DNA, 743 bp, Homo sapiens
  misc_feature: GYAE6OF02IGKL8.5.57.F02.1.454.CMB.1.raw
  modified_base (119)..(119): a, c, t, g, unknown or other
  misc_feature (119)..(119): n is a, c, g, or t
  modified_base (129)..(129): a, c, t, g, unknown or other
  misc_feature (129)..(129): n is a, c, g, or t
  modified_base (153)..(153): a, c, t, g, unknown or other
  misc_feature (153)..(153): n is a, c, g, or t
  modified_base (189)..(189): a, c, t, g, unknown or other
  misc_feature (189)..(189): n is a, c, g, or t
  modified_base (215)..(215): a, c, t, g, unknown or other
  misc_feature (215)..(215): n is a, c, g, or t
  modified_base (231)..(231): a, c, t, g, unknown or other
  misc_feature (231)..(231): n is a, c, g, or t
  modified_base (260)..(260): a, c, t, g, unknown or other
  misc_feature (260)..(260): n is a, c, g, or t
  modified_base (270)..(270): a, c, t, g, unknown or other
  misc_feature (270)..(270): n is a, c, g, or t
  modified_base (326)..(326): a, c, t, g, unknown or other
  misc_feature (326)..(326): n is a, c, g, or t
tcagatcagacacgcacgaccggtgctcgatttagctcgatatagttgggtttggggaggaactgctcagttaggacccagacggaaccatggaagccccagcgcacgcttctcttccncctgctactntggctccagagtaccgttgggganatcggtgatgacgtacagtctccagccattcccgtntcgtgtcgtcctaccgtaggggagancgcccacccttctcgngacgaggtccagtcaagactagttggaancctaacgttnccgtacgtaaaccaaacgaaaaaccgtcggtccaaccgtcctacccaacgtaaccnccgtactacgttttacgtccttaactacctaccgaaccgtacggaccctacgtacgtacgttaccgacccaactaacgtattccggtagtaccacgtaacggtacggaacgttccgggaactcggtaaccttcggaaccgtttcccgtaaccgtaacccgtaagtacccgacgtaaccgtaacggtaccggtaccgaaacggtcgtacgtaacgtaccggtcgtaacgttacgttacttacggtaactacctaagacgtgttacgacgtaacggtccgttaccggtaccgtaaccggttccgaacccgggttaccgacggttacgtacgtacgtacgttacgacggtaaggtacccgtaaggtcggtaacggtaccggttacgtaccgacctaccggtaccttcggtaacttacccg

SEQ ID NO: 92055 - DNA, 676 bp, Homo sapiens
  misc_feature: GYAE6OF02JOA4K.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctcagccatcctgtctgtgtcctccgagggganagacgccctacccgttctccgtgccgacgggccagtacaaggaacctagttcggtaacgctaaacgttacgccgttacggtaacccaaaacctaaaaaccgtcggaccaacgtccctacccacgtacctccgtactatttactccgtacactccaccgacggccacgtcgatccgtacccgaactagtactctaggtcgacgaggtacggtcgtacggacgacgtacgttacgacgttcctaccaaccgtactcaacggtactaaggtccctagaaccggtacgtagtaaacgtacgtcggtacttaagttttactaccgttacgtactaaagtacgttggtcggttacgtacggccggtactaaccggtaaccggttcggaccccgtaagggaccctacgtaggtacgtactacggtacgaacgggtactaacgtcggtagacgtcgaccaccgttatccgttagtccttacg

SEQ ID NO: 92056 - DNA, 844 bp, Homo sapiens
  misc_feature: GYAE6OF02GE57F.5.57.F02.1.454.CMB.1.raw
  modified_base (209)..(209): a, c, t, g, unknown or other
  misc_feature (209)..(209): n is a, c, g, or t
  modified_base (635)..(635): a, c, t, g, unknown or other
  misc_feature (635)..(635): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctcggctccccagactaccggttggggagactcgtgatgacgcgagtctccagccatcctgtctgtgtcctacgagggganacgacgacccaccttcgtccctaggcacgggccctaaggtcgaagaaccgtagttagggtaacgaccgttaaaccgttggtaccttacgggtaaaccctaaaaacccgtaaaaaaccggttcggtacccgtaaaccgcccccgttaaccccgaacggtaacccctttacccgtacttaaccgttttaacccgtttccggttacccttaaaccggttacccccgtaaacccggaacccgggggttaccccctaaaccggttaccggttaaccgttaccccgggttaaaccccccaaaaccgggtaaccggttaacttttacccggtaacgggttacggaccgtaacgggttacgggtcggttaccgggaaactaccggtaactccgtaagttcgaacctaccgtatcgaacgtccaaggtccgtaanccgttgagtaaccgtgttcgtacgtattttaacgcgtagtaaccgttaaacgttacgttggtactaccggacgtacccgtacgttaccggtaccggtaccggacgtaccgtacggtaggtacgtacttaacggtacgaacggtaccggttataacggtttcccggaggactccggttaaacccatttcgggtactcccggtttaaaccg

SEQ ID NO: 92057 - DNA, 771 bp, Homo sapiens
  misc_feature: GYAE6OF02GY2QE.5.57.F02.1.454.CMB.1.raw
  modified_base (152)..(152): a, c, t, g, unknown or other
  misc_feature (152)..(152): n is a, c, g, or t
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
tcagatcagacacgcacgaccggtgctcgatttagctcgatatagttgggtttggggagaactgctcagttaggacccagacggaaccatggaagccccagcgcagcttctcttcctcctgctactctggctcccagataccggttgggganatcgtgatgacgcagtctccagccatcctgtctgtgtctcgagggganganccaccctntcctagcacgggccagtcagaactgttaggacgactaactcgccgttcggtaaccaaaccgtaaaacgtcggaccacgccctacccacgtacctccttctaatttactccgttacaccttcccaacggtacggaccctaacgtcgtaacgttccgtaccccgaacgtacgttacttacgacggtcggaaccgtaggtaagggtccgtacgggactacggtacctttacgacgttacctaccgtaaccgtacgttaaccgacgtaccgtaaccgggccgtttaaacggtaccgtttcgtaaacgggtaacggtttacccgttagggttaacccggttttaattttaaccggttaaccgtacggttaaccctaaagtaacgtttcggtacgggttaccgttagggtaccgttaaccgttaccgggtaaccggtttacccggaccccggttaagggtaacccctaagggtacggttacggtacttacggtaccggacggtaaccggttacgtacgggttcgtacgtccggaacctaccgtttacggctttttccgactttccg

SEQ ID NO: 92058 - DNA, 758 bp, Homo sapiens
  misc_feature: GYAE6OF02GLPLE.5.57.F02.1.454.CMB.1.raw
  modified_base (203)..(203): a, c, t, g, unknown or other
  misc_feature (203)..(203): n is a, c, g, or t
  modified_base (339)..(339): a, c, t, g, unknown or other
  misc_feature (339)..(339): n is a, c, g, or t
  modified_base (744)..(744): a, c, t, g, unknown or other
  misc_feature (744)..(744): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagacgtccaccctctcctgacgacgggccagtcaagtaactagttggagactaaaccgttagcccttacggtaaacccaaaacaaaaaccgtcggacccacgacccctacccagtacctcccttactaattttacnccgttacacttaccccaccggtacggacctacgtagtacttacccgacccctaaaccgtaggttacttacgacggtacggacggtaacgggtaacggggtcgtaacgggggtaactaacggttaaccgttaccggttaaccgtaccttaaccctaaccgttacgttaaccgacgggaacccgtacgggtaccgtaacgtacggttaccgtaacggtaacggttcgttaacgggtaccttttaagttttaacgttacgttactaaacgtaacgttaagggttcggttacggttacgtacggttacggtcccgttaaccgtaaccgggttcccgaccggttacgaaccgtagtagtcggtattacggaggacgggtaacctaggtacgcgactacgccaaccggttntcttccgtatcccg

SEQ ID NO: 92059 - DNA, 792 bp, Homo sapiens
  misc_feature: GYAE6OF02FK3OZ.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgagggganagacgccaccctctcctgcacgggccagtcagaactattggagctaacgttgaccgtggtaacccaaacaaaaaacccgtcggtacccaacgcccctaccccgaacggtaccttcccgttactaattttacttccggttaccaccttcccaacccggacgggaccccaacgtgtaacttaccggtacccccgaaaccgacgtaactccgtacggtcggacgagggtacgggttcgtacgggacgtaacgtaccgttccgtaacgtaccgtacccaaccctaagtacccgaacgtaccgtaaccgtacccggttaaaccgtacgtacggttaagaaacgggtttaaccgttacggggttacttaacggtttttaactttaacgtacgtttaacctaaagttaaacgttggttacggttaacgtacgggtacggttacccgtaacggttaacccggttcccgggaacccggtaccgggtaccgaaaccgttacgggtacggtacttcgaccggtaacgggtaccgtaaaccggtcgggttacgtccgttacggaccgttaacccgtagttaccggttaccgttcgttacccg

SEQ ID NO: 92060 - DNA, 568 bp, Homo sapiens
  misc_feature: GYAE6OF02GKWDQ.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (378)..(378): a, c, t, g, unknown or other
  misc_feature (378)..(378): n is a, c, g, or t
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagccaccctctcctgcagggccagtcagaacnttggagcaacttgcctaggtaccaacaaaaacctggaccagccctcccagacctcctcactttatcgttcactccaccagggccactgactcgtacccaaccagtattccgagtcggcaggagggtctagggacagtacttnacgtctcacatcagcagctacagtctagaagtacgttggactagtttattacgtnttaccaaanatgtagtcaggtcgccgtacgaacggttccgaccgaacggccaacgagtacgatacgtacgtaacgggacgtaaacgtgggtacgtcgtacgtaccgaccgtaattccggtacgttacctttaccg

SEQ ID NO: 92061 - DNA, 581 bp, Homo sapiens
  misc_feature: GYAE6OF02IUXJ1.5.57.F02.1.454.CMB.1.raw
  modified_base (172)..(172): a, c, t, g, unknown or other
  misc_feature (172)..(172): n is a, c, g, or t
  modified_base (203)..(203): a, c, t, g, unknown or other
  misc_feature (203)..(203): n is a, c, g, or t
  modified_base (555)..(555): a, c, t, g, unknown or other
  misc_feature (555)..(555): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtcnccagccatcctgtctgtgtctccgagggganagacgcccaccctctcctgcagggccagtcagaacagttggagcaacttagccttaggtaaccaaacaaaaccgtggacccaagcccctacccagacctccgtactactttactcttcactccaccgagggccactgactcgtacccaacacgtatcgaggtcgacgaggcggtcgtaggactacgacttacacgtctacgactactcacgacgacgtcgtacgagtacgtagacgtacgtggtacttagtttacttacgtgtacaagtagtgtcgactaggtcgaccgtacgtaaccgttcggaccgtaggaccaagtggtagatacgtacgaggtaccgaggttgcggtntcgaccgactgtccgtagttcctacg

SEQ ID NO: 92062 - DNA, 748 bp, Homo sapiens
  misc_feature: GYAE6OF02IL3RG.5.57.F02.1.454.CMB.1.raw
  modified_base (640)..(640): a, c, t, g, unknown or other
  misc_feature (640)..(640): n is a, c, g, or t
  modified_base (726)..(726): a, c, t, g, unknown or other
  misc_feature (726)..(726): n is a, c, g, or t
  modified_base (740)..(740): a, c, t, g, unknown or other
  misc_feature (740)..(740): n is a, c, g, or t
tcagatcagacacgcacgaccggtgctcgatttagctcgatatagttggggtttgggggaggaactgctcagttaggacccagacggaaccatggaacgccccagccgcagcttctcttcctctgctactctgctacccagactaccggttggggatactcggtagatcgaccgctacgtcctccgacgcctacttccctgtcctggttcgtcctccggaggggagacgccgacccacccttctccgtcggccgaaccgggtcctacggaccgaagtaacgttgtacgggtactaaccgtaacgttcgtcccgttacggtaaaccctaaaaccgtaaaaccggtcggaccctacggtcccctaaccgaacgtccttaccttactaaccgtttactccgtacgtacctaccccgtaacggccggtaaccctagtcggtacctaccgtaacccaactagttacgtaccgagggtcgacgtacgggtacggtcgtacggaactcgtaacttcgaacgtccaacgacttacgcacgctacgtacgacgttacgtaacgtacggtaatccggttgaactttaggttaacctcgttagtaactaaaccgttgttacggtaccgttcgggaacgttccggttaaccncccggggttaacgttcccgaaccgttaccggaccgtacgtacgacgtaccgtacgtcggaacgtacgtacgtcgacgtacgacgcnccgtataccggttntacctccg

SEQ ID NO: 92063 - DNA, 786 bp, Homo sapiens
  misc_feature: GYAE6OF02GEWSF.5.57.F02.1.454.CMB.1.raw
  modified_base (356)..(356): a, c, t, g, unknown or other
  misc_feature (356)..(356): n is a, c, g, or t
  modified_base (487)..(487): a, c, t, g, unknown or other
  misc_feature (487)..(487): n is a, c, g, or t
  modified_base (568)..(568): a, c, t, g, unknown or other
  misc_feature (568)..(568): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctcggctcccagataccggttggggacatcgtgagtagacgcagtcctaccagccactcctgtctgtcgtcgtccgagggagacgacgacccaccgtctccgtcgacgacgggcctagtacaacgacgtaagttcgggaacgactaacgttacgtccgtaacggtaaacccaaaacaaaccgcgaccaccgtcctaccgacgtacctcctatacttacgtccgttacnctacccgacgaccggaccacgtagaccgttaccgacccctaatacggtacttacggaggtcggaacgacggggtacggtccggtacgtaccgattaccgtcgtacgttacccaacgtacctataacccggngtacccgtaacggttctaacggtacgttacgtaacgacggtttagtaccgtagtttaacggtttaacgtcgtaacgttaanaaccggttagttacggggttcgaaccggttgtacccgggttacccggtaacggttacccgggtcccggttaacccgggaacggttaaacccggaccggttaaggttacggtaacggttacggaccggggttacgtaaccgggtaccgggttttcggaacccggttatccccgggacctaaacccgtttaccggtcgtttccggttacccttaacccgg

SEQ ID NO: 92064 - DNA, 720 bp, Homo sapiens
  misc_feature: GYAE6OF02ICB0N.5.57.F02.1.454.CMB.1.raw
  modified_base (608)..(608): a, c, t, g, unknown or other
  misc_feature (608)..(608): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactcgtggctcccagataccggttggggagatcgtgatgacgcagtctcagccatcctgtctgtcgtctcgaggggacgagacgccaccctctccgtgcgacgggccagtacacgaactagttacggtacactaacgttacgccgtacggtaaaccaaaaccgtaaaaaccgtcggaccaccgtacccgtacccaacgtaccttacctaacttaactttacgttaccgttaccaacgttacccgaaccggacgggtccctaacgtagtaccgttacccgaacccgtaaccgtaacgtacgtttacgacggtacggaacgtacgggtacgggtacgtacgggaacgaacgttacgttaccgtacgtctaccgaacctagtaccgacgtaccgaacggtaccgtacgtaacgtacgtacgtaaacggtcgttacgtacgtttaacgtttacttacgtacgtaacgtaaatacggtgtaccggtancgggtacgtacgtaccgtacggtcggacccgaggtaacctcgaggtatacgtcgtacggcgtaacgcggttagtcggtacgtcgaccttaccggtctcgttcctagttcccg

SEQ ID NO: 92065 - DNA, 704 bp, Homo sapiens
  misc_feature: GYAE6OF02J091X.5.57.F02.1.454.CMB.1.raw
  modified_base (259)..(259): a, c, t, g, unknown or other
  misc_feature (259)..(259): n is a, c, g, or t
  modified_base (634)..(634): a, c, t, g, unknown or other
  misc_feature (634)..(634): n is a, c, g, or t
tcagatcagacacgcacgaccggtgctcgatttagctcgatatagttgggtttggggagaactgctcagttaggacccagacggaaccatggaagccccagcgcagcttctcttccgctgctactctggctcccagataccgttggggatatcgtgactgacgcagtctccgagccatcctgtcctagtcgtacctcgagggcagacgcccaccgttctccgagcgtacggccctagtcgacgtaacgtagtttcgganacctaacgttcgccgtacggtaaccgaaacctaaaaccgtggaccacgcccgtaccaaggtacctacctacgtaactttacgtccgttacaacgttaccgtacaacgggcctacgtagtacttcggaaccctaacgacgtaactttccgaagtcgacgaacggttcggttccgaagggtacctaggaacttcgacgttaccacgaccttagacgtaaccgcgttacgaccgttacgtaacggtctacgaaacttacggtacggtacttaaggtttactacgtacggttaactaaccgtaggtaccgttcgacgtgaccggtctaaccggtaacggtcccgttacggaacgtacgacgaggtttaccgagttccgngttaaccggccttaaacggttggacgtccgtacggacctaaccggtatttccgggtcctaaggttaaccc

SEQ ID NO: 92066 - DNA, 562 bp, Homo sapiens
  misc_feature: GYAE6OF02GEAAJ.5.57.F02.1.454.CMB.1.raw
  modified_base (155)..(155): a, c, t, g, unknown or other
  misc_feature (155)..(155): n is a, c, g, or t
  modified_base (523)..(524): a, c, t, g, unknown or other
  misc_feature (523)..(524): n is a, c, g, or t
  modified_base (528)..(528): a, c, t, g, unknown or other
  misc_feature (528)..(528): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (536)..(538): a, c, t, g, unknown or other
  misc_feature (536)..(538): n is a, c, g, or t
  modified_base (541)..(541): a, c, t, g, unknown or other
  misc_feature (541)..(541): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
  modified_base (550)..(555): a, c, t, g, unknown or other
  misc_feature (550)..(555): n is a, c, g, or t
  modified_base (558)..(561): a, c, t, g, unknown or other
  misc_feature (558)..(561): n is a, c, g, or t
tcagatcagacacgcacgaccggtgctcgatttagctcgatatagtggtttggggggaagaggaagactgacggtccccccaggagtccagagtgcgtcgcaagtattggcagtgtgaaatttgacaccttatatgcagactctgtgaggggccncttcaccgtgtccagagacaactccaagaacgccgtctatttgcagatggacagcctgagagtcgacgacacgggcatctattattgacggcgccgagcaatactctcttacttctggagtcgagggacgtcccggtctacgtcgtcctcctcacgtccctccgaaccgaacggcccacgtccggttcccttcccccgtcggccctaccctcccgtaccaacgacgccaccgtcggtcggggcacgacggtccggcccgtcggccgtcgtccgtcggtaccgaacggtaccgttaccgttcccgtgtccgtacgtactcgtcggacggtccgggtcgtcggacgtaacgggcgtactacgtacgacgnngacngtngnagnnngtngacngngcnnnnnngannnnc

SEQ ID NO: 92067 - DNA, 723 bp, Homo sapiens
  misc_feature: GYAE6OF02FPS6T.5.57.F02.1.454.CMB.1.raw
  modified_base (527)..(527): a, c, t, g, unknown or other
  misc_feature (527)..(527): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgaggggagagacgcccaccgtctcctggcacgggccacgtcaagaactagttggaacgactaaacgttacgtccgtacggtaaaccctaaaacgaaaaaacccgtcggaccctaacgtaccccctaccctaacggtacccttaccctacttactttttaacgtccgtttaccacttaccccgaaccggtacgggaccctaacgtcgaacgttaccgtaaccccaaaccgtagtaccttacgaggttcgacgtagggtacgggtacgtagggactacggtcctacgtagtcctacgacctactcgaacgccacggtaccgtacgacggttacncggtaacgtacgttcggtacttagtttaacgttacgtacgtacctaacgtagttcgtacggtacgttacgcgggttccgtaacgtaacccggttccggaccggaacgtaccggtgaacggttcggaacgttacggacgtaacggtacggtaaccgtggtacgtcgacgtcctaccgttcgtatttccgtcgttacg

SEQ ID NO: 92068 - DNA, 831 bp, Homo sapiens
  misc_feature: GYAE6OF02FTKU3.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (217)..(217): a, c, t, g, unknown or other
  misc_feature (217)..(217): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtcgtcctcgagggganacgcnccaccctntcctgcacgggccagtcaagaactgttggacgctaaacgttcaccgtcggtaaacctaaaaccaaaaaccgtcggaccccaacggtcccctacccaacgtaccttcctacgttaatttacgtaccgtttaccacgttaccccgaaccgtaccggggtacccctacgtacgtaaccgttcccgtaacccccaaccgtacgtacgttaccgtaacggtacggacgtaagggtaccgggttaggtacgggaactaacgtaccttagtaaccgtcttaccaaacccgtataccgacgtacgaacgtaccggtactaagttaccgtaacgggaacgttaccgttacgggtaacttaacgtttttacgttaaccgttagttaacctaaaacgtttacgggttccgtttacgggtaaccgtacgggtttccggtaccccggttaaaccggttaccccggggttcccggaacccggttaaccggggaaacccggttccggaaacgttcgggttaaaccgtacgtaacccgggaaggttacccgtaaaccgggtttcggtaacgggtccttaacggtacccggtaaccgttcctttacgggtttaccgttaccgtttaccccg

SEQ ID NO: 92069 - DNA, 824 bp, Homo sapiens
  misc_feature: GYAE6OF02GZJ2X.5.57.F02.1.454.CMB.1.raw
  modified_base (155)..(155): a, c, t, g, unknown or other
  misc_feature (155)..(155): n is a, c, g, or t
  modified_base (208)..(208): a, c, t, g, unknown or other
  misc_feature (208)..(208): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagactaccggttgggganatcgtgatgacgcagtcctcagccatcctgtctagtcgtcctccggagggganagacgccctaccccttctcctagccgaacgggccctaggtaccacggaactagtttgggtaacgcctaaacgtttacggtcccgtaacgggttaaacccaaaaaccgtaaaaaacccgtcgggaacccgtacgtacccccgttaccccaacggtaaccttcctaccttaacttttaacgtcgttaccacgttaccccacgtaacggcctaacgtcgactcccgtacccaaccgacgtacgttacgaacggtcggtaccgaacggggtacgggttaccggtagggtacccaacgggtaccctttacgacgttcccttacaaccgtaccttaaccgaagccgtaacggtacccggttaacgttacgtcgttaaacggacgtttaacggttcggtaccgtttaagttttaccgtacgtttaccgtaacaacgtttaggtcggtaagttacgacggttaccgccgtttaacccgggtaaccgtttcccgggaaccgtaacgggaacctagggtttaccgaagttaacccggtgtaaccggtaacgggtacgttaaccggttcggtaacggtaccttaccggaccgttaacgtccgtttaacctccggtttaaccttcccg

SEQ ID NO: 92070 - DNA, 676 bp, Homo sapiens
  misc_feature: GYAE6OF02F3W1U.5.57.F02.1.454.CMB.1.raw
  modified_base (206)..(206): a, c, t, g, unknown or other
  misc_feature (206)..(206): n is a, c, g, or t
  modified_base (506)..(506): a, c, t, g, unknown or other
  misc_feature (506)..(506): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctggtgtctccgaggggagagngcccacctctcctgcgagggccagtcagacattggagcaacttagcctaggtaaccaacaaaacctcgaccagccctacccgacgacctaccctctactttactcgttaccacgttaccaacccgacgggacctaccttgacttacgtaccccctaaccaggtacttccgaggtcggaccgtaggtacgggttccgtaggggacctacggtacttcgacgtccctaccgaacctacgtcacgtcgacgtacgtacacggttactacggaagtacgttcggattaacgttttacttacgtnttaacgaactagttggtagttacgacggtacgggtcctaacggtaaccggttccggaaccgaacgggtacccaacgtagggtacgtacttacggaccgaagggtacctaaccgttcggggtacgtaccgtcgtaccctaaacccgtattcgttaccggttattaaccccg

SEQ ID NO: 92071 - DNA, 806 bp, Homo sapiens
  misc_feature: GYAE6OF02FHKTF.5.57.F02.1.454.CMB.1.raw
  modified_base (153)..(153): a, c, t, g, unknown or other
  misc_feature (153)..(153): n is a, c, g, or t
  modified_base (207)..(207): a, c, t, g, unknown or other
  misc_feature (207)..(207): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcgagtcctccagcccatcctgtctgtgttcctccgaaggggnagacgccctaccctctcccgtgaccgagggcccagtccaagaactagttcggtacgactaacgttacgaccgtacgggtaaacccaaaacgtaaaaacccgtcggccaaccgcccctacccgacgtacccttccctactaagttttacgtccttacctacctacccgaccgtaacgggtcctaacgttcacgttcccgaaccccaaccgtagttaacttcgacgggttacgacgtaacggggtacgggttacggtaccgggtaacgaaccgttacgttaccgtaaccgttccgtaaccctaacctacgttaaccgacggtacccgtacggaacccgtttaacgtacggtttaccggtacggaaaaccggtttcggttacgggtaacctttaaggtttttaaccgttagttaacccgttaacgtaagtacgtttagggtacgttaccggttaacggtcgggttacccgtaaccgggttaacccggttacgggaaacccggtggaaacccgtgtacggtacgtacgttacgacggtaacggtaccgttaggtacccgggttgccgtttacgacctaaacgtcgtcttaccgttcttaaccg

SEQ ID NO: 92072 - DNA, 949 bp, Homo sapiens
  misc_feature: GYAE6OF02FKOYC.5.57.F02.1.454.CMB.1.raw
  modified_base (151)..(151): a, c, t, g, unknown or other
  misc_feature (151)..(151): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgttggganatcgtgatgacgcagtctccagccatcctgtctgtgtctccgaggggtacagacgccaccctctacctcgccgacggtcccaaggtccaagtaacctagtttgggtaacgacctaaccgttacggccgttaacggtaaccccaaaaccgtaaaaaaccccggttcggaccccgtaaccggtaccccctaccccgtaacgtaccccttaccccgttacccttaacgtttttaaccgtaccggttttacccaaccgtttaccccgaaacccggtaacggggtacccctaaccgttaccggtaacttacccggttaaccccccgtaacccgtaaacgttaacctttaaccggtaacggttaccgggtaccgtaacggggtaacgggggtttaccgttacgggggaaacctaaccggttacccgtttaccgggtaaccgtttcccgttaacccgaaccctaacggtttaacccgaacggtaccgaaacgggtacccgttaaccggaccgtttaacggaacgtttaaaccgggtaaccgttacgggttaaactttaaccggttttaacgtttaaaccgttccgttaaacaaaccgtttacgttaacgggttccgggtaaaccgtacggggtttccggtaaccccgggtaaccgggtttaaccgggttcccggggtaacccccggggtaactacggtaacggacggttaaccgtagaccggtacgggtaaaccgtaccggttcggtaccggttaccgacggttacccgaaccgttacgtccgtactttcccgtaccttaacccg

SEQ ID NO: 92073 - DNA, 756 bp, Homo sapiens
  misc_feature: GYAE6OF02IX457.5.57.F02.1.454.CMB.1.raw
  modified_base (157)..(157): a, c, t, g, unknown or other
  misc_feature (157)..(157): n is a, c, g, or t
  modified_base (219)..(219): a, c, t, g, unknown or other
  misc_feature (219)..(219): n is a, c, g, or t
  modified_base (587)..(587): a, c, t, g, unknown or other
  misc_feature (587)..(587): n is a, c, g, or t
  modified_base (635)..(635): a, c, t, g, unknown or other
  misc_feature (635)..(635): n is a, c, g, or t
  modified_base (640)..(640): a, c, t, g, unknown or other
  misc_feature (640)..(640): n is a, c, g, or t
  modified_base (698)..(698): a, c, t, g, unknown or other
  misc_feature (698)..(698): n is a, c, g, or t
tcagatcagacacgcacgaccggtgctcgatttagctcgatataggttggggtttgggggaggaactgctcagttaggacccagacggaaccatggaagccccagcgcagcttctcttcctcctgctactctggctcccagactaccggttgggganatcgtgatgaccgctagtcctccagccatccgtgtctgtcgtccgaccgaggggatacgacncccgtaccctcgtccgtcgaccggtacgggacctacggtaaccgaacgaacttaggttacggaacgtaccttaaacgttacgtaccgttaacggtaaaacccaaaaaccgtaaacggtcggaacccgaaccttacccctacccggtaactacccttaccttacggttaaacttttaccgtccgttaaccaccgtaaccccgaaccgggtacggaacccctagtaccggttaactacccggtaaacccctaacggtagttaaaccgtcggtcggtaaacgggcctaaacgggggtccgttcggaaacggtaacacgttacttaccgaacgttccaacggtaccttaacgcgaacacgtacgtacggtanacgttcaggtaacgtcgtcgtattagtattgacttacaagttgttcgngacgngtccgtagtaccgttacggccgaacggtacgacacggttagtacgcttacgaacgggngaaccgtacggttagccgttaacgtcacgttctaccggttcttaccggtactacccgg

SEQ ID NO: 92074 - DNA, 706 bp, Homo sapiens
  misc_feature: GYAE6OF02FXDAG.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
  modified_base (257)..(257): a, c, t, g, unknown or other
  misc_feature (257)..(257): n is a, c, g, or t
  modified_base (674)..(674): a, c, t, g, unknown or other
  misc_feature (674)..(674): n is a, c, g, or t
  modified_base (687)..(687): a, c, t, g, unknown or other
  misc_feature (687)..(687): n is a, c, g, or t
  modified_base (698)..(698): a, c, t, g, unknown or other
  misc_feature (698)..(698): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtcgtctccgagggganagacgccctaccctctccctgccgagggcccagtccaagaactagtttcggganactaacgttgcctaggtaaccaaacgaaaaacctcggacctacgccctacccgaacgacctccctactacttttactccgttaccacgtcccacgacggaccctagtcgacttccgtacccaacgtagtacttaccgaggtcggacgagggtacggggttcgtacgggaacctaacggttacctttcgaacgttcctacccgaacctagtaccgtacggacctaacggaccgtacacgttcgtaagaacgtacgttacggacttaagttttacgttaactacggttaacctaaacgttaacgttggttaaccggttgacggttaccggtacctacgggttaaccgtcccggtaccgaacggtacaacgttagggacgttactaacgtcggaacggtacgtacgtacggcgtaccgtnacccggtaacctnttccggttacncgttaacc

SEQ ID NO: 92075 - DNA, 691 bp, Homo sapiens
  misc_feature: GYAE6OF02IJAX7.5.57.F02.1.454.CMB.1.raw
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgaagggganagagccaccctncctgcagggccagtcaagaaacnttgggtanctaaacgttgcctcggtaaccaaacaaaaaaccgttggaccagccctacccgaagacctcctacctaatttactaccgtttacaacgttcccaaccgtaacgggccctaactggaacttacgtaccccaaaaccgtaagtactttaccgaaaggtcgggacctaaggaggggttcctaggggaactacggtaaacgttacgcgtacctaaccacgtactacgacgacgtacggtaacctacgtaacgtacgaaagtaccgttaacggtgtaacgtttagtttaactttacgtacgaaacctaagttagttcgtacggtaatagggtccgtaccgtaaccggttaccggttccgaacccgtaccgggaaacaacgtagtacgagtacgcggtaacgacgtaacggtcggagtcgacgtactaccgtcgtacttcgtacttaccg

SEQ ID NO: 92076 - DNA, 907 bp, Homo sapiens
  misc_feature: GYAE6OF02GE9IT.5.57.F02.1.454.CMB.1.raw
tcagatcagacacgcacgaccggtgctcgatttagctcgatatagttgggtttgggggaggaactgctcagttaggacccagacggaaccatggaagcccagcgcagcttctcttcctcctgctactctggctcccagataccggttggggagatcggtgatgacgcagtctccagccatcctgtcctgtcgtcgtaccgaggggagaggacgcccgacccgttctccgtggcgaacgggggaccctaaggtcaaacggtaaactagtttacgggtaacggactaaacgttacggaccgttacgggtaaacccaaaaacgtaaaaaacccgttggaacccgtaacggccccttacccgaacgtaacccgttacccgttactaacgttttaactcccggttacctaaccgttaccccgaaacccggtaccgggtaccctaacgttacggtaacgttacccggtaacccccaaaacgtaacgtacgtttaccggaaacggtcggtaaccgtaagggtaacggggttccgtaaggggtaaccctaaacggttaacgttccgtaacgggttacctaacccaaccgtaacttaccgaacggtacccgtaaggtaccggttaaccgaacggttaccgtaaggaaaccggttcgtttaacgggtacctttaaaggtttttaacgtaacccggttagtaacccgaaaagttaacgttcggttacgggtacgttaacgggttccggtacccggtttaaaccggttaaccggttccggggtaaacccgggtacgggtaaacccgtaacgtaacgggtaccggttaagaccggtaacggtaacgggtaacggtaaccgttggtaaccggtaccgtaccgtacgtaaccgttaagtcccggttacgttccggtttaccc

SEQ ID NO: 92077 - DNA, 565 bp, Homo sapiens
  misc_feature: GYAE6OF02HN5RU.5.57.F02.1.454.CMB.1.raw
  modified_base (153)..(153): a, c, t, g, unknown or other
  misc_feature (153)..(153): n is a, c, g, or t
  modified_base (244)..(244): a, c, t, g, unknown or other
  misc_feature (244)..(244): n is a, c, g, or t
  modified_base (300)..(300): a, c, t, g, unknown or other
  misc_feature (300)..(300): n is a, c, g, or t
  modified_base (374)..(374): a, c, t, g, unknown or other
  misc_feature (374)..(374): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccaggggagagacgccacccttctcctgcagggccagtcagaacattggtancaacttgcctggtaccaaacaaaaacctggaccagcctcccagactcctcatttancgttcatccaccagggccactgatcgtacccaaaccagaattcagtgcagagggtctgggacagacttcagtcncaccatcagcagcgtaacagtctagaacgtacttggacctagtttacttactagtacaaacaaattgtgtacagtcggctcggtaaacgttcgacccgtaggaccaacacgtaggtagtaacttacggaacggacgtaaacgtcggtcggacgttggtaccaaccggtaacttaccgtcgttacttacccg

SEQ ID NO: 92078 - DNA, 845 bp, Homo sapiens
  misc_feature: GYAE6OF02G22YL.5.57.F02.1.454.CMB.1.raw
  modified_base (156)..(156): a, c, t, g, unknown or other
  misc_feature (156)..(156): n is a, c, g, or t
  modified_base (193)..(193): a, c, t, g, unknown or other
  misc_feature (193)..(193): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctcggctcccagactaccggttgggganatcgtgatggacgcagtctcagcctatcctgtctgtntctccgaggggacgagacgccctacccgtctaccgtcggacgtaccgggacctacgggtaccaaacgttaaaccgttaacggtttacggggtaacacccttaaaacggtttaccgtacccggtttaacggggtaaaacccctaaaaaacccgtaaaaaaaacccggtttccggggaacccctaaaccggtacccccgttaccccgaacggtaacccgtttcccttaaacgttaaccgtttttacgtacccgtttacctaacgtaacccccgtaccgtaaccggggtacccttacgtacggttaactccggttaaccccaaacgtaacggacctttaacgaggtacggacctaagggtacgggtacggtgggaacctagtacttccgtaagtccctacgaactacgttacgacggtacgaacgtaccttagtaccggtattacgaacggtacgttcgtaacgttacgttaaattccggtattaaacccgtagtacgtgtacgtcggtatcccggtacgtaccggacggtttcccgacgttaccgggacttaacgtacgggtagtaacttcggtactaacggggtcttaaacgggtaccgttgttacccggaacgtccgtaaccgtaccgtttaggtaccgttaccccgtttcg

SEQ ID NO: 92079 - DNA, 682 bp, Homo sapiens
  misc_feature: GYAE6OF02HJ918.5.57.F02.1.454.CMB.1.raw
  modified_base (205)..(205): a, c, t, g, unknown or other
  misc_feature (205)..(205): n is a, c, g, or t
  modified_base (221)..(221): a, c, t, g, unknown or other
  misc_feature (221)..(221): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctacccagataccggttggggagatcgtgatgacgcagtctccagccatcctgtctgtgtctccgagggganagagccaccctctccngcgacgggccagtcaagaactattggtagctaacgttgccgtacggtaaccaaaaccgtaaaaaccgtcggaacccacggacccctacccaacgacctaccgttactacttttactccgttccaactcccaccgaacgggccctactagtactccgtacccaacctagtactacaggtacggacaggacgggtacgtagggaacgaacgtacgttacgtaacgtacctaccacctatacgacgacacggtacgttaactacgttacgtacggtaaacgtcgttaggactttaagtttacgttactacgtaacctaaattagtacggtacgtacgtacgggttacgtacccgttagtaaccggttcccggaccgtaacgggacctaagtacggtagtacgtgtaccgaggaccgtaacgtggacggtacacggacctaccgtacgttacttccgtacttacc

SEQ ID NO: 92080 - DNA, 791 bp, Homo sapiens
  misc_feature: GYAE6OF02GSR8K.5.57.F02.1.454.CMB.1.raw
  modified_base (157)..(157): a, c, t, g, unknown or other
  misc_feature (157)..(157): n is a, c, g, or t
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
  modified_base (621)..(621): a, c, t, g, unknown or other
  misc_feature (621)..(621): n is a, c, g, or t
  modified_base (759)..(759): a, c, t, g, unknown or other
  misc_feature (759)..(759): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagtacgtaccggttgggganatcggtgatggacgctagtcctccagccacttcctgtctgtctctcggagggganagcnccctaccctctcctgacgacgggccagtccaaggtaactaggttcggtaacgtactaacgttacggtccgttaacggtaacccaaaacctaaaaaccgtcggacccaacgtcccctacccgaacgtaccgtaccctacgttactttacgttccgttactaacctcccaaccggtacggacctaacgtcgtaaccgtccgtaaccccgaaactaggtaacgttcgacggttcgacggtaacggggtacggtacggtacgggactaacgttaccgttaccgacgtttaccgtacccgaacgttacgtacgacggtactaacggttaccgtacgtaacgttcggtaaggtaaaccgtacgttccgggtaactttaaggtttaccgttacgacgttaactaaacgggtntttacgggtacggtacgttacggtccggtaccgtaccggttcccgggttaaccggaccggtaccggtaccaagggtcgtacggtactaacggtacggaaccgggtacgtacggttaggtccgtagtaccggtaacccncgtttaacggtcccgtttactttacggtaccc

SEQ ID NO: 92081 - DNA, 720 bp, Homo sapiens
  misc_feature: GYAE6OF02GUAC6.5.57.F02.1.454.CMB.1.raw
  modified_base (151)..(151): a, c, t, g, unknown or other
  misc_feature (151)..(151): n is a, c, g, or t
  modified_base (169)..(169): a, c, t, g, unknown or other
  misc_feature (169)..(169): n is a, c, g, or t
  modified_base (184)..(184): a, c, t, g, unknown or other
  misc_feature (184)..(184): n is a, c, g, or t
  modified_base (200)..(200): a, c, t, g, unknown or other
  misc_feature (200)..(200): n is a, c, g, or t
  modified_base (481)..(481): a, c, t, g, unknown or other
  misc_feature (481)..(481): n is a, c, g, or t
  modified_base (556)..(556): a, c, t, g, unknown or other
  misc_feature (556)..(556): n is a, c, g, or t
  modified_base (578)..(578): a, c, t, g, unknown or other
  misc_feature (578)..(578): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccgtgggganatcgtgatgacgcagtcnccagccatcctgtcngtgtctccgagggganagacgcccacccttctccgtgccgacgggccagtccgaagaactagttggtacgactaacgttagccgttaacggtaacccaaaaccgaaaaaccgtcgggaccccacgtcccctacccgacggtacctcccttactaagttttaaccgtccgttacaccttaccccgaacggtaccgggtaccccaacggttcggtaacttacccggtaaccccaaaccgtagttaacccttacggacggtcgtaacggaggtacggtcgtaacggaacgtctacgttanaccgttcacccgtaagtctacggatccggacgtacgtactagttacaggtaatcgttggaacttagtttacgtancgttaacgatacggttgtaggntaccgggtacgtaccgaggtacccggttacggcccgtaacggacctagtcgggtacgagtccttaacggggatacccggttagtacgggttaccgtcggtacccgaacgtcccgttaagttcccctaggttcccgttaaccg

SEQ ID NO: 92082 - DNA, 751 bp, Homo sapiens
  misc_feature: GYAE6OF02HA3CL.5.57.F02.1.454.CMB.1.raw
  modified_base (128)..(128): a, c, t, g, unknown or other
  misc_feature (128)..(128): n is a, c, g, or t
  modified_base (168)..(168): a, c, t, g, unknown or other
  misc_feature (168)..(168): n is a, c, g, or t
  modified_base (199)..(199): a, c, t, g, unknown or other
  misc_feature (199)..(199): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctacnctgctccagataccgtggggagatcgtgatgacgcagtcncctagccatcctgtctgtgtactccaggggnagacgccaccctctccgtgcgacgggccagtaccgaagaacctagtttgggaactcctaaacgttagaccttacggtaaccaaaaccgaaaaacccgttggaacccacggttacccctacccgaaggtacttaccccgtactaacgttttaacgttcccggtttcaaccgttaccccgaaacccggacgggaccccgtaacgtcgtaacgtccggttaaccccaaccgtaggactttaacgacgtacggactaagggacgggtactcgggtaacacggtacttacgcgttaccgacctactacgtgaacgacgtagaccgtaaacacggtcgttaaggaactaccggttaggaccttaacgggtttattaacgttcgtaaaccgaaataagtggtaccggtactacggtacgtaccgtacggtaaccgttccggaacccgtaacgggacctaacgtaggtacggtactagtaaccggcggttaacgaaacggttcggtacggtacgtacggaactaacccgtaacgtttcggttacccgtacgttaaccccg

SEQ ID NO: 92083 - DNA, 746 bp, Homo sapiens
  misc_feature: GYAE6OF02JX44A.5.57.F02.1.454.CMB.1.raw
  modified_base (154)..(154): a, c, t, g, unknown or other
  misc_feature (154)..(154): n is a, c, g, or t
  modified_base (174)..(174): a, c, t, g, unknown or other
  misc_feature (174)..(174): n is a, c, g, or t
  modified_base (177)..(177): a, c, t, g, unknown or other
  misc_feature (177)..(177): n is a, c, g, or t
  modified_base (192)..(192): a, c, t, g, unknown or other
  misc_feature (192)..(192): n is a, c, g, or t
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
  modified_base (633)..(633): a, c, t, g, unknown or other
  misc_feature (633)..(633): n is a, c, g, or t
tcagatcagacacgcacgaccggtgctcgatttagctcgatatagttgggtttgggggagaactgctcagttaggacccagacggaaccatggaagccccagcgcagcttctcttcctcctgctactcgtcgctccagactaccggttgggganatcgtgactagacgcagtcnccngccatctgtctggtntccgtccagggganacgacgcccaccctctcngacacgggccagtccaagtaactgtttggtacgacaacgttgtccgtacggtaaaccaaaacgtaaaaaccgtcggcctaaacgtccccgtaccgaacggtacctacctacgtaactttacgtcgttaccacgttacccgaacgtaccgggacctaacgtacgtacctccggtaaccctaaccgacggttacttacgtacggtacggacgttaacgggtagggttaccggttacgggaaccgtaccgtacgtttaaccgacggtttaccaccgaaccggtaactcgtaaccggacgtacgtacgtacgacgggtactacggtaaacgttctaggtacttaacggttactacgttagacgtaactacgtaagtcgtacgtaacggtcggtccgtaaccgcggggttaccnccgttaaacgggccctaaggtcggtaacgtcggtaacgcgaacggtaaccggttcggaacggtttccgacgggacttaccggtaccgtacgtttccgtcggttaccccttagg

SEQ ID NO: 92084 - DNA, 733 bp, Homo sapiens
  misc_feature: GYAE6OF02JV8Z6.5.57.F02.1.454.CMB.1.raw
  modified_base (148)..(148): a, c, t, g, unknown or other
  misc_feature (148)..(148): n is a, c, g, or t
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
  modified_base (512)..(512): a, c, t, g, unknown or other
  misc_feature (512)..(512): n is a, c, g, or t
tcagatcagacacgcacgaccggtgctcgatttagctcgatatagttgggtttggggaggaactgctcagttaggacccagacggaacatggaagccccagcgcagcttctcttcctctgctactctggctccagataccgttggganatcgtgatcgacgcagtctccagccagtcctgtctgtcgtctaccgagggganagcgccctaccctntccgagccgacgggccagtcaagtacagtttcggagctaacgttacgccgttacggtaaccaaacctaaaaaccgtcgggacccaacggtccccttacccgagtaaccgtccctaccgttaatttaccttacggttacctaaccgtttacccgtaacccggacgggtacccacgttacgtacgttaccttaacccccgaacgtacggtacttttaccgaacggtcgtacgaacggggtacggttccgtagggaacgtacgtaacgttccgagtaccctaccaaccgtagtcccgaanccgaaaccggtcgtaaacgtctacgttacgaaggtaccttggtaaccgttaattctttaagcgtactaacgtagtctacgggtacctgggtccgtcctacggtaacgtccgggtacccgaggactacgtaacgtgtaacgtctaccggtacgaaccggttataccgggttcgaccgttaggaacccggtaccttacggtaccgttacgtccctttaacccg

SEQ ID NO: 92085 - DNA, 649 bp, Homo sapiens
  misc_feature: GYAE6OF02FN325.5.57.F02.1.454.CMB.1.raw
  modified_base (200)..(200): a, c, t, g, unknown or other
  misc_feature (200)..(200): n is a, c, g, or t
  modified_base (237)..(237): a, c, t, g, unknown or other
  misc_feature (237)..(237): n is a, c, g, or t
  modified_base (400)..(400): a, c, t, g, unknown or other
  misc_feature (400)..(400): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagtataccggttggggagatcgtgatgacgcagtctccagccatctgtctgtgtctcgagggnagacgccaccctctcctgcgagggccagtcaagaacngttggagactaacttgcctggtaaccaaacgaaaaccgtggaccacgcccctacccaacgtacctccgttactacgtttactccgttacacctcccaccgacgggaccacgtagtacttccaccctaaccgagtacttacgaggtacggcgagggtaggtcgnggaactagtaccttacgacgtcctacacctctcacgtcaacgtcgtaacgtgtactagtaacgtcgtacgtagttaagttacgttaacgtgttaacctaacgttagttacgggttacgttcggtacgttaccgggttacgttaacggtaaccggttccgaccgggtaacggtaccctagtaacgttaggacttagtaccggattaaccggtaagcggtagtcgtcgactccgtatcgttacgtcttccg

SEQ ID NO: 92086 - DNA, 692 bp, Homo sapiens
  misc_feature: GYAE6OF02HC5ZN.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgcccaccctctcctgcagggccagtcagaacagttggagctaacttgcctaggtaaccaaacaaaaacctggaccacgcccctaccagtacctcctactactttactcgttacactccaccgacggccacgtgactcgacccaaactgacttcgagtcgacgacggtaggtcgtagggaactaggtacttcgacgtcctacgaaccgtactacgacgaccgtacgaccgttaagtaccggtacgttacgaaacggttcgttacggtacgttaaagttttaacgttactacgttaaccgtaaactacgtttaggtcgttaacggtaggttccgtaacccgttaccgggtaaccggtttcccggaacccgttaacgggggaacctaaccgtaaggacggtaacttacgtacggaaccgggtaacgtacggttcggtaccgggtacctacggtaccgtaccgttaacgttccgtacgtttcccttaacg

SEQ ID NO: 92087 - DNA, 810 bp, Homo sapiens
  misc_feature: GYAE6OF02I8R2L.5.57.F02.1.454.CMB.1.raw
  modified_base (153)..(153): a, c, t, g, unknown or other
  misc_feature (153)..(153): n is a, c, g, or t
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
tcagatcagacacgcacgaccggtgctcgatttagctcgatatagttgggtttgggggaggactgctcagttaggacccagacggaaccatggaagccccagcgcagtttctcttcctcctgctactctggctcccagataccggttgggganatcgtgatgacgcagtctccagcctatcctgtctagtgtctccgagggganggacncccaccctctcncgcgaggccagcaagactagttaggtacgacaacgtttacggccgttacggtaaaccaaacctaaaaacccgtccgggaccgtaaccggtaccctaccccaacggttaccctacccgttaccttaactttttaacgttccgtttacctactaccccgtaaccggtaccggggaccctaccggtacgtacggttaccccgtacccaaacccggtacgtaactttacgacggttaggaccgtagggtacggggtacgacggggtactaacgtacgttcgtacgtacctacgaccctgtaccgacgacgtaccgtacgtacgtacgtcgtacggaacgttaacggtcgtacgtttaacggtttacgttacgttagtaacgtaacgtaacgttggttacggtacgtacgttaccggtacccggttaacggtaaccgggttcccgggaacgtacccggggtaaccgtacgtaaaccgggtaacgtaacgttacggcccgtaaacggggtaaccgttaaccggttcggtaaccggtcggttacccggaacgttaccgtttaacggtccggttaccgtttcccgacgttttacccg

SEQ ID NO: 92088 - DNA, 706 bp, Homo sapiens
  misc_feature: GYAE6OF02G36JM.5.57.F02.1.454.CMB.1.raw
  modified_base (249)..(249): a, c, t, g, unknown or other
  misc_feature (249)..(249): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgaggggagagagcccaccctctcctgcacgggccagtcaagaacagtttggtanacgtaacttagccgttaggtaaacccaaaaccaaaaaacccgtcggacccaggcccctaccccaagaccttccctacgtaattttactccgttactaccttaccccaccgacggggcccacgttcgactccggtaaccccaacagtacgtttcaggtcggacagggacgggttcgtcggggaaactacggtacttccgagttcctaccggaccacttcaggaccgaacgtccgttaacgaggtcttaaggaagtcgttacggcgttaaagttttagttacgttagtaccgtaaactacgttagggttggtacgtacggttcggtaccgttaccggtaacgggttcccgaccccggtaacgggacctaacggacgggtacgtacgtacgtacggaacggaccggttaacgtgggtaccggtagacgtccgaaccttgttccggttacgtttcctaccg

SEQ ID NO: 92089 - DNA, 803 bp, Homo sapiens
  misc_feature: GYAE6OF02FZ8M4.5.57.F02.1.454.CMB.1.raw
  modified_base (772)..(772): a, c, t, g, unknown or other
  misc_feature (772)..(772): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtcgtctccgaggggagagacgccaccctctcctgcgacggggaccagtcaagaacagttagggtacgactaacgttacgccgtaggtaaccaaaacctaaaaaaccgtcggaccacgacccctaccccagtaacctcctctattttactccgtcactccaaccgacgggaccatcgactacgtaccccaaccgaagtacttacacggttacggcgtaacggggtcgggtacgttacggggaccaagggtaccttacaggtttccctaccgtaaaccctagttccaacgaccgtaacggtaccggtaaacgacggttaccggttaaaggtaaccggttaacggttacgggggttaccttaaaagggttttttaaccgtttaaccgtttaggtaaccctaaaacgttaagttacgggttagtagttaacccggttgggtacccgttaaccgggttaacccggtttcccggggaacccgtaacggggaacccttaaccgggacgggtttaacgggacgtttaacgaccggtaacgggaaccgggttaacgttggggtaccgttacgacggtcccgtaaaacccggttntttacccggtttacgtttaccgttaaccccg

SEQ ID NO: 92090 - DNA, 654 bp, Homo sapiens
  misc_feature: GYAE6OF02HSM7L.5.57.F02.1.454.CMB.1.raw
  modified_base (156)..(156): a, c, t, g, unknown or other
  misc_feature (156)..(156): n is a, c, g, or t
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (224)..(224): a, c, t, g, unknown or other
  misc_feature (224)..(224): n is a, c, g, or t
  modified_base (646)..(646): a, c, t, g, unknown or other
  misc_feature (646)..(646): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagacttaccggttgggganatcgtgatagacgcagtcctccagccatcctgtctgtacgtctccgagggganagacgccacctntcngccacgggcagtacaagaactagttaggacactaacgttagcctaggtaaccaaaacaaaaaccgtcggaccacgcctacccagtacctcctactactttacgtccgttacacgtccgaacgtacggcctactgactaccgtaccaactagtagtacgaacgtcggacgtaggtcgggtacgtgggaaactacggtaccgttcgaacgttaccaccgaccagtaccgaacacgtacgtacggtaaccgtagtacgtaaggtaaccgtaggttacgtacgttaatttacgtaactgtaactaaactaggttagtacggtcaggttccggtacctacggtaccgtccgggtaacccgaggaccaacgtgtaacggtacttagacgtacgacgtacggtgtacgctaacgcctaacgatacgttntacctacg

SEQ ID NO: 92091 - DNA, 744 bp, Homo sapiens
  misc_feature: GYAE6OF02IW1IX.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtcctccacgcctatcctgtctgtgtcctccgaggggagagacgccctaccctcctcctcggccgacgggccaggtacaacggaactagttaggacgtactaaccgttacgaccgttacggtaaacccaaaaccgaaaaaccgtcggaccccaacgtccccgtaccccaacggtaccctacctacttaacgttttacgtccgttacacttacccgacccggaacgggccctaacgtcgtacgtacccgtacccaaccgtagtacttacgaggtcggacgagggtacgggtccgacgggaactacgtacgttcgacgtcctacgacgtacacgacgacgtaacgtcgtaactcgtacgtagtaacgtaccgttaggtaccgttaagtttacttacgtacgtacctaaagtggttaggtacggttacgcggtcgtacccggttacgggtaccggttccggacccgtaacgggaccgtaagtacgggtacggtaagtacgtacgggaccggttaacggtacggtcggttaacgtccggtacgtacccgtaccgtacgtttcggttaccgtttcctaccg

SEQ ID NO: 92092 - DNA, 674 bp, Homo sapiens
  misc_feature: GYAE6OF02GQAHC.5.57.F02.1.454.CMB.1.raw
  modified_base (193)..(193): a, c, t, g, unknown or other
  misc_feature (193)..(193): n is a, c, g, or t
  modified_base (202)..(202): a, c, t, g, unknown or other
  misc_feature (202)..(202): n is a, c, g, or t
  modified_base (322)..(322): a, c, t, g, unknown or other
  misc_feature (322)..(322): n is a, c, g, or t
  modified_base (600)..(600): a, c, t, g, unknown or other
  misc_feature (600)..(600): n is a, c, g, or t
  modified_base (616)..(616): a, c, t, g, unknown or other
  misc_feature (616)..(616): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagactaccggttggggagatcgtgatgacgcagtctccagccatcctgtctgtgtcnccgaggganacgacgcccacccgtctcctgcgacgggccagtcagaactgttggacactaacttcgccttacggtaaccaaacaaaaccgttggacctacgccctacccagacctcctctacttttacncgttcactccacgacggccacgtgactcgtaccccaacgagtacttacaggtcgacgacggtaacgggtcgtagggaactacgtaccgttgaacgtcctaccgtaccacttcgaacgccgtacgtaccgtactacggttactaggaacttacggttcgtaccttttaagtttaacgttcgttacgtaactaaccggtattcggttacgtacgcggttaccggtacccttacgggtaaccggttccggacccgtaacggacccgtaacgtacgggttanaccgttaagtaccggnggtaccggttaccgtaggtcgtacctacgacctaccgttatccgttacgtcttacccg

SEQ ID NO: 92093 - DNA, 781 bp, Homo sapiens
  misc_feature: GYAE6OF02H996A.5.57.F02.1.454.CMB.1.raw
  modified_base (190)..(190): a, c, t, g, unknown or other
  misc_feature (190)..(190): n is a, c, g, or t
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
  modified_base (485)..(485): a, c, t, g, unknown or other
  misc_feature (485)..(485): n is a, c, g, or t
tcagatcagacacgcacgaccggtgctcgatttagctcgatatagttgggtttgggggaggaactgctcagttaggacccagacgggaccatggaagccccagcgcagcttctcttcctcctgctactctggctcccagataccggttggggagatcgtgatgacgcagtctccagccatcctgtctgtntctccgagggganagacgccacctctctcgcgacgggccagtacagaactagttcggaanctaacttagccgtacggttaaaccaaaaccgtaaaaaccgtcggacccaacggtacccctacccgaacgtacccttccgttacctaattttacttaccgttacctacgttaccccaaccggtacgggtaccccaacgttaggtaccttcccggtaaccccaaaccgtagtaccgttacgcggtacggacggtacgggacggggttacgtacggggaactaggtaccttcggtacnccgttccaacgtactacgtagacccgtaacggtccgtaacgttacggtaccgtaacggtaaggtacgtttacggactttaacgttttacgttactacgtaacctaaacgttaggttagtacggtacgttacgggtcggtaccgtacggggttaccgtacccgggtaccgaacggggtaaacccacggtaacgggttacggtaacgttaccggtacggtaacggggaaccgtttaaccggtggtaaccggttaccgcggttacccaccgtttacgtccggtttaccttgttaccccg

SEQ ID NO: 92094 - DNA, 670 bp, Homo sapiens
  misc_feature: GYAE6OF02F4M8R.5.57.F02.1.454.CMB.1.raw
  modified_base (201)..(201): a, c, t, g, unknown or other
  misc_feature (201)..(201): n is a, c, g, or t
  modified_base (611)..(611): a, c, t, g, unknown or other
  misc_feature (611)..(611): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgtgggagatcgtgatgacgcagtctccagccatcctgtctgtgtcctccgagggganagacgcccacccttctcctgccgaaggggcccaggtcaagaactagttttggaacgactaaacttagccctaggtaacccaaaacaaaaacctggacctacggcccctacccagtacctcctctaattttacgtccttccaagttccccaaccgtaccgggcctaacgtgacttccgtaaccccaaccagtaacttccgaggttcggacgtaggtacgggtcgtaggggtacagtaccttcgaacgtcctaccaccgtaactcagtacaacgcgtacgtacgtactaggaacgtacgttaggacgttattttaacgtactacgttacaaacgtgttcggtaggtactaggtcggttccctacggtaccgttccggaccgtacgggaccctagtagggttacgagtaccgnggtaacgggactaacggttcgacgtcgtcggactaccgtcgtttacgtgttacctaccg

SEQ ID NO: 92095 - DNA, 702 bp, Homo sapiens
  misc_feature: GYAE6OF02I4X5K.5.57.F02.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (286)..(286): a, c, t, g, unknown or other
  misc_feature (286)..(286): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgagggganagacgccaccctctcctgcgtacggccagtcagaactagttggagctaacgtcgctaggtaaccaacgaaaacctcggaccanccctaccacgacctcctactattactaccgtcactccaccgcggaccactacgacttaccgtaccccaaactacgtaccgttcgtaggtacggactaagggtacggggttaccgtacggggaactaacggtaaccgtttacggaattcccgttaccaacccgtacttacgaccgtaccgacggtaccgtaacgtacggttcctaaaggtaacgtaacggttgggtaccttaacggttttacttacgtacgttaacaactaaggtgttacggtacgtagtcggtacccgttaggaacccttcggggaacccccgtagggtacccaagggttacggtacggttacgtacgtacggtaacgggtctaacggtcggtaacgtcgtacgacgttaccgtacgttccgttcgtacttacccg

SEQ ID NO: 92096 - DNA, 848 bp, Homo sapiens
  misc_feature: GYAE6OF02JRP0J.5.57.F02.1.454.CMB.1.raw
  modified_base (204)..(204): a, c, t, g, unknown or other
  misc_feature (204)..(204): n is a, c, g, or t
  modified_base (210)..(210): a, c, t, g, unknown or other
  misc_feature (210)..(210): n is a, c, g, or t
  modified_base (605)..(605): a, c, t, g, unknown or other
  misc_feature (605)..(605): n is a, c, g, or t
tcagatcagacacgcacgaccggtgctcgatttagctcgatatagttgggtttgggggaggaactgctcagttagacccagacggaaccatggaagccccagcgcagcttctcttcctcctgctactctggcctcccagtactaccggttggggagatcggtgatgaacgtcagtctccgagcactccgtgtctgtgtactcgnggggangacgcctacctctccgtgcgacgggcctaggtacaacggaactagttggtacgacctaaacgttcgaccgtaggtaacccaaaactaaaaaccgtggaccacgtaccccgtacccaactccgtacctactacttttacgtcgtacctactcccgtaaccgaacgggtaccctacgtagtaccgtacggttaccccaacgtacgtacttcaacggttcgggaacgtacgggttaacggggtccggtaacggtaccgtaaacgttacgtaaacgtcttaaccaccgtaaccgttacgttaaaccgcgtaacgacccgttacgggtaaccaggtttaaccgacgaaaccgggtttacgtaacggttaacccgttaggtttttacgaaaccggttttanaacccgttttaaagtaaacgttcgggtttaccgggttaccctaaacggggtttacccgttaccggtaaaccgggttaaccggtttaccccggaacccgggtaaacgggtaaccaacggggttaccggtaacgtacggtttaacgttaaacccgggaccggttaacggtaaaccggtttggtaacccggtccgttaccgggacttaaccccgtaagggtttcctacggggtttacccctcccgg

SEQ ID NO: 92097 - DNA, 800 bp, Homo sapiens
  misc_feature: GYAE6OF02IBU62.5.57.F02.1.454.CMB.1.raw
  modified_base (158)..(158): a, c, t, g, unknown or other
  misc_feature (158)..(158): n is a, c, g, or t
  modified_base (172)..(172): a, c, t, g, unknown or other
  misc_feature (172)..(172): n is a, c, g, or t
  modified_base (183)..(183): a, c, t, g, unknown or other
  misc_feature (183)..(183): n is a, c, g, or t
  modified_base (209)..(209): a, c, t, g, unknown or other
  misc_feature (209)..(209): n is a, c, g, or t
tcagatcagacacgcacgaccggtgctcgatttagctcgatatagttgggtttggggaggaactgctcagttaggacccagacggaaccatggaacgccccagcgcagcttctcttcctcctgcctactctggctacccagacttaccggttgggganagtcgtgatgacgnagtcctccganccatcctgtctgtcgtctcgaggganagacgcctaccctctcctcgcgacggtccagtcaaagaacgtagttcggtaagccttaacgttacgtaccgttacgtaaacccgaaaactaaaaacccgtcggaccctacgacccctacccgaacgtaccttaccgttacttaatttacctttccgttaacctacgtacccctaacgaaccgggtccacgttacgtaccgttaccggtacccctaaccgtacgtacttaccgagtaacggtccgtaagggtacgggtacgtacggacgtacgtaacgtcgtactacctcaacccgtgtaacccgtacgaccggacgttaaccgtaaccggttacgttaacggtaacgaacggttaccggttacggtaacgttttaaccggtttaaactttacgtaaccgtaacctaaagttaccgttggtaaccggtcgtaacggtttcccgggacccggtttacgttacccgggtttacccgacgggtaacccggtacggtaaccgttacggtacggtacttaacgggacgttaaccggtactaaacggtccggtgtaccgtacgacccgtaccacgtttcggttaccgttcttacccgg

SEQ ID NO: 92098 - DNA, 729 bp, Homo sapiens
  misc_feature: GYAE6OF02FX5UL.5.57.F02.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
  modified_base (219)..(219): a, c, t, g, unknown or other
  misc_feature (219)..(219): n is a, c, g, or t
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
  modified_base (356)..(356): a, c, t, g, unknown or other
  misc_feature (356)..(356): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtcgtctccgagggganagacgcccacccgtntcctgcgagggccagtcaagaactnttggacncaacttgcctggtaaccaaacaaaacctggaccacgcctacccaagtacctcctactattttactcgttcactccaccgacggccacgtgactcgtaccccaacngtacttacaggtcggacaggtacgggtcgtacgggaacgtagtaccttacgtaacgttcctaccgaacctacgtcgacgccgtaacggtccgttaacgacgtcgttaaaggaaccgttacggttaacggtacgttaagtttttaacgttaacgttacggttaaccaaaaccgtaagttagggttccgttaacgtacgggtaccggttacccgtttaccgggtaaaaccgggttcccggtacccggaacgggtacccctaaacggtacgttacgggacttaaccgtacggtaacgggtactaaacccgggttggtccggttaaccgcgttaccccggtaaattaccgtttccggttaccgttaccctttaccgg

SEQ ID NO: 92099 - DNA, 685 bp, Homo sapiens
  misc_feature: GYAE6OF02JTN4Z.5.57.F02.1.454.CMB.1.raw
  modified_base (152)..(152): a, c, t, g, unknown or other
  misc_feature (152)..(152): n is a, c, g, or t
  modified_base (201)..(201): a, c, t, g, unknown or other
  misc_feature (201)..(201): n is a, c, g, or t
  modified_base (252)..(252): a, c, t, g, unknown or other
  misc_feature (252)..(252): n is a, c, g, or t
  modified_base (629)..(629): a, c, t, g, unknown or other
  misc_feature (629)..(629): n is a, c, g, or t
  modified_base (645)..(645): a, c, t, g, unknown or other
  misc_feature (645)..(645): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagactccgttgggganatcgtgatgacgcagtctccagccatcctgtctgtctctaccgaggganagcgccaccgtcctcgtcgcacgggccacgtcgaacgtaacctgttggacncgtaaacttcgccgtacggaaccaaacaaaaaccgtcggaccgtaacgtccctacccacgtacctacccttctaatttacgttcgtacctaactaccccacgtaccgggtaccacgtacgaccgttccgaccctaacctacggtacttacgtacgggtacggtacgaacgggtaaccgggttaccgtagggaaacctacgggtacccttacgtaacggttcctaacccgtaccgactttacggacgttaccggacgtacgtaacgtacgttacggtacgtaaacgtcgttaggttaccgttagtttaacgttcgtagtactaagacgtttgaagtcagttccgtcacggtaccttcggcctaacggtcagtacgtanataacgtgtacgcgtntaacggtcgagtacgcggtaactcgtaacggtctagttcg

SEQ ID NO: 92100 - DNA, 630 bp, Homo sapiens
  misc_feature: GYAE6OF02F2W9W.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (469)..(469): a, c, t, g, unknown or other
  misc_feature (469)..(469): n is a, c, g, or t
  modified_base (510)..(510): a, c, t, g, unknown or other
  misc_feature (510)..(510): n is a, c, g, or t
  modified_base (609)..(609): a, c, t, g, unknown or other
  misc_feature (609)..(609): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagacgccaccctntcctgcgaggccagtcaagaactattggacgctaacttgcctaggtaacccaaacgaaaaaccgtggacctagcccctacccgagtccttccgtactactttactccgtttacaccttacccgaaccggtacgggtaccctaacgtcgtaactccgtaccccaaacgagtacttacgacgtgacgaaggtcgggtacgacgggactacgtacttcgagtctaccaccgtatcgacgacggtacgtacgttaacncggtactaggaaccgttcggttagacgttactttagttacngtaaccaagtagtcgtacgagtacgtcgtacgtacgcgttaccgcgtaacggactacgtagacggtactacggacgaaggtacgacgttggcgtagtcnctacgtatccgtagttacctc

SEQ ID NO: 92101 - DNA, 857 bp, Homo sapiens
  misc_feature: GYAE6OF02IJZ3C.5.57.F02.1.454.CMB.1.raw
  modified_base (208)..(208): a, c, t, g, unknown or other
  misc_feature (208)..(208): n is a, c, g, or t
  modified_base (263)..(263): a, c, t, g, unknown or other
  misc_feature (263)..(263): n is a, c, g, or t
tcagatcagacacgcacgaccggtgctcgatttagctcgatatagttgggtttggggaggaactgctcagttaggacctagacggaaccatggaagccccagccgcagcttctcttcctcctgctactctggctcccagactaccggttggggagatcggtgatgacgctagtctccgagccattcctgtctgtgtctccgagggganagacgccctaccctctcctgacgacgggcctagtccgaagactagttacgggtanacctaaacgttacgtccgtacgggttaaacccaaaaccgtaaaaaccgtcggacccgaccggtacccctacccgtaacggtaacccccttccttaccttaaacgtttttaccgttcccgtttaactaaaccccgtttacccccgaaaacccggtacgggtacccccgtaacgtttaccgtaaccgttaccggttaaccccccctaaaccgtaacggtttaccgtttacccgagggttacggtaccgtaacggggtacgggttcggtacggaaccggttaacgtaaccgttcgtaaccggttccttaccgaccctaacgttccgaccgaccgtcggtaaccgtaaccgtacggttccctaaggaacgttaccgggttagtaccgtttaacgttttacttaacggttacttaacccaaagttaccgttagggttcggtacctacggggttacccgaccgttaacccgggtaaccggttcccggtaacccgtacccgggtaaccgcgtttaagggacgtactacggttaacggacccgggtacgttaaccgtgggttccgaggccgtaccgtacgtacggttcctggttaccctacg

SEQ ID NO: 92102 - DNA, 674 bp, Homo sapiens
  misc_feature: GYAE6OF02GUK4B.5.57.F02.1.454.CMB.1.raw
  modified_base (153)..(153): a, c, t, g, unknown or other
  misc_feature (153)..(153): n is a, c, g, or t
  modified_base (189)..(189): a, c, t, g, unknown or other
  misc_feature (189)..(189): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtntctccgagggganagacgcccaccctctcctgcgaggccagtcagaactgttggtagcaacttgcctaggtaaccaaacaaaaacctggaccacgcccctacccagtacctccctactactttactccgttaccactaccccaaccgacgggtacctacgtagtacttccgtaacccaacctagtacttacgaggtacggacgaggtacgggtcgtacgggtaacacggtacttacgacgttcctaccgacctactacgacgtaccacggtacctaactagtacgtaaggtaaacgtcgttacggtacttaagttttacgtaacgttgttaaccaatagttcgtagtcgtaggtacgtaccgtaccggtacgttcccggaccgtacgggtaccctaggacgttacgtacgtaccgtacggacggtaaccgtaacggttggacggtccgttagaccgtaccgtaacgttcgttaccgtaccttacg

SEQ ID NO: 92103 - DNA, 729 bp, Homo sapiens
  misc_feature: GYAE6OF02H2G39.5.57.F02.1.454.CMB.1.raw
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtcgtcccgagggganagacgccaccctctccgtgcacgggcagtcaagactgttggagctaactagcctaggtaaccaaacaaaacctggccacgcctaccagtacctcctactatttactcgtttacacgtacccaccgtacgggccctaatcgtacgtccgtacccaacgatacttccgagtcggctacgggtacgggtcggtaggacctagggtaacttcgtacgtcctaaccgacctatacggacgacgtaccgtaccggtaacgtcgttaccgtaaggtaaaccgttagtcgggttaaccgtttaagttttaacttaacggttcttaaaccgtaaacgttaggtttcgggttaggtaccggttacggttaccggttaaccggttacccgggttcccgtaacccgggccggttaaaccggcccgtaaaggttcgtaacgtacgtaaccggtaggtaccgggtaaagttaccggttaggtccggtcccgtacgtacctacccggtttctacggtttcccttacgtccgtttaacccccg

SEQ ID NO: 92104 - DNA, 715 bp, Homo sapiens
  misc_feature: GYAE6OF02HCDMP.5.57.F02.1.454.CMB.1.raw
  modified_base (154)..(154): a, c, t, g, unknown or other
  misc_feature (154)..(154): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganatcgtgatgacgcagtctccagccatcctgtctgtcgtctccgaggggagagacgccctaccctctccgtgcgacgggccagtcaagaactagttggacactaacgttacgccgtacggtaaccaaaacctaaaaccgtcggacccacgcccctacccgaacgtacctcctactatttactacgttacctactaccccaaccgacgggtaccctacgtagtacgtacccgtacccaaccgtagtacgttacgacggtcggacgtacggggtacgggtacgtacggggtaactaacggttaccgttacgaacgttccctaccactacgtacgacgcgacgtacgtactagtacgtagtaacgtcgtagtacttagtttacttacgtactaactaacttagtcggtcgtacgtacggttccggtacgtaaccgttacggtacccggaccgtaacgggtaccctaacggtacggtacgtacgtacggtacggaacggtaacggttaccgtggtaccggtacttacgaccgttaaccgtcgttaccgttaccgttaccgttaccg

SEQ ID NO: 92105 - DNA, 746 bp, Homo sapiens
  misc_feature: GYAE6OF02I5BYR.5.57.F02.1.454.CMB.1.raw
  modified_base (156)..(156): a, c, t, g, unknown or other
  misc_feature (156)..(156): n is a, c, g, or t
  modified_base (469)..(469): a, c, t, g, unknown or other
  misc_feature (469)..(469): n is a, c, g, or t
  modified_base (707)..(707): a, c, t, g, unknown or other
  misc_feature (707)..(707): n is a, c, g, or t
tcagatcagacacgcacgaccggtgctcgatttagctcgatataggttgggtttggggggaggaactgctcagttaggacccagacggaaccatggaagccccagcgcagcttctcttcctcctgctactctggcctccagataccggttgggganattcgtgatcgacgcagtctccagccatcctgtctgtgtactccgaaggggacagacgccctacccttctccgtcgacgacgggcccaggtaccagaaactaggttggaacgtactaaccgttcgtaccgtacggttaaacccaaactaaaaccgtcggaccaacgtccctaccacgtaccttccctacttactttacgtacgttacacctaccaaccgtacggcctacgtcgtacgtacccgtaccgtaacgaacgtacgtacgtacggtacgacgtacggtacgggttacgacgggactacgtacgttacncgtaacctacaactacgtacgcgacgtacgaccgtactcgtacgtacgtaaagtcggttacgaacgtttacgtttaagtaacctagtaacctaagtacgttcgggttacgacttacggtaccggaacccgtttaccggaaccgtttaccgggcccgtaaccggggacttaacgtaacgggtgttaactacggttaaacgtcgggaaaccgttacggacggttaccggtacggttaccnccggtaaccttaaccggtacgtttcccgtatttaacccg

SEQ ID NO: 92106 - DNA, 915 bp, Homo sapiens
  misc_feature: GYAE6OF02H7S2P.5.57.F02.1.454.CMB.1.raw
  modified_base (208)..(208): a, c, t, g, unknown or other
  misc_feature (208)..(208): n is a, c, g, or t
  modified_base (224)..(224): a, c, t, g, unknown or other
  misc_feature (224)..(224): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctcggctcccagactaccggttggggacgatcggtgatgacgctagtcctccagccatcctgtctgtgtctccggaggganagacgccacctctccngcgagggccagtacacgaactgtttacggagacctaattacgtccgtacggtaaaccaaaacgaaaaaccgtggaaccacgtacccctaccgtacgtacctcctacttattttactaccgtctaacctaccaccgtaccggacctacgtcgtaactaccgtaacccgtaacgtacggtacttaccggaggttaccgacgttacgggtacgggtccgtaacggggaactacggtaaccttcggtaacttccgtaccgtaaccgtacgtaccgtacggtaaccgtacggtttacccgtaaacgtacgggtttaaacccgtaagggtaaaacgtttaacccgggttacgggaaactttttaacggtttttaaaccgttaaacggttttacgttaaaccgtaaacgtttaacgggtttagggttacccgggttaacgggtttaacgggttacccgggtaccccgtttaaacccggggtttaaaccccgggttaccccggggtaaaccggttaaacccgggtaaccgtaaacccgttaagggttacgtaacccgggtttaaacgggttaacccgggtccgggtaaaccgggtttaaccgttaccgggggtaacccggttacccgttaccgggtaccccgtttaaaacccggttccggttttaaccggttttacccgtttaccggtttaacccccgg

SEQ ID NO: 92107 - DNA, 722 bp, Homo sapiens
  misc_feature: GYAE6OF02FYCI2.5.57.F02.1.454.CMB.1.raw
  modified_base (492)..(492): a, c, t, g, unknown or other
  misc_feature (492)..(492): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtccgtccgaggggagagacgcccaccctctcctgcgacgggccagtcagaactagttaggtagactaacgttagcccgtacggtaacccaaaaccaaaaaccgtcggacccacgcccctacccgagtaccctccttactacttttactccggttacacctcccgaacccgacgggccaacgtgactccgtaccccaaactacgtacttcgaggtcgacgtaggggtacgggtcgtacggggacacggttcttaccgtacgtcctacctaaccgtactacgagtccgacggtaccgttaccgngttacgttaggaaacgttacggttagaccgttttaagttttacgttaccgttagtaacgtaaacttaaggtttggtaccggtacgtacggtcggtaccgtaccggttaccggtcccgggaccgtaacggtaccctacggtagttcggtaatacgtaccggtaacggtaccgtaacggtggtacggtccgtaccgtaccgtaaaccttgtacccggttcgttcccttaccg

SEQ ID NO: 92108 - DNA, 607 bp, Homo sapiens
  misc_feature: GYAE6OF02GP3FD.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccacctctcctgcgacgggcctagtcagaacattcgganctaacttgctaggtaaccaacaaaacctggaccaacgcctacccagacctcctactatttactcgttcactccaccgacggccagtgactacgtaccccaacagacttcagtgacaggtacggtcgtagggacacggaccttcgacgtctaccacactcgagtcgacgtctacgtagtcgtagactacgttggactagttattacgtacgtacaaacgtagttacgtgtacgtagtaccggtaccgttcgaaccggttccggaacccgagggaacccgtaacgaggttacggtatacgttacggacggacggtaacggtcgttcggacgttacgccgtaacttagtccgtattcctaaccg

SEQ ID NO: 92109 - DNA, 745 bp, Homo sapiens
  misc_feature: GYAE6OF02IMAPQ.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtcctccagccatcctgtctgtgtctccgaggggagagcgccacctctctgcacgggccagtcacgaactagttcggtagctacgttaacgccgttaggtaacccaaaaccgtaaaaaacctcggaccgaccgtacccctacccgaagtacctacccgtactaacgttttactaccgttacacctacccgaaccggtacgggaccacgtacgtacgttaccgtaaccccaaccgtagtaacttcgtaacggtcggacgtaacgggtacggggtacgtacggggactaacggtaccgtacgtaacggtacctactacccgacttaccgaacgacgtaaggtacccttaacggacgttactaacgggtaaacgtcgtttacgggtactttaagttttacgttaacgttacgtaactaaacttaggtccggtagtaggttacggtccgtaccgtaccggttaaccggttcccggacccggtaacggtaaccaggtaacgggtagtactaaggtaccgaacgggttaccgtagttcgggacggttcgactaccggacttagtccgtttaggtcccttaaccg

SEQ ID NO: 92110 - DNA, 722 bp, Homo sapiens
  misc_feature: GYAE6OF02HJMIB.5.57.F02.1.454.CMB.1.raw
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (470)..(470): a, c, t, g, unknown or other
  misc_feature (470)..(470): n is a, c, g, or t
  modified_base (705)..(705): a, c, t, g, unknown or other
  misc_feature (705)..(705): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttggggacatcgtgatgacgcagtcctccagcccatcctgtctgtgtcctccgaaggggnaggcncccaccctctcctgcgaacgggccctagtaccaagaactagttgggaacgacctaaacttacggccttaacggtaaacccaaaacctaaaaaaccgtcgggacctaacgaccccttacccaacgtaccttacctactaacttttaactccgtttacacttacccaccgtacgggtcccaacgttgtactccgtaaccccaacgtagtacttcgtaaggtgcgagggtacggtcggagggacacgtactcgaagttccncgaacatcgacgacacggtctaacgtagtctaaggaactcgttagtacttaagtttacgtacttacgtaacaatacgttcggcggttatacggttcggaacctaccgggttaaaccgggtcgacccggtaacgggaccgaaacgtacggtaacgggtctaaacgggttccgaaccggggtacgtaaacggttcgggacggttaccgtacgtacccgaacgttacggttttacccnggtttacccttaacccg

SEQ ID NO: 92111 - DNA, 851 bp, Homo sapiens
  misc_feature: GYAE6OF02I9ZKL.5.57.F02.1.454.CMB.1.raw
  modified_base (205)..(205): a, c, t, g, unknown or other
  misc_feature (205)..(205): n is a, c, g, or t
  modified_base (520)..(520): a, c, t, g, unknown or other
  misc_feature (520)..(520): n is a, c, g, or t
  modified_base (651)..(651): a, c, t, g, unknown or other
  misc_feature (651)..(651): n is a, c, g, or t
tcagatcagacacgcacgaccggtgctcgatttagctcgatatagttgggtttggggagaactgctcagttaggacccagacggaaccatggaagccccagcgcagcttctcttcctcctgctactctggctcccagataccggttggggagatcgtgatgacgctagtcctccagccatcctgtctgtcgtactcgaagggganagaccgcctaccctcgtcctggccgacgggcctaggtacaacggtaactaggttacggagaccttaacgttaccggccgttaacggtaaacccaaaacgtaaaaccgtcggaccctaacgtccccgtaaccgacggtaccctccttacgttactttacgtccgttaccacgtcccgtaacgccggtacctaacgtcgtacctacccgtaaccctaagtacgtagttaccgaggttccggaacgtacgggtaacgggttccggtaacgggtacccttaagggtaccctttagaccgttacctacccgtaacccgtntaccggtaacgccgttaaaccggtacttaaccgtcgtttaccgaacggtaacggttaccgttacgggtacctttaaggttttaccggtacctacggttaaccgtaacgtcgttaccgtacggggtttaacnccgggggtttacctaccccggttaagggttaaccggttaccccgggtacgtaccccgggttaaacgttacccgggaaggtttaacccgttccgtaaacggtacccggtaaccgggttaaccggtaaccgggttagggtacccgtcggttaaccggttaacccacggtttaccgtaccgttccgggttacccttaacccgg

SEQ ID NO: 92112 - DNA, 842 bp, Homo sapiens
  misc_feature: GYAE6OF02IL4TQ.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
  modified_base (258)..(258): a, c, t, g, unknown or other
  misc_feature (258)..(258): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctcccagataccggttgggganatcgtgagtcgacgcagtctccagccatcctgtctgtgtctacgaggganagacgcccaccctctaccngccgagggtccacgtacaacgtaactgttcggtaanctaaacgtttacggcccgttacgggtaaaccctaaaacgtaaaaaacccgtggtaacccgacgacccctcccaaggtaccttcctacgttaactttacgttccgttacctaccgttacccgaacccggtacggtaaccccgtacttacggtactacccggttacccaaaaccgtacgtaacgttccgtaaggtcggtaccgtaagggtaacgggttaccggtacgggtaaccacgttacgtttaccgtaacgttcgttaaccaccgaagttacgacgacgtacggtaccgtaacgtcgtaaccgtaggttaaacgtaccggttagggtacctttaaacggttttacgttaaccggtttagtaaacccgttaacgtttaaggttaccggttacggtacgtaaaccgggttaccgttacccgggtttaaccggaccgggttttacccgaccgggtaaaccggtacccgtaaacgttcgggtaacttacgaccgttaccgggtaacgtaacggtaacgttccgggttaaggtacccgtagaacccgtttacctaaccggtttcccgttacggttccctttaacccgg

SEQ ID NO: 92113 - DNA, 722 bp, Homo sapiens
  misc_feature: GYAE6OF02FHIFT.5.57.F02.1.454.CMB.1.raw
  modified_base (154)..(154): a, c, t, g, unknown or other
  misc_feature (154)..(154): n is a, c, g, or t
  modified_base (160)..(160): a, c, t, g, unknown or other
  misc_feature (160)..(160): n is a, c, g, or t
  modified_base (204)..(204): a, c, t, g, unknown or other
  misc_feature (204)..(204): n is a, c, g, or t
  modified_base (508)..(508): a, c, t, g, unknown or other
  misc_feature (508)..(508): n is a, c, g, or t
  modified_base (647)..(647): a, c, t, g, unknown or other
  misc_feature (647)..(647): n is a, c, g, or t
tcagatcagacacgcacgaccggtgctcgatttagctcgatatagttgggtttgggggagaactgctcagttacggacccagaccggaaccatcggaagccccagcgcagcttctcttcctcctgctactctggctccagactaccgtgggganatcgtnatcgacgcagtctcagccatcctgtctgtcgtcctccggagggngaacgtcgaccctacccgtctccgtgccgagggtcctacgtcaaggtaactgtttcggacgtacctaacttggaccgtacggtaaacccaaaccgtaaaaaccgtggacccctaaccggtccctaccgacgtacctcccgtacttaagtttacctcggttcaaccgttccaaccgtaaggtccctaagttcgaaccgttacccgaaccccgtaaacgtacgtaacgttaccgaaggtcggaccgtaacgggtcgttaccggtacgggactaacggttacctcgaacgtccctaacaccggttancaacggtcagtaccgcgtaacgtcgaacgttaagtaccgtttcggaaacgttaacgttttatccggtaaacgttacaaacgttagtggtaccgtgtacggtcgtaccgttacgggaccgttccgggaactaccggtacngtacgagtactcaaccggcgggtacaacgtttcggtcacggttacacgtacccttgtaccggttctcgttaaccc

SEQ ID NO: 92114 - DNA, 615 bp, Homo sapiens
  misc_feature: GYAE6OF02GDDRG.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagagcccaccctctcctgcagggccagtcagaactagttggagctaacttagccttaggtaacccaaacaaaaaccgtggaccacgccctacccagacctcctactatttatcgttcactccaccgacggccacgtcgtatcgtacccaacctagtacttacacggttcggacaggtacgggttcgtaggggacagtaccttcgagttcctaccacctactcgacgcgacgcgtacagtcgagtaacgtacgttggacttaggttttaacttacgtacgtacaactagtgttcgtacgtaggtcgtaccgtaccggtaacgttcccggccgtaacgggacccagtacgtagacgttacgtacgaagggacctaggtcggtggccgttgacctacgtacgtcttacgtcttccc

SEQ ID NO: 92115 - DNA, 721 bp, Homo sapiens
  misc_feature: GYAE6OF02FSPIM.5.57.F02.1.454.CMB.1.raw
  modified_base (138)..(138): a, c, t, g, unknown or other
  misc_feature (138)..(138): n is a, c, g, or t
  modified_base (153)..(153): a, c, t, g, unknown or other
  misc_feature (153)..(153): n is a, c, g, or t
  modified_base (216)..(216): a, c, t, g, unknown or other
  misc_feature (216)..(216): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccngataccgttgggganatcgtgatgacgcagtctccagccatcctgtctgtgtctccgaggggagagacgcctaccctntccgtgcagggccagtcagaacagttggacgacaacttgcctacgtaaccaaacgaaaaacctggaccagtcccctacccacgacctcctactattttactccgttacacttacccgaaccgacgggaccctacgtacgacgttaccgtaccccaacgtaacggtactttacggaaggtttcggacgtacgggtaacgggttacgtacggggaacctaggtaccgttacgtaacgttcctaccgtacctacgtaccgacggtaccaacggtccgttaaacgcggttacgtacggtaaacgtcgttacggacttaagtttacgttacgtcgttaactaacgtacgttaggtaggtccgtaggtaccgtaccgtaccgggtaaccgtttaccggacccggtaacggaccctaacggtacgtcggttagtaccgtccggaacggaccgggttaatccggggttcgtacggtcgtaccgtaaccgtcgttcgttaccgttacttacccg

SEQ ID NO: 92116 - DNA, 711 bp, Homo sapiens
  misc_feature: GYAE6OF02FFSV3.5.57.F02.1.454.CMB.1.raw
  modified_base (152)..(152): a, c, t, g, unknown or other
  misc_feature (152)..(152): n is a, c, g, or t
  modified_base (676)..(676): a, c, t, g, unknown or other
  misc_feature (676)..(676): n is a, c, g, or t
  modified_base (683)..(683): a, c, t, g, unknown or other
  misc_feature (683)..(683): n is a, c, g, or t
  modified_base (701)..(701): a, c, t, g, unknown or other
  misc_feature (701)..(701): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgtgggganatcgtgatgacgcagtctccagccatcctgtctgtctcctccgaggggagagacgccctaccctctccgtgacgacgggcccaggtaccaaggaacctagtttacgggtaacacgtaaaaccgttggtaccccgtagggtaaaccccaaaacgaaaaaacccgtcggacccgaacgtacccctacccgaaacgacccttcccttactacgttttaactccgtttacactacccgtaccgaacgggacctacgtagactaccggtaccccaaacgtacgtattaccgagtcggaccacggggtacgggtggtacgggacgtaacgtaccttacgtacgttctacccaaccagtaccgaacgtaccgacggtaccgttaccacggtttaacgaggtaacgtacgttggaactaagttttactatcgttaacacgtaagttcgtaggtactggtacgttaccgtaccggtacgttccgacccgtaggacgacgtacgtagtacgtagtacgacggtacgactacggngtacgtnacccgtaacgtctacgtnttacctaccg

SEQ ID NO: 92117 - DNA, 807 bp, Homo sapiens
  misc_feature: GYAE6OF02F2OCU.5.57.F02.1.454.CMB.1.raw
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
tcagatcagacacgcacgaccggtgctcgatttagctcgatatagttgggtttgggggaggaactgctcagttaggaccagacggaaccatggaagcccagcgcagcttctcttcctcctgctactctggctcccagactaccggtggggagatcgtgatgacgcagtctccagccatcctgtctgtcgtactccgaggggagacgtacgccaccctctcctgcnggaccngtacagaacagttaggtacgactaacgttacgccgttacggaaacccaaaacaaaaaaccgtcggaccgaacgccctaccccgtacgaccttcctacttacgtttactccgttactacctaaccgaccgacgggtaccacgttcgacgttaccgaccccgtaaccgtacgtactttaccgaggtacgacggtaacggtaacgggttcgaggggaaccacgttaccgttacgtcgttacctcccgtaacctacttacgaccgaaccgtacggaaccggtttacgtacggtttaaccgaacgtaaaccgttaacggtttcggtaaccgttttacggtttaactttaccgttacggttaaccttaaacgtaacgttacggttacggttacggttacggttaccggttaccggtaccgggttaaccgggtttacccgtaaccgggtaaaccggtaccggaaaccgttacgggttacggttaacgtacgtaccggttaacgggacgttaaccggttaagggttccggttaccggtacggttaccgtaaccctttcggtacgttttccgttacccgtttaac

SEQ ID NO: 92118 - DNA, 920 bp, Homo sapiens
  misc_feature: GYAE6OF02I2KF3.5.57.F02.1.454.CMB.1.raw
  modified_base (154)..(154): a, c, t, g, unknown or other
  misc_feature (154)..(154): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttgggganagtcgtgatgacgcgagttcgccagcctatccgttagtctgttcgtcgtccggaggggtacgtacgagcccctacccttctaccgtggccgacgggtcccgagttaccgaaggaactagttacgggtacacgttaaacgtttcggacccgttacgggtaaaccctaaaaccgtaaaaacccgttcgggaaccccgagtacccctaccccgaacgtacctccttaaccttattttacgtaccgttactacgtcccgtaacgcggaccctactcggtaacctaccggtaaccccaactacgtaaacgttccgtaacggtcggaacgttaaggggtacggttaccggtaacggggaactaacggttaacccgttaccggtacggttacccttaacccggtaccgttaacgtacccgggaacggtacgtaaaccgggtttacccggtaacgttaacggtttaacccggtaaaggttaaaccggttacggtttacgggaacccgtttttacggtttaacctttacgggttacgttaacccgtaaaggttaaccgttcgggtttaacgtaccgggtttacggggtaccgttcccggtaaaccgggttaacccgggtccccgggaacggttaaaccccggggaacctaaacggggtttagtaacgggttacgtacggttaacccggtaaggtacccggttaacgttcgggttaacggtccgtaaccgggtacctccggtttacttaccgtttacggttaccctttaaccccgg

SEQ ID NO: 92119 - DNA, 850 bp, Homo sapiens
  misc_feature: GYAE6OF02IPGRD.5.57.F02.1.454.CMB.1.raw
  modified_base (154)..(154): a, c, t, g, unknown or other
  misc_feature (154)..(154): n is a, c, g, or t
  modified_base (205)..(205): a, c, t, g, unknown or other
  misc_feature (205)..(205): n is a, c, g, or t
  modified_base (222)..(222): a, c, t, g, unknown or other
  misc_feature (222)..(222): n is a, c, g, or t
  modified_base (259)..(259): a, c, t, g, unknown or other
  misc_feature (259)..(259): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctcggctccagataccggttgggganagtcgtgatgacgcagtctcgagccatcctgtctgtgtctccggagggganagacgcctacctctcgnggaccgacggccaagtacaacgtaactagttaggacnctaacgttacgtaccgtaacggtaaacctaaaacgtaaaaaccgttcgggaaccacgtaccccgtacccgaacgtaaccttcctaacgttaacttttacgtaccgttacaaccgtaccgaaccggtaccggtacctacgtacgtacgttaccggtaacctaaacgtaggttacttacggtaacggtcggtaaccgtaacggggtacgggttccggttaacgggaactaaacggttaccgtttacgaacgttacccgtaaccgaacccgtagttacccggtaacgaaccgggtttaactaaacccggttacgtaaccgttacgtaaaggttaaaccggtcggttacgggtaactttaggtttttaactaaccggttagttaaacccgtaaagttaagttcgggtacggttaacgtaagggttacccggttaccggtacgggttaaccggttacccgggaacccgaaaccgggttaacgaacgggttacgttaacgggaacctttacgggtaacccggaaacgggttaccggttaacgttagggaaccgttccggacgaacctaccgttacggtaccgttggtacccttacgg

SEQ ID NO: 92120 - DNA, 731 bp, Homo sapiens
  misc_feature: GYAE6OF02FSGWV.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggagagacgcccaccctctcctgcgacgggccaggtcaagaactagttaggagactaaacttagcctaggtaacccaaaacaaaaaccgtggaccacgcccctacccaacgtacctccctactattttactccgttaccaactaccccgaaccgacgggccctacgtcgacttcgtaacccccaaaccgacgtatttaccgaaggtcggactaaggggtacggggttcgaggggtaacctacggtacttacgacgttcctaccaacccgtactccgacggtaccgaacggtccgttaacgacggttaccgtaaggtaaccgtacgttaccgggtacttaacggtttttactacggttacgttaaccaaacgtaacgttcggttacggtcgtacggtacggttacccgtaccggttaacccggttccgggacccgtaacgggtaccctaagtacggtaggtacgttacgtacgggacggtaccgtacgttggacggtcgtaccgccgttaccgtacgttcgtacgttcttaccg

SEQ ID NO: 92121 - DNA, 618 bp, Homo sapiens
  misc_feature: GYAE6OF02FN2LE.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (237)..(237): a, c, t, g, unknown or other
  misc_feature (237)..(237): n is a, c, g, or t
  modified_base (245)..(245): a, c, t, g, unknown or other
  misc_feature (245)..(245): n is a, c, g, or t
  modified_base (423)..(423): a, c, t, g, unknown or other
  misc_feature (423)..(423): n is a, c, g, or t
  modified_base (436)..(436): a, c, t, g, unknown or other
  misc_feature (436)..(436): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctcgagggganagagccaccctntccctgcagggccagtcagaaccnttggtaanactaaacttagccgtcggtaaccaaacaaaaaacctggaccacgcctaccccaagacctccctctaattttactccgttactaattcccaaccgtagggcctaacgtgaactcgtaccccaactagattcaaggtgacgtaggaggtctgggacagacttcgagtctacacactcgancagcgtactactntagaatacgttagctaagtttattatgtaaacaaaacgttgtacggtagagttacggtaccgtacgtaacgttcggaccgaaccgggtaccacgtagtacgacgttacaggtaccgggtaactaacggtcggtcgtacggttccgacgtacccgtaattccgtaacgttcgttacctaaccg

SEQ ID NO: 92122 - DNA, 704 bp, Homo sapiens
  misc_feature: GYAE6OF02INWCE.5.57.F02.1.454.CMB.1.raw
  modified_base (152)..(152): a, c, t, g, unknown or other
  misc_feature (152)..(152): n is a, c, g, or t
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
  modified_base (239)..(239): a, c, t, g, unknown or other
  misc_feature (239)..(239): n is a, c, g, or t
  modified_base (557)..(557): a, c, t, g, unknown or other
  misc_feature (557)..(557): n is a, c, g, or t
tcagatcagacacgcacgaccggtgctcgatttagctcgatatagttgggtttggggagaactgctcagttaggacccagacggaaccatggaaagccccagcgcagcttctcttcctcctgctactctggctcccagataccgttgggganatcgtgatgacgcagtctccagccatcctgtctgtgtcctccaggggangagcccacctctcngcagggccagtcagacagttgganctaacttgcctaggaaccaactaaaaacctggaccagtcccctacccgagtaccttccctactaacttttaacgtccgttacacgtacccaaccgaacgggtaccctacggtacgaacttccgtaccccaaaccgtagtacttcgacgttcggacgtaggtagggtcgtacgggaactacggtaacttcgtacgtactacctacccagttaccgaagtccgtaagtaccgtaacgtgtaccgtaaggaacggtacgttacgggtacgttaagtttaacgttaacgtagtaacctaaacgttaagtcgtaaggtaccgnggttaacggtccctaacgggtaccgttccggacccgtagggtaaccaacgtggtacgtacgttacgtacggtaacggtaccgtaaggttccggtaccggtacgttaccggtaacctaccgtacgttagttacccgttacgttacccg

SEQ ID NO: 92123 - DNA, 652 bp, Homo sapiens
  misc_feature: GYAE6OF02IXMUI.5.57.F02.1.454.CMB.1.raw
  modified_base (436)..(436): a, c, t, g, unknown or other
  misc_feature (436)..(436): n is a, c, g, or t
  modified_base (570)..(570): a, c, t, g, unknown or other
  misc_feature (570)..(570): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccgttggggagatcggtgatgacgcagtctccagccatcctgtctgtgtctccggaggggagagagcccacctctcctgccagggccagtcagaactattggacgcaacttgccgtaggtaaccaaacaaaaacctggacccacgccctcccacgtacctcctactatttatcttccactccaccgtacgggacctactagtcgtacgtaccccgaaacacgtattaccgaggtcggacaaggggtcggggtcgtcgggacgacgtacttcgtaacgttctaccaccgttaancgacgtacaaggtacccgtagtaacgtcgtacggaaacggtacttagggcttaacgtttaagttacttagtacctaatacgtggtacgttagacggtcgaccggtacgtaaccggtccggcccgaacgggaccncgtaggtacggtactaacgttcggaacggtacggtaaagtcggttgaccgtgaccgtaacctcgttactcggtcttaacccg

SEQ ID NO: 92124 - DNA, 695 bp, Homo sapiens
  misc_feature: GYAE6OF02HDFEB.5.57.F02.1.454.CMB.1.raw
  modified_base (154)..(154): a, c, t, g, unknown or other
  misc_feature (154)..(154): n is a, c, g, or t
  modified_base (166)..(166): a, c, t, g, unknown or other
  misc_feature (166)..(166): n is a, c, g, or t
  modified_base (172)..(172): a, c, t, g, unknown or other
  misc_feature (172)..(172): n is a, c, g, or t
  modified_base (189)..(189): a, c, t, g, unknown or other
  misc_feature (189)..(189): n is a, c, g, or t
  modified_base (192)..(192): a, c, t, g, unknown or other
  misc_feature (192)..(192): n is a, c, g, or t
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (249)..(249): a, c, t, g, unknown or other
  misc_feature (249)..(249): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctggctcccagataccggtgggganatcgtgatgacncagtcncacgcatcctgtctgtntcncggaggganacgngtccacctntctcgacgacggcctagtacagacgtattcggganacctaatcgcctacggtaaccaaacaaaccgtgaccacggtccccaccacgacctacctacttaattacgttaccgtactacctacccgtaccgaccggtcctatacgtacgtacccgtacccaaacgtaacggtcttaccgaaggttcgacctagggtacggtacggtcggaactacgtactacgggtctacccgtacgacccagtaccgacgttacgactacggtaacgacgttaccggaaggttaaaggttccgttaggggttacctttaagttacgttaaccgtacgtaacgtaatacgttaggttaccgtaccggtaggtacccgtacgggtacgtaccggttacccgcggtaacggcctaagggtacggctagtccgtaaggccgtaagtacggtccgtcggtaactccggactaccttggtactttaccggcttaccgg

SEQ ID NO: 92125 - DNA, 689 bp, Homo sapiens
  misc_feature: GYAE6OF02HFZR5.5.57.F02.1.454.CMB.1.raw
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccagataccgttggggagatcgtgatgacgcagtctccagccatcctgtcctgtgtcctcaggggganagngccaccctctctgcagggccagtcaggaacagttggtagctaacttagcctaggtaaccaaaacaaaaaccgtggaccagcctaccagactcctactatttactcgttcactccaccgacgggccacgtgagtcgtacccaaccagtattcgaagtggacaggtacgggtctaggggacaggtacttacgacgttactaccaaccgtatcgagaccgaacgtaccggtaactaggtactaggtaaacggtacgttacggacgtttaagtttaacttaccgtagttaaccgaaactaaagttcggtacggttaacgacgggtttaccggaccgtaacggtaaccggtttccgggacccggaacgggtaccctaacggaggttaggacttaacgttaccggaaggaaccgggttaacttaggggtaccgtcggttaacccggacgttaaaccgtaccggttttacctacggttacccgtttaaccg

SEQ ID NO: 92126 - DNA, 792 bp, Homo sapiens
  misc_feature: GYAE6OF02G45QV.5.57.F02.1.454.CMB.1.raw
  modified_base (211)..(211): a, c, t, g, unknown or other
  misc_feature (211)..(211): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
  modified_base (358)..(358): a, c, t, g, unknown or other
  misc_feature (358)..(358): n is a, c, g, or t
tcagatcagacacgcacgaccggtgctcgatttagctcgatatagttgggtttgggggaggaacgtgctcagttaggacccagacggaaccatggaagcccagcgcagcttctctcctctgctactctggctcccagataccgtgggacatcgtgactgacgcagttctccgagcccatccctgtcctgtcgtcctaccgagggggatagnggacccacctctccgtgaccgagggacctagtaccaagaaaccgtnttacgggtaanacctaaacgttagcccgttaacggtaaccaaaaaccgaaaaaaccgtgggacccctaaacggacccctaacccgaaccgtaccttacccnccgttaacttttacgtaccgttacctacgttacccaacccgtacgggaccctaacgtacgacgtccgtaacccaaacccgttacaactttaccgaggtacgacgtaacggtaacgggtcgttacgggaactaacgacgtttacgacggttactacctaaccgtactacgaacggacctaggtacccgtaagtaccgtaccgtaaggtaaccggttacgtaccgggactttaggtttaacttacgtacgtaactaaacgtaagtcgtaacgggttcaacgggtccgttacccgaaggttacccggtaccgtaccgaacccgggtaacctaccggaacggtaccgttaacgcgtttaacgaacggaaccgttaagggtaccgttagggaaccttcgggtactaaacccggacgtttaccgtaggtttacctaccgg

SEQ ID NO: 92127 - DNA, 819 bp, Homo sapiens
  misc_feature: GYAE6OF02ILQMG.5.57.F02.1.454.CMB.1.raw
  modified_base (154)..(154): a, c, t, g, unknown or other
  misc_feature (154)..(154): n is a, c, g, or t
  modified_base (786)..(786): a, c, t, g, unknown or other
  misc_feature (786)..(786): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctcggctcccagataccgttgggganatcgtgatgacgcagtctcagccatcctagtctgtcgtctccgaaggggcgagtacgcctacccgtctcctcggtcaacggggcccctaggtaccgagtaaaccgtagttcgggtacgacctaaacgttcggaccttacgggtaaacccaaacctaaaaacccgtcggacccaaccgtcccccgtacccaaccggtacctacccgtactacgttttaactccggttaccaacgtaccctaccgaacggggtccctaacgtacgtaacgttccgtaacccctaaccgtacggtaacctttaccggaacggttcggaccggtaacgggttaacggggttacccttaagggggtacccttaaggtaaccggtttacgtacggtaccgttaccgaaacccggttacgtaccggtacgtaaccgtacgggttacccgtaaccgtaaccgttcggtaagtaaccgtaccgttacggggtaccttaagttcggttaaccttacgggtaacctaacgggtaattcgtgggtaccttaggtacggtaccttaccggtaaacgtccggtaccgtacgggtaaccgacctaggttacggtactacggtactacgggaccgtaaggttccggaggtacccgttnaccggtaccttaggtacttccggtattacccgg

SEQ ID NO: 92128 - DNA, 758 bp, Homo sapiens
  misc_feature: GYAE6OF02HWAUR.5.57.F02.1.454.CMB.1.raw
  modified_base (257)..(257): a, c, t, g, unknown or other
  misc_feature (257)..(257): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctcagccatcctgtctgtgtctaccgaggggagagacgcccaccctctccgtgccgacgggccagtcaaggtaactagtttgggaancctaacttacgccgttacggtaaccaaacaaaaaccgtcggaccacgccctaccgaacgaccttcctactatttacttccgttacacttacccgaccgtacgggtaccctactaggtactacggtaccccaaaccgtagtactttaccgagggtccggacgtaaggggtcggttacgtacggggaactacggtaaccttcgtaacgttccgtaccaaccgtacgtaccgaaggtactacggtacgtaaaccgttacgacgttaacggaaacgttcggttacggacgttttaacggtttaacttacggtttacgttaacctaaacgtaaacgttcggttacggttacgtacggttaccgttaccgttaccgggtaacgggtttccccggaccgggttaaccgggtaccgtaacggtacgttaaggacttaacggtcggtaacggtaacggtacgtcgacggtcgtcgaccgtaacgttcgtttacgtcgtttaccgttaccg

SEQ ID NO: 92129 - DNA, 702 bp, Homo sapiens
  misc_feature: GYAE6OF02GX7U3.5.57.F02.1.454.CMB.1.raw
  modified_base (152)..(152): a, c, t, g, unknown or other
  misc_feature (152)..(152): n is a, c, g, or t
  modified_base (201)..(201): a, c, t, g, unknown or other
  misc_feature (201)..(201): n is a, c, g, or t
  modified_base (681)..(681): a, c, t, g, unknown or other
  misc_feature (681)..(681): n is a, c, g, or t
tcagatcagacacgcacgaccggtgctcgatttagctcgatatagttgggtttgggggaggactgctcagttaggacccagacggaaccatggaagccccagcgcagcttctcttcctcctgctactctggctcccagataccgttgggganatcgtgatgacgcagtctccagccatcctgtctgtgtctccgagggganagagcccacccgtctcctgccagggccagtcagacattggagcaacttgcctggaaccaacaaaacctggaccagccctcccagacctcctcatttactcgttacatccgaccagggccacgtcgatcgtaccccaaccgtaagtacttacagtcggactacgggacgggttcacggggacaacggtacttaccgaagttccgtaccaacctacgtaccacggacacggaccgttaacgagttcccgttagaaacggtccgtttaggtaccttaaggtttttaactaacctttagggtaaccctaaacgttaagttcggttacggttccgtagggttccgggtaccgtttaaccgggtaacccggtttccgggacccccgaaaggggtaaccctaaccgggagtttaacgggactttaaccggtaccgtaacggggaccggtttaaactcggggttacgccggttgtacccacccgttanccgtttcggtacctttacccg

SEQ ID NO: 92130 - DNA, 716 bp, Homo sapiens
  misc_feature: GYAE6OF02FUFNP.5.57.F02.1.454.CMB.1.raw
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagcccatccctgtctgtgtctccgagggganagagcccaccctctcctgccagggcccagtcagaacagtttggagcaacttgcctggtaaccaaacaaaacctggccagcctcccagacctcctagtatttactccgttacacttcccaaccgagggcccaactcgtactcgtaccccaaaccgtacgtactttcgaaggtcggacgaaggggtacgggtcgtacggggactaacggtaccttacgacgttccgttaccaacccgtactaccacgtaccgacggtaccgttaacgacgttaccgtaggaacgtacgttacgggtactaaggtttttactaccgtagtaacctaaacgttaagttcggttacggtacgtaggttccgggacccgttacggtaacccggtttcccgggacccggaacgggtaaccctacggtaacggttacggtacttacgtaccggtaacggtaaccggttaacgttcggggtaccgttacgtaccgacccgtaacctacgtccggttacgttcgttaacccg

SEQ ID NO: 92131 - DNA, 836 bp, Homo sapiens
  misc_feature: GYAE6OF02JFJ10.5.57.F02.1.454.CMB.1.raw
  modified_base (150)..(150): a, c, t, g, unknown or other
  misc_feature (150)..(150): n is a, c, g, or t
  modified_base (199)..(199): a, c, t, g, unknown or other
  misc_feature (199)..(199): n is a, c, g, or t
tcagatcagacacgcacgaccggtgctcgatttagctcgatatagttgggtttggggagaactgctcagttaggacccagacggaaccatggaagccccagcgcagcttctcttcctcctgctactctggctcccagataccgttggganactcgtgatgacgcagtctccagccatcctgtctgtgtctccgaggganagagcccaccctctcctgcgacggccaggtacaacgaactagtttggaacgaccgtaaacgttcgccgttacggtaaaccctaaacgtaaaaaccgtcggacccacggtacccctacccgaacgtacccgttacccgtacttaactttttaacgtccgttactaccgtacccgtaaccggacggaccctaacgtagaccttacgtacccccgaaaccgtaggttaacgtttccaaggtccggtacctaaggggtacgggttacgacgggtaaacaccggtttaccttacgtacggttaccctaccgtaacccgtagtttccgaagtccaacggtaccccgtaaacgttacggttaacgtaggtaaaccggtacgtttaccgggtaaaccgttagttttttaaccgttacgtaacgttaaacctaaacgttcgtttacgggtagggtttaacccgttaagggttcccgttacccgttaacggtaacccgggttttacccggaacccgggtaaccggtaacctacgggtacgtttaacgggacttaacccggtaacggtaccgggaacttaacccggttggttacggtaaccctcggtaaacctcggttacctttcggttaccgtttaccgttaacccg

SEQ ID NO: 92132 - DNA, 783 bp, Homo sapiens
  misc_feature: GYAE6OF02G37B0.5.57.F02.1.454.CMB.1.raw
  modified_base (151)..(151): a, c, t, g, unknown or other
  misc_feature (151)..(151): n is a, c, g, or t
  modified_base (201)..(201): a, c, t, g, unknown or other
  misc_feature (201)..(201): n is a, c, g, or t
  modified_base (203)..(203): a, c, t, g, unknown or other
  misc_feature (203)..(203): n is a, c, g, or t
  modified_base (719)..(719): a, c, t, g, unknown or other
  misc_feature (719)..(719): n is a, c, g, or t
tcagatcagacacgcacgaccggtgctcgatttagctcgatatagttgggtttggggaggaactgctcagttaggaccagacggaacatggaagccccagcgcagcttctcttcctcctgctactctggctccagactaccggttgggganatcgtagatgacgcagtctccagccatcctgtctgtgtctccgagggganancgcccacctctcctgcgtacgggacctaggtccaagtaacctagtttaggtagacctaaacgttcgccgttacggtaaacccaaaacgaaaaaccgtggaccacgtacccctaccgagtacctcctactaacgtttactccgttacactcccgaacgtacggtccaacgttagacttaccaccgaacctagtaacttcgaacggtcggtacgtaagggtacggtcgtacgggagtaacgtacttccgaagttccctaacgacctaacgacgaagtccgaacgtacgtaacgtacgtactaacggtaacttacggttacggtacgttaacgttttaacgttactaggttaacctaagttaacgttcggtttaacgtaccgttacgggttaccgtacccgggtttaaacgttacccgggtacccgaacccgggtaaaccggtacccgacgtacggggttaaccgttaaccgtaggttaccgggtaaaccggtaacccggttaagtacgggggttaccnccggtttaaccgaacccggtacttttaacccggggtacgttttaccgggtttaccctaaccccg

SEQ ID NO: 92133 - DNA, 761 bp, Homo sapiens
  misc_feature: GYAE6OF02JBD2A.5.57.F02.1.454.CMB.1.raw
  modified_base (155)..(155): a, c, t, g, unknown or other
  misc_feature (155)..(155): n is a, c, g, or t
  modified_base (206)..(206): a, c, t, g, unknown or other
  misc_feature (206)..(206): n is a, c, g, or t
  modified_base (257)..(257): a, c, t, g, unknown or other
  misc_feature (257)..(257): n is a, c, g, or t
  modified_base (444)..(444): a, c, t, g, unknown or other
  misc_feature (444)..(444): n is a, c, g, or t
tcagatcagacacgcacgaccggtgctcgatttagctcgatatagttgggtttgggggaggaactgctcagttaggacccagacgggaccatggaagccccagcgcagcttctcttcctcctgctactctggcctcccagactaccgttgggganatcgtgatgacgcagtctccgagccatcctgtctgtcgtctccgagggganagcgcccaccctcgtccgtgcgtagggcccagtcaagaactgttggtaacnctaacgtcgcctacggacctaaacgaaaacctggaccacgccctccaagacctcctctaacttctacgttcgactcccgaccgaggcccactaggacctaccgtaacccaaccgtagtacttacgaacggtcgacgaggtacgggtctacgggacacgtcgtacgtacgtcctactaaccggttacncgacgtaccgagtacgtacgtacgtaccgtaggtaacgttacggttacggtaacgtttacgtttaacgttaccggttaacgtaaccgttaaacgttaggttaccggttaacggtccgtaaacggttccggttaaacccgtcccggtttaaacgggtccccgttaacccgaacgggggttaacccgttaacggaacgggttacggtaacgttaccggtaaccgtaaccggggttaccgtaaacggttcgggtacccgtaacggttacccggtaaaccgtcccggttacggtacccgtttagggtacccgtttaacccc

SEQ ID NO: 92134 - DNA, 769 bp, Homo sapiens
  misc_feature: GYAE6OF02GZ1F2.5.57.F02.1.454.CMB.1.raw
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttggggagatcgtgatgacgcagtctccagccatcctgtctggtgtctccgaggggagagacgcccaccctctcctgcgacgggccagtcaagaacctagttggtacgacctaacgttacgtccgttaacgggtaaacccaaaaccgtaaaaaacccgtcgggaccccgacgtcccccgttacccgaacggtaccctacccttaccgttaactttttacgttaccggtttactaaccgttaccccgaacccggtaccgggtaccctaaccgttacggtaaccttacccggtaaccccaacccgtagtacgttaccgaggtcggacgtaacgggtacggggtacctacggggaactacggtacttacggaccgttcctaccgaacctactacgacgtccaacgacgttaccgagttaccgtaaggaacgtacgttaggtaccgtttaagtttaacgttacgttacgtaaactaagttaacggttggtacggtacgtcgggttaccggtaccgttcgtaaccggttccggacccgaacgggtaccaacgtagacgtataacgtcggaaggtaaccgtagtcgggacgtcgtacgacctaccgttagtaccgttgttccttaccg

SEQ ID NO: 92135 - DNA, 723 bp, Homo sapiens
  misc_feature: GYAE6OF02I7CEC.5.57.F02.1.454.CMB.1.raw
  modified_base (153)..(153): a, c, t, g, unknown or other
  misc_feature (153)..(153): n is a, c, g, or t
  modified_base (482)..(482): a, c, t, g, unknown or other
  misc_feature (482)..(482): n is a, c, g, or t
  modified_base (489)..(489): a, c, t, g, unknown or other
  misc_feature (489)..(489): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccacgcctatcctgtctgtcgtctccgaggggacgagacgcccaccctcgtcgtgcgacgggccagtacaacgtaactgtttaggaacgtactaaacgttcgtactaacggtaaccaaaacgaaaaaccgtcggaccaacgtcccctaccgacgtaacctccctacttaacgtttactccgttacctaacctcccgaacccgtacggaccctaagtacgacttacccgaaccccgtaacacgttaccgtacgtacggtacggacgtaacgggtgggtacctagggaactacgtactacgtcgtccacaccntaaccgncgtaagcgtaaacgcgtacgtaagaacgttctaacggtactacgttttacaacgttacgaacgtaaactaagttcgtaaggtccgtaaacggtccggaccttaacggtaccgttcccgaccggaacggtacccgagtacggtaggtacttacggacgtaacgggtaacgtacggtaggttccgaaccgttccggaactaacccggttatacccgggttagtaacccgttttcgg

SEQ ID NO: 92136 - DNA, 854 bp, Homo sapiens
  misc_feature: GYAE6OF02HFZ72.5.57.F02.1.454.CMB.1.raw
  modified_base (155)..(155): a, c, t, g, unknown or other
  misc_feature (155)..(155): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttgggganatcgtgatgacgcagtctccagccatcctgtctgtgtctccgaggggagagacgccaccctctcctgcgacgggcctagtacaacgaactagttaggacgactaacgtacgccgtacggtaaacccaaaaccgtaaaaaccgtccggaaccaccgtacccctacccgaacgtacccttcccgtaacttaacttttaaccgttcccgttacctaaccttacccccgaaccggaccggggtaacccctactacggtaccgttacccgtaaccccgtaaaccgtaacgtaccgttacggtacggtaccggacggtaacggggttacgggttaccgggtaacgggtaacgtaacggttaccttaccggtacgttacccgtaccttaacccgacgttaccgacgtaccgtaacggtacccgttaacgtacggttacgtaacgtaaacggtacgtttggtaaccgtttagtttaacgttacgttacgtaacctaaagttacgttcggtacgttacgcgggttacccggaccgttaaccgggtacccgggttacccgaacccggggtaaccgtaccgtaacggttaaccgtaggttaaccgtacgggtacccggtaacgggtacccggtaagggttccggttaacgggtcctaccgggtaaccctaccgttaaccgttcccggttaccgtttacccgtttaacccg

SEQ ID NO: 92137 - DNA, 701 bp, Homo sapiens
  misc_feature: GYAE6OF02HVXL3.5.57.F02.1.454.CMB.1.raw
  modified_base (212)..(212): a, c, t, g, unknown or other
  misc_feature (212)..(212): n is a, c, g, or t
  modified_base (263)..(263): a, c, t, g, unknown or other
  misc_feature (263)..(263): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggcctcccagacttaccggttggggagatcggtgatggacgcagtcctccagccatcctgtctgtgtcctacggaggggganaagcgcccctaccctctccgtgacgacggcctagcgaagaactagttgganactaacgttacgcctaacggtaaccaaaacgtaaaaccgtcggccaaccgccctacccgaagtacctctactattactcgttacactccacgacggtaccacgtgtactacgtacccctaagacgtacttacgaggtaggaccaaggggtcggtcgtacggacacgtacttcgaacgtctaccaacgtacgtacgacggtacgaacgacgtaaccgtcgtaacccggtagaaacgttacggtaaccgtcgttttaaaaggtttaactaccggtttacgaaccaaagttacgtggtacgtacggtacggtcgtacccgtacgggtaacttccggcggttaaccgggactaacggagttagacgtagttccgaaccgggttgaccgtagggtactcggttacccggactaaccgttacctacgtacttcggttttaaccc

SEQ ID NO: 92138 - DNA, 995 bp, Homo sapiens
  misc_feature: GYAE6OF02IHTEW.5.57.F02.1.454.CMB.1.raw
  modified_base (165)..(165): a, c, t, g, unknown or other
  misc_feature (165)..(165): n is a, c, g, or t
  modified_base (709)..(709): a, c, t, g, unknown or other
  misc_feature (709)..(709): n is a, c, g, or t
tcagatcagacacgcacgaccggtgctcgatttagctcgatataggttgggtttgggggaggaactgctcagttaggacccagacggaaccatggaagccccagcgcagcttctcttcctcctgctactctcggcctacccagacgttacccggttagggggganagttcggtagatcggaccgcgtacgttcctaccgacgtcccacttcccgtagttcttggttcgtccgtaccggagggggagacgaccgtacccctaccccttccgtccgtcggaccggtacgggccctaacggtacgaacggtaaacgtttaagggttttaaccggggtaaactaacccgttaaaaccgttttaccggacccgttaaaccgggtaaaaacccctaaaaaacccgttaaaaaaacccgtccggggaacccaacccgttccccccgtaaccccgtaaccgtaaacccgtttcccccgtaacgttttaacttttaaccgtttcccggttaacctaacccgtaccccgtaaaccccgggtacggtacccctaacgttacggtaccgtacccgttaaccccgaaaccgaacggttaacgtttaacgggaacggtaccggtacgtaacgggggtaacgggttccgggtaacggggaaactttaaccgggtaacgtttaccgaaacggtttcccaaacccggtaacctacgacccggtaanaccgtacgtacgtacggtaacttcggtaagttaacgtacgttacgttacgtttaacgtttacgtaacgtacgttaaactaacgttaacggtaggtacgtacggtacgttaacccggtaccgggttacggtaaccccggttaccgggaaacccgggtaaccggggtaaccgacggttaacggtacggtaacgttacggaaccggttaacgggaacccgtacgggtttaagcccgggttaaccgtccggaacttaccgtaaccgtttgttacccgttacctttaccgg

SEQ ID NO: 92139 - DNA, 784 bp, Homo sapiens
  misc_feature: GYAE6OF02GPD1K.5.57.F02.1.454.CMB.1.raw
  modified_base (200)..(200): a, c, t, g, unknown or other
  misc_feature (200)..(200): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctcagccatcctgtctgtgtctcgagggganagacgccacccttctcctcgacgacgggcctagtccaagaacctagttcggtaacgactaaacgttacgcctacggtaaacccaaacgtaaaaaccgtgggacccaacgcccctacccgaacggtaccttcccgtacttaacgttttaactccggtttactaacctaccccgtaaccggacggggacccctaagtacgtacgttaccgtaccccgaaaccgtaagtacctttacgaacggttacggacgtaacggggtaacgggtcggtaacggggaacctacggtaccgttacgaacgttacccgtaacaacctacgtaacgacgaccgtaacggtacgttaacctacggttaccgtacggtaaacgttacgttacgggtaacctttagttttaacgttaccgtagtaacccgtaaaacgttagtacggtttacggtacgtacgggtaccggtaccgtacgggtaacccggttcccggaaccggtaaccggacctaagtacgggtacgtacgtcggtaaccgtagggaaccgttacggtcggttacggcgtagacctaccgtaaccttcgtacgttactaccg

SEQ ID NO: 92140 - DNA, 695 bp, Homo sapiens
  misc_feature: GYAE6OF02JFDLJ.5.57.F02.1.454.CMB.1.raw
  modified_base (153)..(153): a, c, t, g, unknown or other
  misc_feature (153)..(153): n is a, c, g, or t
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (480)..(480): a, c, t, g, unknown or other
  misc_feature (480)..(480): n is a, c, g, or t
  modified_base (666)..(666): a, c, t, g, unknown or other
  misc_feature (666)..(666): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtcctcagccatcctgtctgtgtctaccgaagggganagacnccctaccctctccgtggccgagggccagtacgacgaaactgttggtacgacctaacttgcctacggtaaaccaaaacgtaaaacctggaccacgaccctacccgagtaaccctcctactactttacgttaccgttcactaccccgaacgaccgggtacctacgtacgtaactaccgtacccctaaacctaggtaaccttacgacgttacggacgagggtacgggtactacggggaactacgtacttcgacgttctaaccgactactcgacncgtaacgcgtaagacgtacgagtaacgtacgttcggtacttaaagttttacgacgtttaacgtactaaacgtagttcggtacgttacgaggttccgtaccggtaacgttccggtaaccgtacccgtaacgtaccgaacggtaggtacgtacgtagtcccgagaccgttaggtcgtcgtaccgttanccggtaacctgttccgttacgtcttaccg

SEQ ID NO: 92141 - DNA, 726 bp, Homo sapiens
  misc_feature: GYAE6OF02G5JVF.5.57.F02.1.454.CMB.1.raw
  modified_base (205)..(205): a, c, t, g, unknown or other
  misc_feature (205)..(205): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagatccggttggggagatcgtgatgacgcagtcctccagccatcctgtctgtgtcctccgaagggganacgacgcccaccctcgtcctggcctacgggccaggtcaacgaaactagttcggaacgtctaaacgttacgccgttacggtaaacccaaaacaaaaaccgtcggaaccacgtcccctacccagtaccctacctactactttaactccttacactacccgaccgacgggacccactcgaactccgtaaccccaaactagtaacttcgacgtaggacagggtacgggtaccgtaggggaactacggtaaccttcgaacgtcctaaccaaccgtatccgaacgaccgtacgtaccggttaacgacgtacgtaagtaaacgtacggtacggtacttaacggtttaattacgtctaacgaaacgtagttcggtaggtaccgtaggttcggaccgttccgggtaaccggtttccggacccgtacgggaaccctagtacgggtacggacgttagaccggtaacggaccgttaacggtcggtaccggtgtcccggaccgtaacgtaccggtttccttacggtccttaccg

SEQ ID NO: 92142 - DNA, 619 bp, Homo sapiens
  misc_feature: GYAE6OF02FLGUR.5.57.F02.1.454.CMB.1.raw
  modified_base (525)..(525): a, c, t, g, unknown or other
  misc_feature (525)..(525): n is a, c, g, or t
  modified_base (559)..(559): a, c, t, g, unknown or other
  misc_feature (559)..(559): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctccccagataccgttggggagatcgtgatgacgcagtctccagccatcctgtctgtgtctccgaggggagagagccaccctctcctgcgagggcccagtcagaactagttggtagcctaaacttacggccttaggtaacccaaaactaaaaaacccgtgggacccaacggcccctacccagacctccctactactttactcgttacacttccccgaaccgacgggtcccacgtcgacttccgtaccccaaaccgtagtacttacgacgttcggacgtaagggtacgggtctacggggaactacggtacttcgacgtctacacctactcacgcagtaccgtacacgtctagaacgtgttgactagtttatactgtaacaactagtgtgtacgngtcgccttacgaacgttcgacccgtaggacctanagtcgatagtcgacggtacgtacgtggtcgacgttcgactaccgtagtcgtcgtacttac

SEQ ID NO: 92143 - DNA, 833 bp, Homo sapiens
  misc_feature: GYAE6OF02GUAQC.5.57.F02.1.454.CMB.1.raw
  modified_base (441)..(441): a, c, t, g, unknown or other
  misc_feature (441)..(441): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggctcccagataccggttggggagatcggtgatgacgctagtctccagcctatcctgtctgtgtcctccgaggggagagacgccctaccctctcctgccgacgggccagtacaagaactagttcggagactaacttacgaccgttacggtaaacccaaaacgtaaaaacctcgggacccaacgtcccctacccgaagtaccctccttacttaactttacttccgttaccaaccttccccgaacccggtaggtaaccctacgtacgaccgttaccgttaccccaaacgtacgtacttaccgtaggtacggnggtaacgggtacgggttccgtaaggggaacctacggttaccgttcgtaaccgttacccgtaccaaccgtacgtacgtaacggtctaaaccggtaccgttaacgtcgtaaccggttaagaacggtttaccgttaggtaacgttttaaacgttttacgttaaccggttaccttaaactaaagggtactttagggttaccggtgttaacccgggttcgtaacccgtttaacgggttaccccggttaacccgggtccggaaaaccggggtacctaacggttacgggtaaacggtttaccgtaacgttacggggaaaccgggttaccggttaacgtcgggtccggttaacgttaaccgacggtttaccttaccggtacgtttttacgtacccgttac

SEQ ID NO: 92144 - DNA, 816 bp, Homo sapiens
  misc_feature: GYAE6OF02G6R08.5.57.F02.1.454.CMB.1.raw
  modified_base (155)..(155): a, c, t, g, unknown or other
  misc_feature (155)..(155): n is a, c, g, or t
  modified_base (210)..(210): a, c, t, g, unknown or other
  misc_feature (210)..(210): n is a, c, g, or t
tcagatcagacacgcacgaccggtgctcgatttagctcgatatagttgggtttgggggaggaactgctcagttaggacccagacggaaccatggaacgccccagcgcagcttctcttcctcctgctactctggctcccagataccggttgggganatcgtgatgacgcagtcctccgacgccatccttgtctgttcgtcctcgagggganacgacgacccacccgttcctccgtgacgacgggaccagtaccgacggaactagtttaggtacgactaaccgttacggtccgtaacggttaacccaaaaaccgaaaacccgtccggaccaccgtaccctaccctaacgtacccttcctactttatttacgttccgttacctacctacccgtacccggcggtacctacgtcgtaactccgtaacccaacgtactacgttcgagttcggacgtacggtacgggtcgtaacggtactaacggtacgttcgtaaccgttcccgaccgtaaacgtcgtaccgacggaccgttaacgtacccgtaacgttacgtaccggttaaacgaacgttccggtttaagtaaccgttttaagtttaccgttaccgttaacgtaccgtaaagttcggttaggttaccggtacgtaaccgggttccgtaacccggtttaccggtaaacccggtccgggtaaaccccgtaaggacctttaaagggcggttaacgatttacccgtaacgggacggttaaccggttaacgggtcgttaacgggccctaaggttcccctaaacgttccggtttaccgtttacgtttacccgtacgg

SEQ ID NO: 92145 - DNA, 833 bp, Homo sapiens
  misc_feature: GYAE6OF02HG93X.5.57.F02.1.454.CMB.1.raw
  modified_base (199)..(199): a, c, t, g, unknown or other
  misc_feature (199)..(199): n is a, c, g, or t
  modified_base (456)..(456): a, c, t, g, unknown or other
  misc_feature (456)..(456): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctggctccagataccgttgggagatcgtgatgacgcagtctccagccatcctgtctgtgtctccgagggganacgacgcccgacccttcgtcctgccgaagggtccctagtcgaacgaacgtatttgggaacgcctaacgttacgacccgtacggtaaacccaaacgtaaaaaaaccctcgggaccacggcccttacccgacggtaccttccctaactacttttacctacgtaccgtaacttaccccgaaccgacgggtcccagtacgtacgtaccggttaccccaaacccgaggtacttcgaagtccggtacgagtacggggttccgnggtaaccgtagtaccttcgtagttcctacgacctactacgtacggacctaggtaccgttacgacgttacgtacggtaaaacggtcgtttaacggtaccgtttaaggttttaacgtttaaccggtaacgttcaaaaacccgtttagttaacggggtcggttaacgtaaaccggtacgggtttccccgttaagaaaacccggttttccgggacccggtaacccggggtaaactcccgtaaggggtttaacgaccgtttaaggttacccggaaaagggtcccgggtttaaacggttaaccggtcgggttttaaccgacccggggttaacctaaaccccgttaggtttacccggttttacccttacgttttaaacccccgg

SEQ ID NO: 92146 - DNA, 917 bp, Homo sapiens
  misc_feature: GYAE6OF02G7AFM.5.57.F02.1.454.CMB.1.raw
  modified_base (187)..(187): a, c, t, g, unknown or other
  misc_feature (187)..(187): n is a, c, g, or t
  modified_base (211)..(211): a, c, t, g, unknown or other
  misc_feature (211)..(211): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagacgtaccggttggggacgatcgtgatgacgcagtctccagccatcctntccttggtctcgtccgaagggganagtacgcccctaccctcgttacctcggacgtacggggccagtaccaaggtaacctagttcggtaacgacctaacgttacgccttacggtaaaccaaaaccaaaaccggtggaccaacgtcccctacccacgtaccctcccgtacttaacttttaccgtacggttacccaccgtccccgtaaccggtacgggtaacccctcttaacgggaccgttacccgtaacccccgtaaactaacggttacttacccgtacggggttccgacgtaacggggtacggggtacggtcgggaaacgtaacgtaccggttactaacgtaccctaacgtaccctaaacgtccgtaaggtacccgaacggttaccgtaacgtacgtttaaccgggaagtaaacgttccggtttaccggtaaatttaaccggtttttaacgaaccgtttacgtaaacgttaaccggtagtttaccggggttttacgaccggtttaaacgggtccggggttaaaacccgtttaccggttaaacccggggggtaccccttaccggggtaaaacccggggtttaacccaacggtaacgggttttaaccggggaacttttaaaccgggccgtaaccggggttaaaccggttaccgggggtcggttacccgggttacggaacccggtttaccctaaacgttacccgggttttcgtaactttacccgggttaacccg

SEQ ID NO: 92147 - DNA, 757 bp, Homo sapiens
  misc_feature: GYAE6OF02F5RBB.5.57.F02.1.454.CMB.1.raw
  modified_base (192)..(192): a, c, t, g, unknown or other
  misc_feature (192)..(192): n is a, c, g, or t
  modified_base (205)..(205): a, c, t, g, unknown or other
  misc_feature (205)..(205): n is a, c, g, or t
  modified_base (678)..(678): a, c, t, g, unknown or other
  misc_feature (678)..(678): n is a, c, g, or t
  modified_base (722)..(722): a, c, t, g, unknown or other
  misc_feature (722)..(722): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcggtgatgacgctagtctccagccatcctgtctgtntctccgagggganagacgccctaccctctccgtgccgagggcctaaggtccaacggtaaactagtttacgggtaacaccgttaaaacgttacggaccgttacggtaaccccaaaaaacgtaaaaaacccgtgggaccccaaccgtaccccgtaccccaaggtacctcccttactaacttttaacgtacccgttacaccgtacccgaaccggtaccgggaccctaaccgttagtaaccgttaccgtaaccccctaaacgaacgtaacgttacgaaggtacgggactaagggtaacgggttcgagggtaaccaggttaaccttacgtaacgttccctaaccaccgtaactacgacgacaacggtacggtacaccgtagtacgaagttcggtagtacttaacgtttaacgtactacgtaactaacgtaagtcggtagtacgtaggtacggtacctacggtaacggttaccggacccgaacgggtaaccncggtagacggtactaggtaccgaaggtaccggtaacgtacgggngtcttacgaccgtactagtcctttacaccggttac

SEQ ID NO: 92148 - DNA, 683 bp, Homo sapiens
  misc_feature: GYAE6OF02IOR1D.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (290)..(290): a, c, t, g, unknown or other
  misc_feature (290)..(290): n is a, c, g, or t
  modified_base (331)..(331): a, c, t, g, unknown or other
  misc_feature (331)..(331): n is a, c, g, or t
tcagatcagacacgcacgaccggtgctcgatttagctcgatatagttgggtttgggggagaactgctcagttaggacccagacggaaccatggaagccccagcgcagcttctcttccctcctgctactctggctcccagataccgttgggganatcgtgatgacgcagtctccagccatccctgtctgtgtcctcgagggganagcgcccaccgtctctgcaggccagtcagacagttganctaactacgctaggaaccaaaccaaaaaccgtggaccagccctacccanacctcctacgtatttactcgtcactccacgacggaccagtnaactcgtacccaacgagtacttcgaggtgaccaggtacggtacgtggacagtacttcgaagtcacgaaccctatacaacgacacggtacgtaacgtagtacgtaagaacgtcgtacggacttaagtttaacgttactacggtaactaaactaacgttaggtacggttacgacgggttaccggtaccgttaacccggtaaaccggttttcccgggaaccgttaaaccggggaacccgtaaaccgtagttaaccggggtataaccggttacggaacgggtaaccggtaaacggtttcggaacggtccgttacgaccgttaacccgagtttacccttacgggttactttaacccg

SEQ ID NO: 92149 - DNA, 956 bp, Homo sapiens
  misc_feature: GYAE6OF02F1T2S.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctcccagacttaccgttggggagatcgtgatgacgcagtctccagccatcctgtctgtgtctccgaggggagagacgccctaccctctcctgccgagggcccagtaccaaggaaactagttgggtaagacctaaacgtttagcccgttaggtaaaccccaaaaccgtaaaaaacccgtgggacccaaacggtcccctaaccccgaaggaacccttccccttactaactttttaacttcccggtttacacgtttacccccaaacccggaaggggtacccctaaccgttacgtaacgttaccggttaaccccccaaaaccgtacggtaactttaaccgtaagggttaccggaaccggtaacgggtaacggggttaccggttaacgggggaaacccttaacgggtaaaccttttaccgaacggtttcccttaaccccgtaaacccgtaaacgtttcccaaacgggtacccgtaaaacggtacccggttaaaccgtaacccgggtttaccgttaacggtaaaacgggtttaacccgttttaggggtttaaaccgttttaacgtttaaccgtacggttacctaaaacgtaacgttaggttacggttacgaacggttccggtacccgttaaccgggttaaaccggttccgggttacccccggaaaggggtaaccccttaaaacggtaccgggttaacgggtaaccgtttacgttaaccgggaacgggttaaccgggtaaaaccgtttcggggtaaccggttacccttaaccgggaccccttaaccgtaaccgttaccggttcgtttaccccgtttacgtttaacccccgg

SEQ ID NO: 92150 - DNA, 635 bp, Homo sapiens
  misc_feature: GYAE6OF02IAQ32.5.57.F02.1.454.CMB.1.raw
  modified_base (156)..(156): a, c, t, g, unknown or other
  misc_feature (156)..(156): n is a, c, g, or t
  modified_base (168)..(168): a, c, t, g, unknown or other
  misc_feature (168)..(168): n is a, c, g, or t
  modified_base (208)..(208): a, c, t, g, unknown or other
  misc_feature (208)..(208): n is a, c, g, or t
  modified_base (256)..(256): a, c, t, g, unknown or other
  misc_feature (256)..(256): n is a, c, g, or t
  modified_base (496)..(496): a, c, t, g, unknown or other
  misc_feature (496)..(496): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactcctggactcccagactaccggttggganatcgtgatgacncagtctccagccattcctagtctgtcgtctccgagggganagcgacccaccctctctgacacgggccagtacaaggaactagttgganctaacttcgctagtaaccaaacaaaaccgtcgaccacgtcccctaccgacacctcctagtactttactcgttacacttcccaaccgacggacctacgtgacttaccgtacccaactagtacttacgaggtacggagacggtcgggtacgtacggactacgtactacgagtcacaccgtatcgacgcacggtactacgtgtacgtagtaacgtcgtacgtacttacgtttagttacgttanaacgttagtacgtaggtacgtacgtaggtacggtccttaccgggtacgttaccggccgtacgaccgaagtacgggtatacgtacggtcgaaccggtacgacgttcgcgtccgtacgcctaactctcgtacgtacttccg

SEQ ID NO: 92151 - DNA, 828 bp, Homo sapiens
  misc_feature: GYAE6OF02F92MA.5.57.F02.1.454.CMB.1.raw
  modified_base (201)..(201): a, c, t, g, unknown or other
  misc_feature (201)..(201): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccgaggggngagacgccctaccctcgtcctgcgacgggccagtacagaactgttgggacgacctaacgttacgccgttacggtaaacccaaaacctaaaaacccgttggaccctaacggtcccccttaccccgaagtacccttccctactaacttttacgtaccgtttccaaccgttcccgaaccgacggggacccctaacgttcgaacgttacccgtaacccctaaaccgtacgtaacgttttcgacggttacggaccgtaaggggtacggggttaccggtaggggtaaccaacgggttacctttacggaacttaccggttaaccaaccgtaactcgacgggttaccgacggtaccggttaacacggtttccgaaggtaaacgttaccgttgggtaacccttaagtttttacgttaaaccgtaccgttaaacgttaaacgtaacggtttcgggtttaacgtaggtaacggttaccggttacccgtaccgggtaaaccggtttccgggaacccgttaacgggaaccctaggttacgggtacgttaacgtacgtacggaacgggttacgtaaacggttcgggtacggttaaccgtggtacccaaccggtttataccggtttcggtttaaccttaccg

SEQ ID NO: 92152 - DNA, 681 bp, Homo sapiens
  misc_feature: GYAE6OF02GGWAM.5.57.F02.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctccagccatcctgtctgtgtctccgagggganagagcccaccctctcctgcagggccagtcagaactagttggtanctaacttagcctaggtaacccaaaaccgaaaaaccgtcggacccacgacccctacccgagtacctcctactaacttttaacgtccgttaccaacttcccgaaccgacgggtaccctaacgtcgaacgttccgtaccccaaaccagtacttacgtacggtacggacctaggggtacgggttcgtagggaacgtagtaccgttacgtacgtcctacgactagtaccagtaccgacgtcgtaacacggtactaggaacgtacgttggactagttttactagtcgtaacaaagtactggtacggtactaggtccgggtacctacggtaaccggttcgacccgtaaggaccacgtagtacgtataccgtacgggacggacgtaacggttggttaccggactcggtacccaaaccgttcgtaccgtttacgttccttaacc

SEQ ID NO: 92153 - DNA, 733 bp, Homo sapiens
  misc_feature: GYAE6OF02FHQ9R.5.57.F02.1.454.CMB.1.raw
  modified_base (151)..(151): a, c, t, g, unknown or other
  misc_feature (151)..(151): n is a, c, g, or t
tcagatcagacacgcacgaccggtgctcgatttagctcgatatagttgggtttggggagaactgctcagttaggacccagacggaaccatggaagccccagcgcagcttctcttcctcctgctactctggctcccagataccgttgggganatcgtgatgacgcagtctccagccatcctgcctgtgtctccgaggggaagacgcccacccttctcccgtagcacgggcccaggtccaaggaacctagtttcggtagactaactttagcccttggtaaccccaaacaaaaaacccgtggacccgtaacgccccctaccctaacggtaacctcccttccctaaactttttacttcccggttttacacttaccctaacccgtaacggggcccctaactcgaacttcgtaaccccccgaaactacgtactttacgacggtcgtacacgggtaagggttccggtagggaacctaacgtcgttaacgtacgtacccttaccgacccgtacgtactacggaccaggacccgttaaccgtaagtttaccgaggtaaaacgtacgtttacggacgtttaaacggttttattaacgtcgtaacgaacctaaagtttcggttacgtcgtaggtcggccttacggaaccgttcccgaaccgacggtaccagtacgtacgactacgtcgaccgggtaatacggtcgttcgggcttgacccgtacctagtccgttacgttcttacc

SEQ ID NO: 92154 - DNA, 913 bp, Homo sapiens
  misc_feature: GYAE6OF02G2MZM.5.57.F02.1.454.CMB.1.raw
  modified_base (153)..(153): a, c, t, g, unknown or other
  misc_feature (153)..(153): n is a, c, g, or t
  modified_base (172)..(172): a, c, t, g, unknown or other
  misc_feature (172)..(172): n is a, c, g, or t
  modified_base (202)..(202): a, c, t, g, unknown or other
  misc_feature (202)..(202): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtccncagccatcctgtctgtgtctccgagggganacgacgcccaccctctccgtagccgtacgggccagtacaacggtactagttcgggaacacctaacgttacgccgtacggtaacccaaactaaaaaccgtcggaccaacgcccctacccgaacgtacctccctacgttaacttttacctacgttacctaccttaccccgaaccggtaccgggtaccccaacgttacggtaccttaccggttaacccccaaaaccgtacgttaacgttaaccggacgggttaccggtaacggtaacggggtacggggttaccggttaaaccgggggtaactaacgggttaaccgtttaaccgtaccgggttaccctaccgtaaacccgtacgtttaccggacgtaccgttaccggtaccggttaaaccgtacggtacccgttaaagggtaacgttaccgggtttacggttaacgttttacgttttaaaccgtttaacgtaccgtttaaaccgaaaccggtttaacggttgggtttaaccggttccgtttaacggggttaaccgttacccgggtttaaaccgggtaacccgggtttaccccgggaaccgttaaacccgggtaaccccggtaagttacccgggtaagggttactaacggtttaccggaacgggttaacccgtaggttaccgggtaccgtaaccggttccgttaaccttaccggacgttttaccgggtccgtttacccttacccgg

SEQ ID NO: 92155 - DNA, 778 bp, Homo sapiens
  misc_feature: GYAE6OF02GTD9H.5.57.F02.1.454.CMB.1.raw
  modified_base (172)..(172): a, c, t, g, unknown or other
  misc_feature (172)..(172): n is a, c, g, or t
  modified_base (228)..(228): a, c, t, g, unknown or other
  misc_feature (228)..(228): n is a, c, g, or t
  modified_base (748)..(748): a, c, t, g, unknown or other
  misc_feature (748)..(748): n is a, c, g, or t
  modified_base (765)..(765): a, c, t, g, unknown or other
  misc_feature (765)..(765): n is a, c, g, or t
tcagatcagacacgcacgaccggtgctcgatttagctcgatatagttggggtttgggggaggaactgctcagttaggacccagacggaaccatggaagccccagcgcagcttctcttcctcctgctactctggcctcccagactaccggttggggagattcgtgatggacgngtagttcctaccgacgcctactccgttgtccttggtcgttcctaccggaagggganacggaccgtccctaccccttcgtcccgtggacgaacggggccctacgtacgaacgtaaccgtagtttcggggaactaaccgtaaccgtttaccggtcccgttaacggtaacccaaaaccgtaaaaaccgtcggacccgtaaccgtcccccgtaccgaccgtaccttaccctattaccgttttacgtccgttactaaccgacccgttaacccggaccggtaacctaccgttacggtacttacccggtaaccccaaacttacgttaccgttacgtacggttcggaacggtacggtacgggttccggtacggaacgtacggttacctcgtaacgccctaccggactacgactggaaccgacgtacgtagtacggtcgaggttaacgtcgggttgtaacgtttaacgtttcgttaacgtcgttaaccgaaactttggtcggtccgtacgttacggtaccggtacctacggtaccggtacgccgaacggtaccgcgttaggtactacgtacgcgtaacggtcgtntacggtgcctcgactcngtcttcgcttacg

SEQ ID NO: 92156 - DNA, 722 bp, Homo sapiens
  misc_feature: GYAE6OF02JU65W.5.57.F02.1.454.CMB.1.raw
  modified_base (157)..(157): a, c, t, g, unknown or other
  misc_feature (157)..(157): n is a, c, g, or t
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
  modified_base (654)..(654): a, c, t, g, unknown or other
  misc_feature (654)..(654): n is a, c, g, or t
  modified_base (706)..(706): a, c, t, g, unknown or other
  misc_feature (706)..(706): n is a, c, g, or t
tcagatcagacacgcacgaccggtgctcgatttagctcgatatagttgggtttgggggaggaactgctcagttaggacccagacggaaccatggaagccccagcgcagcttctcttcctcctagctactctacggctcccgagatccggttgggganatcgtgatcgacgtcagttcctccgagccatccgtcggcttacggtcgtaccgtccggaggggacgagaccgcccgtacccttcgtccgtcgcgtaccgggccagtaccgaacgaactgttacggtacnctaacgtcnccgttcggtaaccaaaccgaaaaccgtcgaccgtaccgtcctacccggtacgtaccctctaacgttactttacgtacctacgaccgtcccgtaccgacggtccagtcgtaccgtccgtaaccacgtacgtattacgcggtcggacgtacgtagggtccgtaacggacgtaaccgtctaccgtacgttaccgacgtacctaggtcacggtaccgactaccgtaacgtcgtaaccgtacggtaaactcggttaacgaccgttagtttaacggttactaccgtaacgtaacgtagttccgtaacgggtctaagggtccgtacccgtacggaccgttccggacgttaacggctaacgtacggngaatccgtaacggacggttaccgacgtcgtacgtccgtacgccgtaaccgtntacgtcgttcctaacg

SEQ ID NO: 92157 - DNA, 788 bp, Homo sapiens
  misc_feature: GYAE6OF02IHSS9.5.57.F02.1.454.CMB.1.raw
  modified_base (153)..(153): a, c, t, g, unknown or other
  misc_feature (153)..(153): n is a, c, g, or t
  modified_base (210)..(210): a, c, t, g, unknown or other
  misc_feature (210)..(210): n is a, c, g, or t
  modified_base (232)..(232): a, c, t, g, unknown or other
  misc_feature (232)..(232): n is a, c, g, or t
  modified_base (722)..(722): a, c, t, g, unknown or other
  misc_feature (722)..(722): n is a, c, g, or t
  modified_base (763)..(763): a, c, t, g, unknown or other
  misc_feature (763)..(763): n is a, c, g, or t
tcagatcagacacgcacgaccggtgctcgatttagctcgatatagttgggtttggggaggaactgctcagttaggacccagacggaaccatggaagccccagcgcagcttctcttcctcctgctactctcggctcccagataccggtgggganatcgtgatgacgctagtcctccgagcctatccgtgtctgtcttccgtacgaggggancgacgccctacccgtcgttccnggaccgtacgggcctaaggtcgaagaaaccgtcgttttaggaacgtcccttaaaacgttcggtacccgttacggtaaacccaaaaacccgtaaaaaacccgttccggaccccgtaaacggtcccccgtaccctaaccgaacccttccttaaccgttaactttttacgtttcccggttacgtaaccccttaccccgaaaccccgggtacggtaccccttacgtacggtaacccgttaccgttaacccccgaaactacgtaacgttaccggtagtccggtacacggggttaccgggtaccggtacgggtacaacggtacttacccgagtccgacctaacgtcgtacacgtacgtacgtactaccgtacggtctacggtataccggttgtaccgtaagttttactacgttacgtaaccgtaattaagttgtacgtacgtcgggtacttccggtaaccggttaaccgtccgggtaaccttaccggggctaacgngtacgacgtaacgtcgtaaacgcgtacgtcgaacggtccgnaaccgctagtcgttcgtacttcccg

SEQ ID NO: 92158 - DNA, 772 bp, Homo sapiens
  misc_feature: GYAE6OF02GHSK4.5.57.F02.1.454.CMB.1.raw
tcagatcagacacgcacgaccggtgctcgatttagctcgatatagttggggtttgggggaggaactgctcagttaggacccagacggaaccatggaagccccagcgcagcttctcttcctcctgctactctggcctcccagataccgttggggatatcgtgatgacgcagtctccagccatcctgtctgtgtctccgaggggagacgacgcccacctctcctgcgacgggacctagtaccaacgaacgtagtttgggacgtacctaaccgttaggcccgtaacggtaaacccaaacctaaaaacccgtggaccctaccgcccctacccacgtacccttcctactacgtttatccgttactactccgaaccgtcgggaccacgtacgacgtaccgacccgtaaccgtagtacgttaccgagtacgggcaacggggtacggggttgacggggtaaactacgtaccttacgtaacttccgttaacccaaccgtacgtaacgacgtaccacggtaccgttacgtaacggtacccgtaaggtaaaccggtcgtttacggaccgttttagtttactttaccgtaccgtaactaaacgttagtacgggttacgtacgtacggtacggtaccgttacgggtaaccgttacccgggacccgtaccgggaacgtacgttaacggtaggtacgtacgttaccggaaccggtaacggtaccggtagggttaccgtgggttaaccaccggttaccgttaacttccggttacgttaccgttaaccg

SEQ ID NO: 92159 - DNA, 739 bp, Homo sapiens
  misc_feature: GYAE6OF02FI61Y.5.57.F02.1.454.CMB.1.raw
  modified_base (152)..(152): a, c, t, g, unknown or other
  misc_feature (152)..(152): n is a, c, g, or t
  modified_base (158)..(158): a, c, t, g, unknown or other
  misc_feature (158)..(158): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggactgctcagttaggacccagacggaaccatggaagccccagcgcagcttctcttcctcctgctactctggctcccagataccgttgggganatcgtnatgacgcagtctccagccatcctgtctgtgtcctaccgagggganagacgccctaccctcgtccctagccgagggccaggtacacgactagtttgggaccgactaacgttagacccgttacggtaacccaactaaaaacccgtcggacccacgccctacccacgtacccgttccctctacgtttactccgttttacacttacccgaacccgacgggacctacgttacgtacttaccggtaccccgaaacctacgtactttaccgtaacggttcggaccgtaacgggtacgggtaccgttacggggaacgtacgtaaccgttactaacggttacccttaccgtacccgtaaccgttcgaacgtacccgacggtcccgtttaacgaccgtttacgtacggaaccggttacgtccgggtacttacgtttaacttacgtacgttactaacagttcgtacgtacgtacggcgtcccgttacgtaacggttccgtaccgaccggtaaccagtacggtaccagtacgtcgtaacggaccgtaaggtcgtcggtacacggtacaccgtcttacgttacgtcctttaccg

SEQ ID NO: 92160 - DNA, 682 bp, Homo sapiens
  misc_feature: GYAE6OF02I5R9U.5.57.F02.1.454.CMB.1.raw
  modified_base (201)..(201): a, c, t, g, unknown or other
  misc_feature (201)..(201): n is a, c, g, or t
  modified_base (250)..(250): a, c, t, g, unknown or other
  misc_feature (250)..(250): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctcagccatcctgtctgtgtctcgagggganagacgcccaccctctcctgcgacgggcctagtcaagactgttacggtanactaacgttcgccgttacggtaaccaaaacgtaaaaaccgtcggaccctacgccccctaccgaacgtacctacccttactacgttttactccggttacacctacccgaaccggtaccgggtacctacttacggaccttaacccgtacccctaaacgtacggtactacggtacggtaggaccgtacggggtaacgggtcggtacgggactacgtacttacgtacgtacctaccgacactcgacgcgtacgtacgtataacggtctaagtacgtacggttacgacttagtttcgttactatactaattagtcgtagtcgttacgacggtccgtaacgtccggtaccgaccgtacggaccaacggtagtagtactgaaccggtgaacccggtagtcggtacgtacgtactcgactacgtcgttaccgttctaccg

SEQ ID NO: 92161 - DNA, 746 bp, Homo sapiens
  misc_feature: GYAE6OF02GPAY6.5.57.F02.1.454.CMB.1.raw
  modified_base (152)..(152): a, c, t, g, unknown or other
  misc_feature (152)..(152): n is a, c, g, or t
  modified_base (252)..(252): a, c, t, g, unknown or other
  misc_feature (252)..(252): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggganatcgtgatgacgcagtctccagccatcctgtctgtgtctcgaggggaagacgccaccctctcctgacgacgggcctagtccaagaactagtttcgggaanactaaacgttacgaccgttacggtaaacccaaaacctaaaaaaccgtcggaccaacggcccctacccgacgtacctccctacttaacttttacttaccgttcctaaccttcccgaaccgtacgggccctaacgtagtaacttccgaaccccctaaaccgtaacggttacttacgaaggtcggaccgtaagggacgggttacgtacgggactacggtaccttacgagttcctaccgaaccctgtaaccacgaccgaacgtaccgtaacgtaacgttccgtaagtaaacgtacgttaggtcctttaaaggttttacttaacgtcgttaaacctaacgtaagttaccggttacggtaacgtccggtaacggtacccgttacggtaaaccggttccgggcccgtaaacgggaacccgtaagacggttacggataacgtcggaacggtacggtacgtacggtcggactcggacctacgtacgtacgttccgtactaccg

SEQ ID NO: 92162 - DNA, 641 bp, Homo sapiens
  misc_feature: GYAE6OF02JHF27.5.57.F02.1.454.CMB.1.raw
  modified_base (153)..(153): a, c, t, g, unknown or other
  misc_feature (153)..(153): n is a, c, g, or t
  modified_base (170)..(170): a, c, t, g, unknown or other
  misc_feature (170)..(170): n is a, c, g, or t
  modified_base (199)..(199): a, c, t, g, unknown or other
  misc_feature (199)..(199): n is a, c, g, or t
  modified_base (422)..(422): a, c, t, g, unknown or other
  misc_feature (422)..(422): n is a, c, g, or t
  modified_base (464)..(464): a, c, t, g, unknown or other
  misc_feature (464)..(464): n is a, c, g, or t
  modified_base (496)..(496): a, c, t, g, unknown or other
  misc_feature (496)..(496): n is a, c, g, or t
  modified_base (504)..(504): a, c, t, g, unknown or other
  misc_feature (504)..(504): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggagntcgtgatgacgcagtcncagccatcctgtctgtgtcctcgaggganagacgccacctctccgagcgagggccagtcaagactagttcggacactaacgttcgccgttacggtaaaccaaacaaaaccgtgacccaacgccctaccgaagtcctacctcgttaatttactcgttacacgtccgaaccgacggtaccacgtcgtactccgtaccaaccgagttacttcgacggtcgacgtagggtacggtcgacgggtaacacgtacgttnaacgtcctacaaccgtagcctacggacaaccggtctaacgtntcgaagaacgttggttacggacttaacgtttntaaccgtntaaaccgtaactagtacgtcgtagacgttccgacgtgtaacccggtcgacgtccggactacgtagtacgtgtaaccgtgaaaacgggctttaggacggtcgtacgtcaaccgtaccttagtgttcccgtaattccgg

SEQ ID NO: 92163 - DNA, 884 bp, Homo sapiens
  misc_feature: GYAE6OF02GI5IM.5.57.F02.1.454.CMB.1.raw
  modified_base (155)..(155): a, c, t, g, unknown or other
  misc_feature (155)..(155): n is a, c, g, or t
  modified_base (204)..(204): a, c, t, g, unknown or other
  misc_feature (204)..(204): n is a, c, g, or t
tcagatcagacacgcacgaccggtgctcgatttagctcgatatagttgggtttgggggaggaactgctcagttaggacccagacggaaccatggaagccccagcgcagcttctcttcctcctagctactctcggctcccagataccgttgggganatcgtgatgacgcagtctccagccatcctagtctgtgtctccagggganagacgacccaccctcgtccgtgcgaacggggccagtaccgaagtaactagttggtaacactaacgttacgacccgtggtaaccaaaaccgaaaaaaaccgtcgggacctaacggtacccctaaccccgaagtaaccgtcccttactaacgttttaaagtaccgttaccgtaacgtaccccgtaacccgaacggggacccctaacggttacgaacgttaccggtaacccctaaaccgtaacgtaactttacgaacggtacgggtaacagggtaacgggtaccgtagggtaaccgtaaacgtaccttaacgtaacggttactaccgtaaccgtaacgtacctaacggaccgtaacggtaccgttaaccgaacgttaccgtaaggtaaacgtaaccgttgggaaaccttaagggttttaaaccttaacggtacggttaacgtaaaaccggtaagttacggttaaccgggtacgttaaacgggtccggtaccgtttacccggtaaacggtttcccgggaacccgtaacgggtaaacccgtaacggtaacgggttaaccggttacgtaaccggttaacggtaacggggaacccggttaaacgttccggggttaaccggtaacccggtttaccggacccgttaacgtaacccggtttacccggttacgggttaccctttaacccgg

SEQ ID NO: 92164 - DNA, 872 bp, Homo sapiens
  misc_feature: GYAE6OF02IIVA1.5.57.F02.1.454.CMB.1.raw
  modified_base (154)..(154): a, c, t, g, unknown or other
  misc_feature (154)..(154): n is a, c, g, or t
tcagatcagacacgcacgaccggtgctcgatttagctcgatataggttggggtttgggggaggaactgctcagttaggacccagacggaaccatggaagccccagcgcagcttctcttcctctgctactctggctccagataccggttgggganatcgtgatgacgcagtacctccagccatcctgtctgtagtctaccgaggggagagacgcccaccctctctgacgacgggtccagtacaacgtaactagttagggtacacctaaaccgttagtacccgttaaccggttaaaaccaaaaccgtaaaaaacccggtccgggtaacccaccggtaccccctaccccaaccgtacccttaccgtaccctttaacgttttaccgtttaccggttaccctaaccggtacccctaaccccgggtaaccggggaccccttaacgttaccgggttaccttaccccggtacccccctaaacccgtaacggttaaccttaccggtaacgggtacggtaaccgtacgggggtaacggggttccgggttaaccggggaaacgtaaccgttaacccgttacgggtaaccgttcccgttaaccaacctagtaccaacgggtaccgtacgtacccggtaactaacggttaccgtaggtaaacggtacggtttaacgggttactttaatttaaccgttttcgaaccgtttaactaaacgttagttacgtcggttactacggttcggtaccgttaaccggtacccgggtacgggtacccggtaaacggacctaacgggagttcggaacttacggaccgtaagggaccgttaaggtccgtacggaaccgtccggtaaccaccgttacgttccgttagttcccgttacg

SEQ ID NO: 92165 - DNA, 691 bp, Homo sapiens
  misc_feature: GYAE6OF02GNLJK.5.57.F02.1.454.CMB.1.raw
  modified_base (154)..(154): a, c, t, g, unknown or other
  misc_feature (154)..(154): n is a, c, g, or t
  modified_base (195)..(195): a, c, t, g, unknown or other
  misc_feature (195)..(195): n is a, c, g, or t
  modified_base (484)..(484): a, c, t, g, unknown or other
  misc_feature (484)..(484): n is a, c, g, or t
  modified_base (530)..(530): a, c, t, g, unknown or other
  misc_feature (530)..(530): n is a, c, g, or t
  modified_base (625)..(625): a, c, t, g, unknown or other
  misc_feature (625)..(625): n is a, c, g, or t
  modified_base (642)..(642): a, c, t, g, unknown or other
  misc_feature (642)..(642): n is a, c, g, or t
  modified_base (667)..(667): a, c, t, g, unknown or other
  misc_feature (667)..(667): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctcgctcccagactacggttgggganatcgtgatgacgcagtctccagccatcctgtcgtgtgtccnccgaaggggagacgtacgaccctacccgtctcccgtaggccgacgggaccctaggtacaacggtaaactgtttacgggacacctaaacgttcgtcccgtacggtaaaccaaaactaaaaccgtggacccaagtccctacccgagtacctaccgtacttagttacgtcttccaactcccacgacggtactaccgtgacgttacgaacccgaactagttacctccgtaagcggaacgtagggtcggtacgtcgggaaccttaagaccgttacacgtacctacccgaactancgtacgacgtagcgtacgtacgtcgtaacgaaccgtagggtttacnccgtttaaagtttactacggtactaacgtaaacgtacgtgtacgtagttcggacgttacccgaacgtaccgtacggacccacgggtacacggtanaggtatacggttaccgngtaaccgtcgtaagagtcggtaacnccggtactcgtattcgtacgtacc

SEQ ID NO: 92166 - DNA, 792 bp, Homo sapiens
  misc_feature: GYAE6OF02ITBHF.5.57.F02.1.454.CMB.1.raw
  modified_base (209)..(209): a, c, t, g, unknown or other
  misc_feature (209)..(209): n is a, c, g, or t
  modified_base (554)..(554): a, c, t, g, unknown or other
  misc_feature (554)..(554): n is a, c, g, or t
tcagatcagacacgcacgaccggtgctcgatttagctcgatatagttgggtttggggagaactgctcagttagacccagacggaaccatggaagccccagcgcagcttctcttcctcctgctactcgtcggctcccagtactaccggttgggggacagttcgtgatggacgcagtctccagccatcctgtctgtcgtctccgagggganagcgcccacctctccgtgcgacgggccagtaccaagtaactagttcgggatacctaacgttacggccttacgggtaaacccaaaaaccgtaaaaaccgttcgggaacccaaccgtcccccgtacccgtacggtaaccccttccctacttaaccgttttacgttacccgtttacctaaccttaccccgaaccggtaccggacccgtacgtcgtaaccgttacccggtaccccaaaccgtaactacgttacggtaacggtacggaccgtaagggtccgggtcggtagggaaccgtacgtacgttaccgacgtcctaaccgactacgtcgacacgtacggacttacgngtacgtacgtacgttacgtacgtcgttacgtttacttactacgtaactacgtagtcggtaagtcggtacgtacggtaccgttaacccggtacggacccgtacccgggtacgggaaccgtaaggtacggttaaccgtaggtaaccggtaccggaacggttaccggtaacggggttacttaccgggtaaccgtaccggccttaaacccggttacgttcccgttaccgttcgttaaccccg

SEQ ID NO: 92167 - DNA, 707 bp, Homo sapiens
  misc_feature: GYAE6OF02IVOOY.5.57.F02.1.454.CMB.1.raw
  modified_base (203)..(203): a, c, t, g, unknown or other
  misc_feature (203)..(203): n is a, c, g, or t
  modified_base (255)..(255): a, c, t, g, unknown or other
  misc_feature (255)..(255): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccggttggggagatcgtgatgacgcagtctccagccatcctgtctgtgtctccgagggganagcgcccaccctctccgtgccgacgggccagtacaagaactagtttagggancctaaacgttacgccgtacggtaaccaaaaccaaaaaaccgtcggaccacgacccctacccaacgtacctccctactatttacttccgttactactcccgaacccacgggaccacgtgtactcgaccccaacgagtacttcgaggtcggacaggtacgggtcgtacgggaacacggtacttacgtacgtctaccgacctatcgacgacacggtacgtaacgtacggtcgttaggaaacgttacgttcgggtacttaaaggttttacttaactcgtaactaaacttaacggttggtacggttacgtacggttaccgtccgttaccggtaaccggttcccgggtaaccgacgggtaaccgacgtacggttaggtacctacggtaccggtaacggaccgtaacggtcggtaccggtcgtacggccctaacgacctttcgtacgttaccttacccg

SEQ ID NO: 92168 - DNA, 758 bp, Homo sapiens
  misc_feature: GYAE6OF02HJOW1.5.57.F02.1.454.CMB.1.raw
  modified_base (210)..(210): a, c, t, g, unknown or other
  misc_feature (210)..(210): n is a, c, g, or t
  modified_base (243)..(243): a, c, t, g, unknown or other
  misc_feature (243)..(243): n is a, c, g, or t
  modified_base (272)..(272): a, c, t, g, unknown or other
  misc_feature (272)..(272): n is a, c, g, or t
tcagatcagacacgcacgaccggtgctcgatttagctcgatatagttgggtttgggggagaactgctcagttaggacccagacggaaccatggaacgccccagcgcagcttctcttcctcctgctactctggcctacccgagacttaccggttggggagtagtcgtagatcggaaccgcaggtccaccagcccatcctgtctgttcgtcnccgaggggacgagcgccacccgtctcgtgccgngggcctagtaccaagaactagttacgganaccgtaacgttcgcgtacggtaaccaaaacgtaaaaccgtcggaccaccgaccgtacccaagtacctcctaccgtattttacgtccgttactaccctccggaaccggacgggtaaccctacgtacgtacgttacccgacccaaccgtagtacttaccgaggtacgacgtagggtaacgggtcaaggggacaggttcctacgaaccgtctacgcctaagtccagggactagtacgtacgtacgttcgaacggtacgtaacgtacggttaactttacgttaacgttacgtacgtacggtaaattaacggttcggtacggtagttacgggttaacccgggttaccctaccggggttaaccggttacccgggaccgtaaacgggacccggtacgaacgggtagtaccgtaggtacccgggacgtaaccggttaggtacccgggtacgacgtccgaccggtagaaccgtttccgttacgtccttaacccgg

SEQ ID NO: 92169 - DNA, 553 bp, Homo sapiens
  misc_feature: GYAE6OF02IJGYV.5.57.F02.1.454.CMB.1.raw
  modified_base (267)..(267): a, c, t, g, unknown or other
  misc_feature (267)..(267): n is a, c, g, or t
  modified_base (513)..(513): a, c, t, g, unknown or other
  misc_feature (513)..(513): n is a, c, g, or t
  modified_base (521)..(521): a, c, t, g, unknown or other
  misc_feature (521)..(521): n is a, c, g, or t
  modified_base (523)..(524): a, c, t, g, unknown or other
  misc_feature (523)..(524): n is a, c, g, or t
  modified_base (526)..(526): a, c, t, g, unknown or other
  misc_feature (526)..(526): n is a, c, g, or t
  modified_base (528)..(529): a, c, t, g, unknown or other
  misc_feature (528)..(529): n is a, c, g, or t
  modified_base (532)..(532): a, c, t, g, unknown or other
  misc_feature (532)..(532): n is a, c, g, or t
  modified_base (534)..(553): a, c, t, g, unknown or other
  misc_feature (534)..(553): n is a, c, g, or t
tcagatcagacacgcacgaccggtgctcgatttagctcgatatagttggggtttggggggaagaggaagactgacggtcccccaggagtccagagtgcgtcgcaaagtattggcagtgtgaaatttgacaccttatatgcagactctgtggaggggccgcttcaccgtgtccagagacaactccaagaacgcctctattgcagatggacagcctgagagcgacgacacgggcattctaatatttggacggcggccgagacaattacncgttacttactttcgtaggtagtcgacgggtacgtcccgggtccacttcgtctccctcgaacgcctaccaccgaaccgggcccacgttccggttcctttcccccgtcgccctacccgtcctccgaagtaccgcctacccgtcggtcgggaccgacgacggccgggaccccgtgggtcctcgggccgtcggtacacgtaccgtccttccgtgtccagtcgctacgacggttcggctcggacgacggngacgagtngnngngnncgngnnnnnnnnnnnnnnnnnnnn

SEQ ID NO: 92170 - DNA, 688 bp, Homo sapiens
  misc_feature: GYAE6OF02FKAVT.5.57.F02.1.454.CMB.1.raw
  modified_base (152)..(152): a, c, t, g, unknown or other
  misc_feature (152)..(152): n is a, c, g, or t
  modified_base (158)..(158): a, c, t, g, unknown or other
  misc_feature (158)..(158): n is a, c, g, or t
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (248)..(248): a, c, t, g, unknown or other
  misc_feature (248)..(248): n is a, c, g, or t
  modified_base (369)..(369): a, c, t, g, unknown or other
  misc_feature (369)..(369): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttggganatcgtnatgacgcagtctaccagccatcctgtctgtgtcctccagggganagngccaccctctcctggacacgggtccagtccagaactattggancaaacttgccttaggaccaaacgaaaacctggaccacgcctacccagtacctcctactactttactccgttctactcctaccgacggtaccactacgtatcgtacccaacctagtacttcngtacgtacacggtagggtccgtagggacttacggctttacgacgtccgtaccaccctatacgaacgacaacggtccgttacggtacgtcttaacggtaacgtaccgttcggttacttacgttttacgttactacgttactaaacggtacgttaggtttggtaccgtaggtacgtaccgttacccgggtaaccgtttccgggacctaacgggtacccaaccggtagttccggtagtaccgtacggtaaccgggacggtaaagtcccggtaggtacctacgggtaccctaccgtaccggttacttccgttaccgttacccg

SEQ ID NO: 92171 - DNA, 748 bp, Homo sapiens
  misc_feature: GYAE6OF02GEG3P.5.57.F02.1.454.CMB.1.raw
  modified_base (703)..(703): a, c, t, g, unknown or other
  misc_feature (703)..(703): n is a, c, g, or t
tcagatcagacacgcacgaccggtgctcgatttagctcgatatagttgggtttgggggaggaactgctcagttaggacccagacggaaccatggaagcccagcgcagcttctcttacctcctgctactctgctccagataccgtgggagtatcgtagatgacgcagtcctccgtagacctactctagtctgtcgtactccgagggacgagacgaccctacccgtacttccgtaggaccgtaacggggacctacgttaaccgaacgtaacgttacgttagggaacgtactaaaccgttagtacctacggtaaaccctaaaaagtaaaaccgcggtaccacggccttaacccgagtaaccctcctagtaactttacgtaccgttacacttacccgaacgacggtaccaactacgtaacggtaccaacccgtaacacgttacgttacgtaaggacccgtagaccggggtaaagtttccgaagggtaaccacgtaacttcggtaaccgtctaaccgtaacgtaacctacggagtaacacgggttaacccaagtccgtagtacgaaacgttacgtcgtaaagttacgtttttaacaagtacgaactaagtactttcggagtactgggtaactcccgtagaaccgttccaacgggaccgtactaaacggtgacgggtataccggtacgtaaacgtaggacgtttacggngtttaaccgacctgtaaacccgtagtttccggatacccgtttacg

SEQ ID NO: 92172 - DNA, 861 bp, Homo sapiens
  misc_feature: GYAE6OF02FMB66.5.57.F02.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtcaccagccatcctgtctgtgtcctccaggggganaggacgccaccctctcctggcgacgggaccagtcaaggaactagttggacactaacgttgaccgttacggtaacccaaaaccaaaaacccgttcgggaccctaacgcccctaccccgagtaccctccttactacttttaagtccgttactaccttaccgaacccggaacgggacctacttacgtacgttccgttaaccccgaaaacctacggtacttaccgaggttacggactaacggggtacgggtccgtagggacctaaggtaccttaccgtacgttcctaacctaacccgacttacacgggtaccgtaacggtacgtaaccggtaaggttccgtaaggtaaacgggttaccggtttacgggaacccgttttaaggttttttatttaaccgggtacccgtttaaaaccgaaccttttaagggttaccgggtttaggggttaaacccgttgggtttacccggggttaaccccgtaacccggggtttaccgggtacccgggttaacccccgggaggttaaaccccaaagtttacggggtaacggtacggttaacctcggggtaaacccgggtacggttaaacccggttagggtacccgtacggtcccggttaacccgtaaccgttacgttaacccggttttcgtccccgttttaaacg

SEQ ID NO: 92173 - DNA, 697 bp, Homo sapiens
  misc_feature: GYAE6OF02G3F7Q.5.57.F02.1.454.CMB.1.raw
  modified_base (96)..(96): a, c, t, g, unknown or other
  misc_feature (96)..(96): n is a, c, g, or t
  modified_base (155)..(155): a, c, t, g, unknown or other
  misc_feature (155)..(155): n is a, c, g, or t
  modified_base (205)..(205): a, c, t, g, unknown or other
  misc_feature (205)..(205): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (278)..(278): a, c, t, g, unknown or other
  misc_feature (278)..(278): n is a, c, g, or t
  modified_base (637)..(637): a, c, t, g, unknown or other
  misc_feature (637)..(637): n is a, c, g, or t
tcagatcagacacgcacgaccggtgctcgatttagctcgatatagttgggtttggggaggaactgctcagttaggacccagacggaaccatggaanccccagcgcagcttctcgttcctcctgctactctaggctcccagattaccgttgggganactcgtgactgacgcagtctccagccatcctgtctgtgtcctcgaggggnagacgccaccgtctctgccacggcagtcagaactnttgganctaacttgccttaggtaccaaactaaaaccgngtaccgacgtccctccgaacgtcctcctattaactttactccggtttccaactacccgtacacgggacctacgtaggacctcgttaaccccaactagtaacgttccgacggtcggactaagggtcgggttaccgagggtaaccaggttacctttacgacgttttaccgacacccgttagtacccgacggacaggtccgtaaacgcttacggtaacggaacgtttacgtgggtaactttacgtttaatcttacggaactaacggtaagttcgtaggactaggtaccgttaccgtacgtaccggttccgaaccggttaacggaccaacgtcgttacggattaccgtggaaccgggttaacncggtacggtcgttacccgtacggtaactaaccggtttcgaccgtttcgtacctttacccg

SEQ ID NO: 92174 - DNA, 839 bp, Homo sapiens
  misc_feature: GYAE6OF02GUJIR.5.57.F02.1.454.CMB.1.raw
tcagatcagacacgcacgaccggtgctcgatttagctcgatatagttgggtttgggggaggaactgctcagttaggaccagacggaacatggaacgcccagcgcagcttctcttcctcctgctactctcggctccagactaccggttggggagacgtcgtagatcggacgctagtcctccgacgcctactcctcgtccgtggttcgtccgtaccggaagggggacaacggaccggtccccgtacccttccttccgtcgacggaccggccttaggtaccaaaggtaactggtttagggacaacgttaacgttcgccgtaacgtaaaccaaactaaaaaccgtcggccaacgtcccgaccaacgtcctacctacttacgtttccgtacttaccgtaacctcccgaccggtaccggaccgtaaccgtcggtaccgtaccgtaccccgtaaacaaccggttaccgtaccgtacggtaacggtacgacggggttaccgggtacgggttaacgggaccgtaaaccgggttaccgttaccggtaaccggtttccgttaaacccggtaaccgtcgtaaacggcggtaactaaacccggtgggttaacccgtacgtacggtaaacgaaccgtttacgggttcggtacgttacgtttacggttaccgttaactaccgtaaacgtgttaccggttaggacgttaccgggttaccgtaccgtacggggtttaccctaccgggtaaccggtccggtaacggtaacccgtaggttaccggtacttacggcggtaaccggtcgtaacggttcgggacgtcgttacgactaccgtactcgttccgttactcccgg

SEQ ID NO: 92175 - DNA, 672 bp, Homo sapiens
  misc_feature: GYAE6OF02GZPXN.5.57.F02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (527)..(527): a, c, t, g, unknown or other
  misc_feature (527)..(527): n is a, c, g, or t
  modified_base (563)..(563): a, c, t, g, unknown or other
  misc_feature (563)..(563): n is a, c, g, or t
  modified_base (656)..(656): a, c, t, g, unknown or other
  misc_feature (656)..(656): n is a, c, g, or t
tcagatcagacacgcacgaccggtgctcgatttagctcgatatagttgggtttgggggaggaactgctcagttaggacccagacggaaccatggaagccccagcgcagcttctcttcctcctgctactctggctcccagataccgttgggganatcgtgatgacgcagtctcagccatcctgtctgtgtctccgagggganagacgccctaccctctctgcgacgggccagtaccagaactagttgggtacaccgtaaactttcggacccgttacgggtaaacccaaaaacctaaaaaacccgttcgggacccaaccggtccccttaccccaacggaacccttcccttaactaactttttacgtaccgttaccaactccccgtaaccgacggggaccctacgtcggactaccgttaccccaaacctaggtacttccgaaggtcgacgtaggtacgggtcttacgggaacacgtacgttcgacgttactaccacagtcagcgagtctagcgtatagaacgtcttacgnttagtttactactagtaactaacgagtgtggtacgngtaccgtcctacggactcgggtaccgaggacctagacgtcggtatacgtacggcgtacggtaccttgggtcgccgttagccgaattaccggtnttccggttataacccg

SEQ ID NO: 92176 - DNA, 898 bp, Homo sapiens
  misc_feature: GYAE6OF02I33S2.5.57.F02.1.454.CMB.1.raw
  modified_base (153)..(153): a, c, t, g, unknown or other
  misc_feature (153)..(153): n is a, c, g, or t
  modified_base (166)..(166): a, c, t, g, unknown or other
  misc_feature (166)..(166): n is a, c, g, or t
  modified_base (203)..(203): a, c, t, g, unknown or other
  misc_feature (203)..(203): n is a, c, g, or t
tcagatcagacacgcacgaccggtgctcgatttagctcgatatagttgggtttgggggaggaactgctcagttaggaccagacggaaccatggaagccccagcgcagcttctcttcctcctgctactcgtggctcccagataccggttggganatcgtgatgacgnagtctccagccatcctgtctgtcgtctccgagggganacgacgccaccttcgtcctgcgagggtcagtcgaagaacctagtttagggtacgactaaccgttacgccgttacgggttaaaccccaaaacgtaaaaacccgtcgggtaaccccaccggtaccccttaacccgaacggtaccccttcctaccgttattttaaccgttccgttacctaacgtcccgaccggaacgggtacctactggtaccttacgtaaccccaacgtaacggttacttaccgaacggtttcggaaccgtacgggtaccggttaccggtacgggtaacttaacggtaacgttacggtaacgtttacccgtaacccttaaccggtaacgtaccgtaaacggtacggtaccgtaaacggttaacgtaaccggttattaacccgggtaaagttaccgtttcgggtaaaccgttttaaccggtttttaagttacccgggttaaaccggttaacgtaaccgtttaacggttccgggtaccgggtttttagaaccccgggtttaggttaccccgttaccggggttaaaccgggtttacccgggaaccccgggtttaaacggaccgtttaacgtacgggtacgttaacgttccggttaacgtaacggggtacctttaccggaagggtttacccggaggttacccggaaccggtaaccctttccgtaaccgggtttccgtaagtttaaccccgg

SEQ ID NO: 92177 - DNA, 1090 bp, Homo sapiens
  misc_feature: GYAE6OF02HLWCZ.5.57.F02.1.454.CMB.1.raw
tcagatcagacacgcacgaccggtgctcgatttagctcgatatagttgggtttgggggaggaactgctcagttaggacccagacggaaccatggaagccccagcgcagcttctcttcctcctgctactctggctccagactaccggttgggagatcgtgatgacgcagtctccagccatcctgtctagtgtctccgaggggacgagacgcccaccctctccctggtccgacgggtacccgaggttaccaacggaacctaggtttagggtaacggtaccttaaaccggtttacggaccccgttacggggttaaacccaaaaaacccgtaaaaaaaccccggttcggaacccccgaaacgggtacccccttaacccccgaaaccggttaacccttacccccgttacctttaaacttttaaacgttcccggttttaacctacttacccccgaaccccggtaacgggggacccctacgttaaccggtacggtttaccggttacccccaaaaccgtcggtaaactttcccgaaacgggttccgggtaccgtaagggggttaacgggggttccccgggtaggggggttaaacccaccgggttaaccgtttaccggaaaccgtttaccctcccgtaaaacccgttacgttaaccccgagggaacccgaacgggtacccgggtttaaaccgaacggttttccgggtaaaggttaaaaccggtttaacgggtttacgggtaaaccgttttaacgtttttaaaccgggttttaccttaccgggtttaacccggtttaaaaactttaccgggttaacggggtttttaccgggtttccgttaaaacgggggttcccgggttttaacccccgggttacccgggttaaaacggggttttcccccgggggtaaccccggggttaaccgggtaacccgttaaacggggtaccgggttaacgggttaccggtttaaacccggtttaccggggaaaccggtcccggttaaaacccggtttgggggtacccgggttacccgggttaccggtaaacccggttcccgtaaacccggttttccccggtttttaatcccccggttttaaccgg

SEQ ID NO: 92178 - DNA, 718 bp, Homo sapiens
  misc_feature: GYAE6OF01C6YX9.10.11.A11.1.454.CMB.1.raw
tcagcatagtagtgcacgaccggtgctcgatttagctacgactgcaaaggggaaaggggggggtctcaggaggcagcgctctcgggacgtctccaccatggcctgggctctgctgctcctcaccctcctcactcaggacacagggtcctgggccctgtctgccctgactcagcctgcctccgtgtctgggtctccgtggacagtcggtccaccatctcctgcacgtcggacccagccactgagtggtggctatttataccttgtctccgtgtactacaacacgccagaacaaccgccccactactcgttgtattagtgaacgtcaagtaacgccggaccttcggtagggtttctagtcgtcttctctcgtccctacgaagtccgtagaccaaccgtaccgtccccttaccgtacgtaacctaacgttccgtccgtcgggtacctaccgtacggtacgtacggaacggacggacggtactaagtaacttaacgttacgtcgtactacgtaccttacgtaagttagttaggtaaggttcgttacgggttaccgttaccgttttacggtttacgggttaacgggttttaccgggaccgggggttaaccggtaccggtaaccgggttaccgttaccggttaacccggttaaccggtaaccggttaccgtaacccgggtaacccgacggttaccccgtccccgggttccccggttaaccccgg

SEQ ID NO: 92179 - DNA, 663 bp, Homo sapiens
  misc_feature: GYAE6OF01BKQBK.10.11.A11.1.454.CMB.1.raw
  modified_base (204)..(204): a, c, t, g, unknown or other
  misc_feature (204)..(204): n is a, c, g, or t
  modified_base (255)..(255): a, c, t, g, unknown or other
  misc_feature (255)..(255): n is a, c, g, or t
  modified_base (385)..(385): a, c, t, g, unknown or other
  misc_feature (385)..(385): n is a, c, g, or t
  modified_base (625)..(625): a, c, t, g, unknown or other
  misc_feature (625)..(625): n is a, c, g, or t
tcagcatagtagtgcacgaccggtgctcgatttagctacgactgcgaagggaaagggggggtctcaggaggcagcgctctcgggacgtctccaccatggcctgggctctgctattcctcaccctcctcactcgagggcacgagggtcctgggcccagtctcgccctgactcacgcctgactccgtgtctgggtctccgtggacngtcgatcactatcctcctgctacgtggccaccgagcagtgaacagtaggtntacttaataactgtcgtctcgtgacagccaccacgaagtaccaaaccgacccctaagtttccgtttgtttagacggtacgaaggtacgccgaccctaggacggtaccgtccgtagtaccgtccggtttcnccgtacgtccgtaaccgtaacgttccgtacggaacccaaacccgtccggttcccccttccgtaccgtacccgtttcgtcccggttcggacccttaccggacggtacgttagggaaggtacgttagggaacggttctaacgttacgttaacgtacgcgacgagtccgtatacttaccgacgacccggaccgtaaggttcgggttggcggacgacggtatacggtcgtccggtgtacggacncgtacgacgcccgtccgcccgagtacctcgtccctccg

SEQ ID NO: 92180 - DNA, 809 bp, Homo sapiens
  misc_feature: GYAE6OF01D85T5.10.11.A11.1.454.CMB.1.raw
tcagcatagtagtgcacgaccggtgctcgatttagctacgactgcgaagggaaaggggggggtctcaggaggcagcgctctcgggacgtctccaccatggcctgggctctgctattcctcaccctcctcactcagggcacagggtcctgggcccagtctgccctgactcagcctgactcgtgtctgggtctcctggacagtcgatcactatctcctgcactggccaccgagcagtgacagtaggtgtcttaataactagtcgtcctaccgttacggtaaccaaacaaccaccccgaacggcccgaccggacccccaagacctacgacttactacttttcgagtactcgtctagtacgtaacgttccggtcccgtttagggtacttttacgtaacgttccgtctttaccgtcgtaccgtacccttaccgtaacgttccgtacggtaaccctaaaccggtacccgggttcctttaccccggtacgtaccccgttaacgttccccgttacccggggtacccttacccgaccggtacgtacgggaaccggtacggacggttcccgtacgtttaacgtttacgttaccgtacgaccgtaacgttaccctacgtaaccgttacgttaaacccggacccggtaaggggttaccctaccggtttaccgtaccgggttacggttaacgtttacccgggttaccggggtacccggggtaaccggggttcccgttacggggttacccgttaacccggttaccccggtttaccctaacccggggttacccaaccccgggtaaccccgttaaaccccggggg

SEQ ID NO: 92181 - DNA, 779 bp, Homo sapiens
  misc_feature: GYAE6OF01CJIPR.10.11.A11.1.454.CMB.1.raw
  modified_base (145)..(145): a, c, t, g, unknown or other
  misc_feature (145)..(145): n is a, c, g, or t
  modified_base (251)..(251): a, c, t, g, unknown or other
  misc_feature (251)..(251): n is a, c, g, or t
tcagcatagtagtgcacgaccggtgctcgatttagctacgactgcgaaggggaaaggggggggtctcaggaggcagcgctcgtcgggacgtctccaccatggcctgggctctgctattcctcaccctcctcactcgagggcacgngggtcctcgggccctagtctgccctgactcagcctgacctcgtgtcgtcgggtcctaccgtggactacgtcgatccaacttctcctcctgctacgtcggcaaccgngcaggtcgaactagtagggtctacttaaataacgttgtcgttacctaccgtaaccggtaaaccaaaaccgaacccgacccggaaccgggacccctacccgggaccccctaaggtacctactaacgttcctaacttttcgtagtaacgttcgtacgacggttacgtaaccggttcccgggttacggtttacgggttaactttactaacggttcccggttccttaccgttacggtcccgttacccgttaccggtaaaggttccgtacgggaacctaaacccggtcggtttccctacccgtacgtactaccggttcccgacccgggtactccgacgtacggtagggaaccggacgtacgtccttaacgttacgtttaacgtccaggtacctactacctaacgtaacgttaccgaacccggtacggaccggtcttaaccgtccgttagaccgttaagtcgggtaccggagggtaacggtccgtacggtcgtacgtacccgtaccgaccggtacacccggtaacccgtccggg

SEQ ID NO: 92182 - DNA, 652 bp, Homo sapiens
  misc_feature: GYAE6OF01DNTPR.10.11.A11.1.454.CMB.1.raw
  modified_base (257)..(257): a, c, t, g, unknown or other
  misc_feature (257)..(257): n is a, c, g, or t
  modified_base (357)..(357): a, c, t, g, unknown or other
  misc_feature (357)..(357): n is a, c, g, or t
  modified_base (538)..(538): a, c, t, g, unknown or other
  misc_feature (538)..(538): n is a, c, g, or t
  modified_base (636)..(636): a, c, t, g, unknown or other
  misc_feature (636)..(636): n is a, c, g, or t
tcagcatagtagtgcacgaccggtgctcgatttagctacgactgcgaaggggaaagggggggggtctcaggaggcagcgctctcgggacgtctccaccatggcctgggctctgctattcctcaccctcctcactcgagggcacgacgggtcctgggcccagtctcgccctgactcagcctgactcgtgtctgggtctccgtggactagtcgatccactactctcctagcactcggcaccagcagtgactagtaggtntacttaataactagtcgtacctcgtacgtaaccaacaaccaccgtacggaccaccggaccccaagtacctactactacgtactttcgtagaagtcgtacnggtacgtaacgttccggtccgtttaggttactttacgtaacgtcgtcttctcgtctaccctacgtaacgtcgtacgacgaacgtaccggtcttacccgtgaaccctacgttccgtaccgggtacctaccgacggtacgtacggacggtacggacgttactactaagtttactacgtcgaancggtactatactacaccgaaccggacggctacttcgtacgtacgagtacggtaccggtgggacggtacgtcgtacgtaccgtaccgttacgacgtacncggtaacccggtaccg

SEQ ID NO: 92183 - DNA, 823 bp, Homo sapiens
  misc_feature: GYAE6OF01B3VBD.10.11.A11.1.454.CMB.1.raw
tcagcatagtagtgcacgaccggtgctcgatttagctacgactgcgaaggggaaaggggggggtctcaggaggcagcgctcgtcgggacgtctccaccatggcctgggctctgctattcctccaccctcctcactcgagggcacgaggtcctcgggccctagtctcgccctgactcgacgcctgtactccgtgtcgtcgggtcctccgtaggacacgtcgaactctaactactcctctgctacgcggacacctagctagtgaactagtacggtcgtacttaactaaccttagttccgttacgttaccgtaaccggtaacccaaaccgtaaacccgacccgaaccggaccccgacccggaacccccagtaacctctaactactttacttagtacggtaacttgtccgtaaggttacgtaccgttccggttaccggttttaggttaacgtttacttaacggtccttccgtttccgtacgtccgttaccgtacgttaacgtccgtacggaacctaacgtccgtaccgtcccgttacccgttaggaccgttaccgtccggcccggtacccctacggaccgtacggtacgggaacggttaccgggtaccgtaacttccggtttaaaattccgttaacctcgggtcctaaacgttccgtaaccgttaaacctaacccgggtaacccgaaccccgggtaacgggtccccttacggttacctacgggttaacgtacgttaccggggtaccgggaccggggtaaacgtcccgggtacggttacgacccccggttaaccgtccggtaacccgcggtaaccccggtaacccggg

SEQ ID NO: 92184 - DNA, 746 bp, Homo sapiens
  misc_feature: GYAE6OF01B23YN.10.11.A11.1.454.CMB.1.raw
  modified_base (206)..(206): a, c, t, g, unknown or other
  misc_feature (206)..(206): n is a, c, g, or t
  modified_base (223)..(223): a, c, t, g, unknown or other
  misc_feature (223)..(223): n is a, c, g, or t
tcagcatagtagtgcacgaccggtgctcgatttagctacgactgcgaaggggaaaggggggggtctcaggaggcagcgctctcgggacgtctccaccatggcctgggctctgctattcctcaccctcctcactcgagggcacgagggtcctcgggcccagtctcgccctgactcagcctgactcgtgtcgtgggtctccgtggacngtcgatcactatctccngcacgtgaccacagcagtgacagtaggtcgtacttaactaacttagtcgtaccttccgtacggtaaacccaaacaaccgacccgacggccaacccggaccccagacctcactcttagtttcagtactgtacgtagtacgtcgttaccggttccgtttaggtacttttacgtaacgttccgttctttccgtacgtcgtacctacggtaagtccgtacgacctaacccggtccgtacccttacccgtacgtacctaccggttccccggtaccggttccctaccgtacggtcgacggacgggaacgtacggtacctacttacgtttactacctcgacgtcgtactactaacgtaaccgtaacccggtaccggtacgggtacctaccggttcggttacgtacggttaaccgttacggggttacccgggacggggttaacgggtccccggacgggttacccgttacccgggttaacccgttacccgggtaacccggtacccggaacccgggtcccgttaaccccgggg

SEQ ID NO: 92185 - DNA, 857 bp, Homo sapiens
  misc_feature: GYAE6OF01CU3MR.10.11.A11.1.454.CMB.1.raw
  modified_base (132)..(132): a, c, t, g, unknown or other
  misc_feature (132)..(132): n is a, c, g, or t
tcagcatagtagtgcacgaccggtgctcgatttagctacgactgcgaagggaaaggggggggtctcaggaggcagcgctctcgggacgtctccaccatggcctgggctctgctattcctcaccctctcactnaggacacaggtcctgggccctgtctgccctgactcagcctgcctccgtgtctggtcctcgtggactaggtcgtcacctagtcctcctgcaacgtcggaacccagactactgtatggttacgggctaattaacttaaccttcgtaccttcgtaggttaactacaaccaacgacccaacgaaccgaaacctacccccactaaccgttccttaggtaacttttaagtacgtaagttaccgtaagtaacggcccggtacccgttcgtaacggggttttacctaacggtccgtccgtttacgtacgtccggtacccaccgttaaacgtcgttacggacgtaaacccgtaccggtaccctttaccccgtaggaaaccctaagttacccgtccggtacggtaccgttacccgacgggtaccgtacggtaacggtaacgtaacgggtaaccttaaaggtaaacgtttaacgttacgtacgtaccgtaacgtaccgttaactaacgtttaacgtaaggtaacggtagttcgggttaaccgggtaccttttacgggttttaacggttaaaccggggttttaccggggaaccgggggtaaccgggttaaaccggtaccggggtaccgtaacccgggtttaaaccccggttaccgttaaaccgggttaacccgacccggtaacccccgggtaacgggttcccgtaaccccggtaccccccggttcggttaacccccg

SEQ ID NO: 92186 - DNA, 777 bp, Homo sapiens
  misc_feature: GYAE6OF01BKHY4.10.11.A11.1.454.CMB.1.raw
  modified_base (294)..(294): a, c, t, g, unknown or other
  misc_feature (294)..(294): n is a, c, g, or t
  modified_base (634)..(634): a, c, t, g, unknown or other
  misc_feature (634)..(634): n is a, c, g, or t
tcagcatagtagtgcacgaccggtgctcgatttagctacgactgcgaaggggaaagggggggggtctcaggaggcagcgctctcgggacgtctccaccatggcctgggctctgctattcctcaccctcctcactcgacgggcacgagggtcctcgggcccagtcctcgccctgactcacgccgtgacctcgtgtcgtcggtcctccgtggacagtcgatcacttacgttcctcctgccacgtcggaccaaccgagctacggttgttacttttcgtacgtacttaacgtaacttnttcgttccttccgtacggtaccaacgcccaaccgaccgacgtaaccgaaaccctaccccttaaacgtttcgttttacggtttacggaaccggtacgaacggtaaccggcccggtaccgtacggtacggtaaccctccgttagtacccgtttcgttccgtccgttcccgtacttaaccggtagtttaccgtacggaaccctaacccggtccgtacccctccggttccgtaacccgttccgggttccgggtaccggtcccgtacggtaacgggtacgtacggggtaacggtacgtggaccgttagtaaccgtatacgtgacgtcgaggttacatacgttacnccggtaccgtaaccgtgggggttacgttgggaccgggtaaccggacggttacggtaccgttccgggtaccggtcgggacgtaccgccgggtaaccgcgttcccggacccctcggtccactttccgtcccggttcccgtccccg

SEQ ID NO: 92187 - DNA, 737 bp, Homo sapiens
  misc_feature: GYAE6OF01BS7O1.10.11.A11.1.454.CMB.1.raw
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
  modified_base (291)..(291): a, c, t, g, unknown or other
  misc_feature (291)..(291): n is a, c, g, or t
  modified_base (457)..(457): a, c, t, g, unknown or other
  misc_feature (457)..(457): n is a, c, g, or t
tcagcatagtagtgcacgaccggtgctcgatttagctacgactgcgaaggggaaaggggggggtctcaggaggcagcgctcgtcgggacgtctccaccatggcctggctctgctattcctcaccctcctcactcgagggcacgacgggtcctgggcccagtctcgccctgactcacgccctcccgtccgcggtccggtctccgtggacagtcacgtcaccnctctctgcacgtcgaaccgngacgtagtcgtactttgtcgtacttaatactattcgtactccgtagaccngaccaccaccgaggaccaaccgcccctaacgttcctttaggtttcggacgtgtacgtacgccggtacctacggaggtccctcgtgtacgttcgttcgacgtccgtcctaacgtacgttcgacgacaacccgccggtccctacggtcgaccgtcgtacgccggtacncggtacgtcgtaggagtacgtacgagtacgtagtaaccttacgtacggtacgtaacgtcgtacgacgttaacttacgtacccggaacccgtaacccgtaagggttacggggtttcgggtaccggggaacggggttaccggtacggttaacgggtccggttcccgggtcggtaccgggtaccgtaccgggacccggtaccgggtacccttccccgggtacccgttaccgttaccgtccgtttaccccgttacccgttcccctccccggtaccttaaccccg

SEQ ID NO: 92188 - DNA, 758 bp, Homo sapiens
  misc_feature: GYAE6OF02IN9H3.10.11.A11.1.454.CMB.1.raw
tcagcatagtagtgcacgaccggtgctcgatttagctacgactgcaaaggggaaaggggggggtctcaggaggcagcgctctcgggacgtctccaccatggcctgggctctgctattcctcaccctcctcactcagggcacagggtcctgggcccagtctcgccctgactcagcctgactccgtgtcgtgggtctcgtggacagtcgatcaactatctctgcactggccaccagcagtcgactagtaggtcgtcttaataacttaatgtccttccgttcggtaaccaaaccaaccaacccgacggacccgacggcccccaacgacctctactctactttcgtgatcgtctagtagtacgtccggtccgtttggtactttactaactcgtacttctctcgtcctactaacgtctacggacgaaccgtacggtaccttcccgtcgtaaccctaacgtcccgtacccgggtcccttacccgaccgtcgtacggaacggaaccgggtacggtacccgttaccttaagtttaacctttaaccgtcggtacgtacggtacctacctaacgttaaccgttaacccgaacccgggtaaccggggtacctaacccggttaccgttaccggttacgttaacgttacgggtttacccggggtaccggggtaacggggttacccggttaccggggtaacccgttaccggttaaccccggtttacccgttaacccgggtacccgtaacccggtacccggttaaccccgggg

SEQ ID NO: 92189 - DNA, 730 bp, Homo sapiens
  misc_feature: GYAE6OF02ID1FW.10.11.A11.1.454.CMB.1.raw
  modified_base (183)..(183): a, c, t, g, unknown or other
  misc_feature (183)..(183): n is a, c, g, or t
  modified_base (237)..(237): a, c, t, g, unknown or other
  misc_feature (237)..(237): n is a, c, g, or t
tcagcatagtagtgcacgaccggtgctcgatttagctacgactgcgaagggaagggggggtctcaggaggcagcgctctcgggacgtctccaccatggcctgggctctgcttattcctcaccctctcactcagggcacgagggtcctgggcccagtctgccctgactcagcctgacctccgtntcgtggtctccgtggactgtcgatcaactatctcgtgctacgtcggacaaccgngactagtcggaacagttagggagttaccttaaataacttgtcgttcctaccgtacggtaaccaaacgaacccacccgacggacccgaccggcccccgaagtacctctaactcttactttcgacgtattcgttacgtagttacgtacgttccggttacccggtttagggtacttttacctaagtccggttccttcgtcctacgtcctacgtacgtcgtacgactacggtccgttacctccgcgtaccacggttcccgtacccgggtcttacccgacggtcggttacggaacggtaccgtaccggtacttacggttattaccgtacggtcgacgtacgtacctacgtaaccttacgaaccccgtaccgggtaggtccctaccgttggttaccgtacgtttaccggtacggttcccgggacggttaccgggaccgttacggtccgttccggtaaccccgttaccgtaccggtacccggtacccgaccgtacccggg

SEQ ID NO: 92190 - DNA, 807 bp, Homo sapiens
  misc_feature: GYAE6OF02G7BKJ.10.11.A11.1.454.CMB.1.raw
  modified_base (222)..(222): a, c, t, g, unknown or other
  misc_feature (222)..(222): n is a, c, g, or t
tcagcatagtagtgcacgaccggtgctcgatttagctacgactgcgaagggaaaggggggggtctcaggaggcagcgctctcgggacgtctccaccatggcctgggctctgctattcctcaccctcctcactcagggcacagggtcctgggcccagtctgccctgactcagcctgacctccgtgtcgtgggtctcctggacctagtcgatcactatctcctncactggccaccagctagtgacagtaggtgtactttaagtaacttagtcgttcctccctaggtacccagtaccacccacccgaggaccaaacgaccccccctaaattccgtttagttttacggacggtacaaggtacgccgtacccgtacgacggtacgtacccgtgtacgttccggttcctcgtcgtaccctacgaacggtccgttacggaacctaacccgaccggttaccctcccgtacgtacccgttacgttccggtacgggtacccttccggacggtaccggtacgggaacggtaacgttaccgggaacggtaccgtaacggtttactttaacccgtaacgttacggaccgtacggtacccgtaacgttaacgtttaccggttacccgtaacccgggtaacccccggttaagggttaccggggtttcgggttacgggacccggggtacggtaaacgggtttacgggacccggttacccggttaccgggttacgggtacccgtaaccggtacccggtaacggtccccggttaccccggtcccccggttacggtacccttaccgttaccccggttaccccccgg

SEQ ID NO: 92191 - DNA, 724 bp, Homo sapiens
  misc_feature: GYAE6OF02HEJZI.10.11.A11.1.454.CMB.1.raw
  modified_base (224)..(224): a, c, t, g, unknown or other
  misc_feature (224)..(224): n is a, c, g, or t
  modified_base (256)..(256): a, c, t, g, unknown or other
  misc_feature (256)..(256): n is a, c, g, or t
tcagcatagtagtgcacgaccggtgctcgatttagctacgactgcgaagggaaagggggggtcgtcgaggaggcgagcgctctcgggacgtctccgaccatggcctgggctctgctattcctcaccctcctcactcagggcacagggtcctgggcccagtctcgcccgtagctcacgccgtgacctccgttggtctgggtctccgtggacacgtcgatcgactntctcctgcacgtggacaccagtcagtgaaccngtacggtgtacttactaactatacgtacttcctacggttaccaaacgtaaccaccgacgaccgaccgccccaataccgtacactactacttacctagtctgtactagtcgtacggtaccgttccggtttaggtattttaccgtaacgttccgttctttaccgtcgtacctccgtacctaacggttctacgggaaccctaccgtaccgttcctttcccgacgaaccgttaccgtcccggtccggtaccgttacctaccgggtacgtacggtaaccgggacgacgttacgtaccttaagttacttacgtctacgtaccgttctacgaacttacgaacccgtaccggtacggtaccacgttacgtacgtacgttacgtaccggttcgggtaaccgggtacggtaacccggtggtaccggttaccgtacccggtttaccgtacgttacccggtaccgaaccccggtaacggg

SEQ ID NO: 92192 - DNA, 155 bp, Homo sapiens
  misc_feature: GYAE6OF01B1WUD.2.28.C06.1.454.CMB.1.raw
  modified_base (155)..(155): a, c, t, g, unknown or other
  misc_feature (155)..(155): n is a, c, g, or t
tcagacgctcgacacacgaccggtgctcgatttagagctcacgtattgggtttgggggaagaggaagactgacggtcctgccacagcggccctgggctgcctggtcaaggactacttcctgtcgagcgtctgagcgggctggcaaggcgcatagn

SEQ ID NO: 92193 - DNA, 155 bp, Homo sapiens; identical to SEQ ID NO: 92192
  misc_feature: GYAE6OF01E3LBF.2.28.C06.1.454.CMB.1.raw
  modified_base (155)..(155): a, c, t, g, unknown or other
  misc_feature (155)..(155): n is a, c, g, or t

SEQ ID NO: 92194 - DNA, 155 bp, Homo sapiens; identical to SEQ ID NO: 92192
  misc_feature: GYAE6OF02IRHRF.2.28.C06.1.454.CMB.1.raw
  modified_base (155)..(155): a, c, t, g, unknown or other
  misc_feature (155)..(155): n is a, c, g, or t

SEQ ID NO: 92195 - DNA, 495 bp, Homo sapiens
  misc_feature: GYAE6OF01DDPYC.18.73.G07.1.454.CMB.1.raw
  modified_base (250)..(250): a, c, t, g, unknown or other
  misc_feature (250)..(250): n is a, c, g, or t
  modified_base (484)..(495): a, c, t, g, unknown or other
  misc_feature (484)..(495): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaattgtcatctatggtaacaataatcggccctcaggggtccctgcccgattcnctggctccaagtctggcacctcagcctcctggccatcactgggctccaggctgatgatgaggctgattatactgccagtcctatgacactaatctcagtggtcgtgggggtcttcgggcggagggaccgaggcgtggaccgtcggtgggtcagcccaaggctcgcccctcggtccactctcgttcccgccctcctccactactcgtactcgacgcgggctggcaggcgcagtgnnnnnnnnnnnn

SEQ ID NO: 92196 - DNA, 502 bp, Homo sapiens
  misc_feature: GYAE6OF01EFEQT.18.73.G07.1.454.CMB.1.raw
  modified_base (484)..(484): a, c, t, g, unknown or other
  misc_feature (484)..(484): n is a, c, g, or t
  modified_base (493)..(493): a, c, t, g, unknown or other
  misc_feature (493)..(493): n is a, c, g, or t
  modified_base (497)..(502): a, c, t, g, unknown or other
  misc_feature (497)..(502): n is a, c, g, or t
tcagtacgagtatgcacgaccggtgctcgatttagctctacgctcagggtcctgggcccagtctgggctgacgcagccgccctcactgtctggggcccccagggcaggagggtcagcatcaactgcactgggaccagttccaacatcggggcaaattatgatgtacactggtaccagcaacttccaggaacacgcccccaaacttgtcatctatggtaacaataatcggccctcgacggggtccctcgcccgattctctggctccaagtctggcacctcagcctccctggccatcactgggctccgaggctgatgatgaggctgtattattactgccagtcctatgacactaatctcagtggtcgtggggtctcgggcggagggaccaggctggaccggtcggtgggtcacgcccgaaggcctccgccccctggtccactccttcgttccccaccctcctcctactcctcgtactgacgcggcnggcgaggcnatgnnnnnn

SEQ ID NO: 92197 - DNA, 491 bp, Homo sapiens
  misc_feature: GYAE6OF01BQNFO.18.73.G07.1.454.CMB.1.raw
  modified_base (237)..(237): a, c, t, g, unknown or other
  misc_feature (237)..(237): n is a, c, g, or t
  modified_base (330)..(330): a, c, t, g, unknown or other
  misc_feature (330)..(330): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (481)..(488): a, c, t, g, unknown or other
  misc_feature (481)..(488): n is a, c, g, or t
  modified_base (490)..(491): a, c, t, g, unknown or other
  misc_feature (490)..(491): n is a, c, g, or t
tcagtacgagtatgcacgaccggtgctcgatttagctctacgctcagggtcctgggcccagtctgggctgacgcagccgcccgtcactgtcctgggccccagggcacgagggtcagcattcaactgcactgggaccagttccaacatcggggcaaattatgatgtacacttggtacctagcaacttccaggaactagcccccaaattgtcatcgtatggtaacaataatcggccctnaggggtccctgcccgattctctggctccaagtctggcacctcagcctcctggccatcactggctccaggctgatgatgaggctgacttatacngccagtcctatgacactaatctcagtgtctggggtcttcggcggaggacaggctgaccgtcgtggtcagccaagctcgcccctcggtcactctcgtcccacctcctccatcctcgtactgacgcggctcggctacggtcgcagtagnancnnnnnnnngnn

SEQ ID NO: 92198 - DNA, 231 bp, Homo sapiens
  misc_feature: GYAE6OF01EWPN8.18.73.G07.1.454.CMB.1.raw
  modified_base (230)..(231): a, c, t, g, unknown or other
  misc_feature (230)..(231): n is a, c, g, or t
tcagtacgagtatgcacgaccggtgctcgatttagctctacgctcagggtcctgggcccagtctgggctgacgcagccgccctcactgtctggggccccagggcagagggtcagcatctcttgttctggaagcagctccaacatcggaagtcagcccaaggctgccccctcggtcactctgttcccgcctcctccatactcgtactgagcgggctggcaaggcgcatagnn

SEQ ID NO: 92199 - DNA, 501 bp, Homo sapiens
  misc_feature: GYAE6OF01DNMS5.18.73.G07.1.454.CMB.1.raw
  modified_base (486)..(486): a, c, t, g, unknown or other
  misc_feature (486)..(486): n is a, c, g, or t
  modified_base (492)..(501): a, c, t, g, unknown or other
  misc_feature (492)..(501): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctcaagtctggcacctcagcctcctggccatcactgggctccaggctgatgatgaggctgattatactgccagtcctatgacactaatctcagtggtctgggggtcttcgggcggagggaccgaggctggaccgtcggtgggtcaagcccgaaggcctcgcccccgtcggtccacttcctcgttcccacccttcctcctactcctccgtactgacgcggctggcaggccgngatcgnnnnnnnnnn

SEQ ID NO: 92200 - DNA, 505 bp, Homo sapiens
  misc_feature: GYAE6OF01B3F3E.18.73.G07.1.454.CMB.1.raw
  modified_base (216)..(216): a, c, t, g, unknown or other
  misc_feature (216)..(216): n is a, c, g, or t
  modified_base (441)..(441): a, c, t, g, unknown or other
  misc_feature (441)..(441): n is a, c, g, or t
  modified_base (494)..(495): a, c, t, g, unknown or other
  misc_feature (494)..(495): n is a, c, g, or t
  modified_base (498)..(505): a, c, t, g, unknown or other
  misc_feature (498)..(505): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcagcttccagggacagcccccaaactcctcatctttggtancaacaatcggccctcaggggtccctgaccgattctctggctccaagtctggcacctcagcctccctggccatcactgggcctccgaggctgaggatgaggctgactattactgccagtcctatgacatgaggctgagtggttcgtatcgtcttcggatctgggaccaaggtcaccgtctaagtcagcccgaacgcctaacccctctcgtcacttctcgttccccncccttcctccatacctcgtactgacgcgggtctcggccaaggtccgcataggnngcnnnnnnnn

SEQ ID NO: 92201 - DNA, 488 bp, Homo sapiens
  misc_feature: GYAE6OF01D3Y7N.18.73.G07.1.454.CMB.1.raw
  modified_base (404)..(404): a, c, t, g, unknown or other
  misc_feature (404)..(404): n is a, c, g, or t
  modified_base (429)..(429): a, c, t, g, unknown or other
  misc_feature (429)..(429): n is a, c, g, or t
  modified_base (470)..(471): a, c, t, g, unknown or other
  misc_feature (470)..(471): n is a, c, g, or t
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
  modified_base (480)..(480): a, c, t, g, unknown or other
  misc_feature (480)..(480): n is a, c, g, or t
  modified_base (482)..(483): a, c, t, g, unknown or other
  misc_feature (482)..(483): n is a, c, g, or t
  modified_base (485)..(487): a, c, t, g, unknown or other
  misc_feature (485)..(487): n is a, c, g, or t
tcagtacgagtatgcacgaccggtgctcgatttagctctacgctcaggggtccgtgggcccagtctgggctgacgcagccgccctcactgtctggggccccagggcagagggtcaccatctcctgcactgggagcacctccaacatcggggcgggttatgatgtacactggtaccagcagcttccagggacagccccaaatcctcatctttggtagcaacaatcggccctcaggggtccctgaccgtattctctggctccaagtctggcacctcacgcctcctggccatcactgggctccgaggctggaggcgaggctagatttatactgcagctcatatacagcagcagcactcaagtcttggaactggaccaggtcacgtctagtcagccaaggccaacccntgtcactctcgtcccacctcctacnctactcgtactgacgcggctggacaggcgcgagtacggctnncgnagcncncnncnnnc

SEQ ID NO: 92202 - DNA, 479 bp, Homo sapiens
  misc_feature: GYAE6OF01BVTI6.18.73.G07.1.454.CMB.1.raw
  modified_base (472)..(479): a, c, t, g, unknown or other
  misc_feature (472)..(479): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggagcacctccaacatcggggcgggttatgatgtacactggtaccagcagcttccagggacagcccccaaaactcctcatctttggtagcaacaatcggccctcaggggtccctgaccgattctctggctccaagtctggcacctcagcctcctgccatcactgggctccaggctgagatgagctgactatactgccagtcctatgacatgaggctggagttggtcgtatgtcttcggatcgtggaaccaggtcacgtctaagcagcccaagccaaccctctgtcactctcgttcccgccctcctccatacctcgtactgacgcgggtctggcaaggcgcatgnnnnnnnn

SEQ ID NO: 92203 - DNA, 489 bp, Homo sapiens
  misc_feature: GYAE6OF01EL4OY.18.73.G07.1.454.CMB.1.raw
  modified_base (435)..(435): a, c, t, g, unknown or other
  misc_feature (435)..(435): n is a, c, g, or t
  modified_base (475)..(475): a, c, t, g, unknown or other
  misc_feature (475)..(475): n is a, c, g, or t
  modified_base (481)..(489): a, c, t, g, unknown or other
  misc_feature (481)..(489): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagccccaaacttgtcatctatggtaacaataatcggccctcaggggtccctgcccgattctctggctccaagtctggcacctcagcctccctggccatcactggctccaggctgatgatgaggctgattatactgccagtcctatgacactaatctcagtggtcgtggggtcttcggcggagggaccaggctcggaccgtcgtgggtcagcccgaaggcctcgccccgtcgtcactctcgttcccnccctcctccactcctcgtactgacgtcggctggcgagcgnagtagnnnnnnnnn

SEQ ID NO: 92204 - DNA, 490 bp, Homo sapiens
  misc_feature: GYAE6OF01DD0C5.18.73.G07.1.454.CMB.1.raw
  modified_base (482)..(490): a, c, t, g, unknown or other
  misc_feature (482)..(490): n is a, c, g, or t
tcagtacgagtatgcacgaccggtgctcgatttagctctacgctcagggtcctgggcccagtctgggctgacgcagccgccctcactgtctgggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgccccgattctctggctccaagtctggcacctcagcctccctggccatcactgggctccaggctgatgatgaggctgattattactgccagtcctatgacactaatctcagtggtctgggggtcttcgggcggagggccaggctgaccgtgtgggtcagcccgaaggcctcgccccctcggtcactctcgtcccaccctcctccactactcgtactgacgcggctggcaaggcgcagtacgnnnnnnnnn

SEQ ID NO: 92205 - DNA, 495 bp, Homo sapiens
  misc_feature: GYAE6OF01D1494.18.73.G07.1.454.CMB.1.raw
  modified_base (484)..(495): a, c, t, g, unknown or other
  misc_feature (484)..(495): n is a, c, g, or t
tcagtacgagtatgcacgaccggtgctcgatttagctctacgctcagggtcctgggcccagtctgggctgacgcagccgccctcactgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctcctggccatcactgggctccaggctgaggatgaggctgacttattactgccagtcctatgacatgaggctgagtggttctatgtcttcggattcgtggaccaaggtcaccgtctaagtcacgcccaaggcccaaccctctcgtcactctcgttccccgccctcctccactacctcgtactgacgcgggctggcaaggcacgatagnnnnnnnnnnnn

SEQ ID NO: 92206 - DNA, 476 bp, Homo sapiens
  misc_feature: GYAE6OF01EKTMJ.18.73.G07.1.454.CMB.1.raw
  modified_base (420)..(420): a, c, t, g, unknown or other
  misc_feature (420)..(420): n is a, c, g, or t
  modified_base (465)..(468): a, c, t, g, unknown or other
  misc_feature (465)..(468): n is a, c, g, or t
  modified_base (470)..(476): a, c, t, g, unknown or other
  misc_feature (470)..(476): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaattgtcatctatggtaacaataatcggccctcaggggtccctgcccgattctctggctccaagtctggcacctcagcctcctggccatcactgggctccaggctgatgatgaggctgattattactgcagctcatatacagcagcagcactcaagtcttacggactgggaccaggtcaccgtctagtcagccagacccacccactcgtcactctcgttcccncctcctccactcctcgtactgacgcggctggcaggcgccgatagnnnncnnnnnnn

SEQ ID NO: 92207 - DNA, 588 bp, Homo sapiens
  misc_feature: GYAE6OF01BK61M.18.73.G07.1.454.CMB.1.raw
  modified_base (330)..(330): a, c, t, g, unknown or other
  misc_feature (330)..(330): n is a, c, g, or t
  modified_base (579)..(579): a, c, t, g, unknown or other
  misc_feature (579)..(579): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
  modified_base (586)..(586): a, c, t, g, unknown or other
  misc_feature (586)..(586): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagccccaaacttgtcatctatggtaacaataatcggccctcgaggggtccctgcccgattctctggctccaagtctggcacctcagcctcctgccatcactgggcctccgagctgatgatgagctgattatactgcagctnatatacagcaccagcctactctactatcgtacgttcggaacgtcgggaaccaaggtcctaccgtccgtaggtaccacggaccccaacggccccaaccccgtacgttccgtacctaccgttcccgtaccgtttacccccgccccttacccgtaccctacgttaacccgttcccgttaaccgtcggaccgggtcccgggtaccgtacgggtaccgaaccggggccgtacgtaacgtacggtctacgatcgncancngngc

SEQ ID NO: 92208 - DNA, 507 bp, Homo sapiens
  misc_feature: GYAE6OF01B38CI.18.73.G07.1.454.CMB.1.raw
  modified_base (375)..(375): a, c, t, g, unknown or other
  misc_feature (375)..(375): n is a, c, g, or t
  modified_base (496)..(496): a, c, t, g, unknown or other
  misc_feature (496)..(496): n is a, c, g, or t
  modified_base (499)..(507): a, c, t, g, unknown or other
  misc_feature (499)..(507): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcagcttccagggacagcccccaaactcctcatctttggtagcaacaatcggcctcaggggtccctgaccgattctctggctccaagtctggcacctcacgcctcctggccatcactgggctccgaggctgaggatgaggctgacttattactgcctagtcctatgacatgaggctggagtgttcgtatgtcttggatcgnggacaggtcaccgtctaagtcacgccaagcccaaccctctcgtctcctctccgttccccaccctcctccctattaccgtccgtactggacgccggtctggcctaagggccgactagtacgnacnnnnnnnnn

SEQ ID NO: 92209 - DNA, 472 bp, Homo sapiens
  misc_feature: GYAE6OF01CB9PP.18.73.G07.1.454.CMB.1.raw
  modified_base (407)..(407): a, c, t, g, unknown or other
  misc_feature (407)..(407): n is a, c, g, or t
  modified_base (442)..(442): a, c, t, g, unknown or other
  misc_feature (442)..(442): n is a, c, g, or t
  modified_base (464)..(472): a, c, t, g, unknown or other
  misc_feature (464)..(472): n is a, c, g, or t
tcagtacgagtatgcacgaccggtgctcgatttagctctacgctcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacacgcccccaaactcctcatctttggtagcaacaatcggccctcgaggggtccctgaccgattctctggctccaagtctggcacctcagcctcctgccatcactggctccaggctgaggatgagctgactatactgccagtcctatgacagtgagctgagtggttctatgtctcggatcgtggacctagtcacgtctaagcacgccaacgcccaaccctntcgtcactctcctccaccctctccatactcgtacngacgcggctggcaggcgcatgnnnnnnnnn

SEQ ID NO: 92210 - DNA, 525 bp, Homo sapiens
  misc_feature: GYAE6OF01CYDL4.18.73.G07.1.454.CMB.1.raw
  modified_base (505)..(505): a, c, t, g, unknown or other
  misc_feature (505)..(505): n is a, c, g, or t
  modified_base (513)..(515): a, c, t, g, unknown or other
  misc_feature (513)..(515): n is a, c, g, or t
  modified_base (517)..(525): a, c, t, g, unknown or other
  misc_feature (517)..(525): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctccaagtctggcacctcagcctcctggccatcactgggctccaggctgatgatgaggctgattatactgcctagtcctatgacactaatctcagtggtcgtggggtcttcgggcggagggaccgaggctcggaccgtcggtcgggtcacggcccaagggcctccgcccccgtcggtccaccgtccttccgttcccctacccctcctccctacttacctcgtactcgcggcgggtctcggtacgacggcncagtacgnnncnnnnnnnnn

SEQ ID NO: 92211 - DNA, 505 bp, Homo sapiens
  misc_feature: GYAE6OF01A4DPL.18.73.G07.1.454.CMB.1.raw
  modified_base (470)..(470): a, c, t, g, unknown or other
  misc_feature (470)..(470): n is a, c, g, or t
  modified_base (490)..(490): a, c, t, g, unknown or other
  misc_feature (490)..(490): n is a, c, g, or t
  modified_base (495)..(505): a, c, t, g, unknown or other
  misc_feature (495)..(505): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctccaagtctggcacctcagccctcctggccatcactgggctccaggctgatgatgaggctgattattactgccagtcctatgacactaatctcagtggtcgtgggggtcttcgggcggagggaccgaggctggaccgtcggtgggtccaggcccaacggcccaaccccacgtcgtccactcctcgttccccgccctcctccactacctcgtacngtacgcggctggcaggccgnagtgnnnnnnnnnnn

SEQ ID NO: 92212 - DNA, 485 bp, Homo sapiens
  misc_feature: GYAE6OF01E26G5.18.73.G07.1.454.CMB.1.raw
  modified_base (326)..(326): a, c, t, g, unknown or other
  misc_feature (326)..(326): n is a, c, g, or t
  modified_base (341)..(341): a, c, t, g, unknown or other
  misc_feature (341)..(341): n is a, c, g, or t
  modified_base (412)..(412): a, c, t, g, unknown or other
  misc_feature (412)..(412): n is a, c, g, or t
  modified_base (430)..(430): a, c, t, g, unknown or other
  misc_feature (430)..(430): n is a, c, g, or t
  modified_base (450)..(450): a, c, t, g, unknown or other
  misc_feature (450)..(450): n is a, c, g, or t
  modified_base (472)..(472): a, c, t, g, unknown or other
  misc_feature (472)..(472): n is a, c, g, or t
  modified_base (474)..(477): a, c, t, g, unknown or other
  misc_feature (474)..(477): n is a, c, g, or t
  modified_base (479)..(485): a, c, t, g, unknown or other
  misc_feature (479)..(485): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcagcttccagggacagcccccaaactcctcatctttggtagcaacaatcggccctcaggggtcccctgaccgattctctggctccaagtctggcacctcagcctccctggccatcactgggctccaggctgaggatgagctgactattacngccagtcctatgacntgagctgagtgtctatgtcttgatcgtgggaccaaggtcaccgtctaagtcagcccaaggcccaacccctntcgtcactctcgtccccnccctcctccatcctcgtacngacgcggctggcaaggcgctangnnnntnnnnnnn

SEQ ID NO: 92213 - DNA, 542 bp, Homo sapiens
  misc_feature: GYAE6OF01CJXL6.18.73.G07.1.454.CMB.1.raw
  modified_base (438)..(438): a, c, t, g, unknown or other
  misc_feature (438)..(438): n is a, c, g, or t
  modified_base (529)..(529): a, c, t, g, unknown or other
  misc_feature (529)..(529): n is a, c, g, or t
  modified_base (533)..(542): a, c, t, g, unknown or other
  misc_feature (533)..(542): n is a, c, g, or t
tcagtacgagtatgcacgaccggtgctcgatttagctctacgctcagggtcctgggcccagtctgggctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcagtaatcggcctcgtagggttttcaatcgtcttctctggctccaagtctggacaacacggccctcctgaccatctcgtcggctccgaggctaggacggacgaggctgattattactgcagctcaatatacaagcagcagcactacaagttccttacggaacgtcgggaaccaacggtccaccgtccgtaggtaccacggaccccaaggccccaaaccccgtntacgtcctaacttccgttccgtcccccgcccttcctacctacttacccgtcgtactcggacggccgggctagggccaaacgggcacgtaangcannnnnnnnnn

SEQ ID NO: 92214 - DNA, 612 bp, Homo sapiens
  misc_feature: GYAE6OF01D4Y4M.18.73.G07.1.454.CMB.1.raw
  modified_base (320)..(320): a, c, t, g, unknown or other
  misc_feature (320)..(320): n is a, c, g, or t
  modified_base (592)..(592): a, c, t, g, unknown or other
  misc_feature (592)..(592): n is a, c, g, or t
  modified_base (596)..(596): a, c, t, g, unknown or other
  misc_feature (596)..(596): n is a, c, g, or t
  modified_base (607)..(608): a, c, t, g, unknown or other
  misc_feature (607)..(608): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
tcagtacgagtatgcacgaccggtgctcgatttagctctacgctcagggtccgtgggcccagtctgggctgacgcagccgccctcactgtctgggccccagggcagagggtcagcatcaactgcactgggaccagttccaacatcggggcaaattatgatgtacactggtaccagcaacttccaggacacgcccccaaattgtcatctatggtaacaataatcggccctcaggggtccctgcccgtattctctggtctccaagtctgacacctcacgcctccctgccatcactggctccaggctgatgatgagctgattnttacgtgcctagtcctatgactacgtaatctcgtagttcggtcgttggggtccttcgggacggtaacgggaccgaggcgtcggtaccgtcggtacgggtcgacgtcccgaaaggtcccttccgtacccccgttcggttcctaacccgttccttcccggtttacccccctaccccgttcccttacccgtaaccttaccgttaccgttaaccgtcggtaaccggccgggtaccgttcggggaaccgtaacgggccgtaccgtaacgtaacggtncgtncgtatcgtcanntngn

SEQ ID NO: 92215 - DNA, 542 bp, Homo sapiens
  misc_feature: GYAE6OF01B1C3Y.18.73.G07.1.454.CMB.1.raw
  modified_base (354)..(354): a, c, t, g, unknown or other
  misc_feature (354)..(354): n is a, c, g, or t
  modified_base (520)..(520): a, c, t, g, unknown or other
  misc_feature (520)..(520): n is a, c, g, or t
  modified_base (529)..(530): a, c, t, g, unknown or other
  misc_feature (529)..(530): n is a, c, g, or t
  modified_base (533)..(542): a, c, t, g, unknown or other
  misc_feature (533)..(542): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacacgcccccaaaacttgtcatctatggtaacaataatcggccctcaggggtccctgcccgattctctggctccaagtctggcacctcacgccctcctggccatccactcgggctccgaggctgatgatgagctgattatactgccagtcctatcgacactaatctntagtggtcgtggggtcttcgggcggagggaccgaggccgtggtaccgtcggtcgggtcacgcccgaaggtcctcgcccccgtcggtcctacgtcccttcgttccccaccccttccctacctacttacccgtcgtactggacgcgggtcgtcggaccgaagggccgngtacgtagnngcnnnnnnnnnn

SEQ ID NO: 92216 - DNA, 497 bp, Homo sapiens
  misc_feature: GYAE6OF01D4DEO.18.73.G07.1.454.CMB.1.raw
  modified_base (307)..(307): a, c, t, g, unknown or other
  misc_feature (307)..(307): n is a, c, g, or t
  modified_base (486)..(487): a, c, t, g, unknown or other
  misc_feature (486)..(487): n is a, c, g, or t
  modified_base (489)..(497): a, c, t, g, unknown or other
  misc_feature (489)..(497): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagccccaaacttgtcatctatggtaacaataatcggccctcaggggtccctgcccgattctctggctccaagtctggcacctcacgcctccctggccatcacttgggctccaggctgntgatgaggctgattattactgccagtcctatcgacactaatctcgagtggtcgtggggtcttcgggcggagggccgaggctcgacgtcggtggtcacggccaaggcctcgcccctcgtcacctctcgtcccgccctctccactactcgtctgacgtcggctggcgaggcagtacgtagnngnnnnnnnnn

SEQ ID NO: 92217 - DNA, 663 bp, Homo sapiens
  misc_feature: GYAE6OF01AEY9I.18.73.G07.1.454.CMB.1.raw
  modified_base (643)..(644): a, c, t, g, unknown or other
  misc_feature (643)..(644): n is a, c, g, or t
  modified_base (649)..(649): a, c, t, g, unknown or other
  misc_feature (649)..(649): n is a, c, g, or t
  modified_base (656)..(656): a, c, t, g, unknown or other
  misc_feature (656)..(656): n is a, c, g, or t
  modified_base (659)..(659): a, c, t, g, unknown or other
  misc_feature (659)..(659): n is a, c, g, or t
tcagtacgagtatgcacgaccggtgctcgatttagctctacgctcagggtcctgggcccaggtctgggctgacgcagccgccctcactgtcgtggggccccagggcagagggtcagcatcaactgcactgggaccagttccaacagtcggggactaaattatgatcgtacactggtaccagcaacttcgaggaaccacgcccctaaattgtacatctagtagtaaacaataacgtccggcctcgacgggtccctggaccgtattctcgtcggccttaccgaagttctggaccacctcacgtccctccgtggaccatccgacgtcgggcctaccgagggtcttacggaggtgtaggtacgggtcctagaacgttacgttacgtcgacctacgtcctaatcggactacgtggacggtcgttggtaggtttcggttacggtacgttcggttccgttacggtacgttccggtacgggtaactaccggttaccgtaaccggttactaaacgtccgaacgtaccccggtaaacgccccgtaacccttcgtctacctaccgttcctaccgttccccctaccgttccctaccgtacttaccgttcgtacgtcggtacggcggtacgtacggacgtacggcgtacgacgtgnngctangtcacgnccntcgc

SEQ ID NO: 92218 - DNA, 540 bp, Homo sapiens
  misc_feature: GYAE6OF01CZPNE.18.73.G07.1.454.CMB.1.raw
  modified_base (252)..(252): a, c, t, g, unknown or other
  misc_feature (252)..(252): n is a, c, g, or t
  modified_base (525)..(525): a, c, t, g, unknown or other
  misc_feature (525)..(525): n is a, c, g, or t
  modified_base (530)..(532): a, c, t, g, unknown or other
  misc_feature (530)..(532): n is a, c, g, or t
  modified_base (534)..(536): a, c, t, g, unknown or other
  misc_feature (534)..(536): n is a, c, g, or t
  modified_base (538)..(540): a, c, t, g, unknown or other
  misc_feature (538)..(540): n is a, c, g, or t
tcagtacgagtatgcacgaccggtgctcgatttagctctacgctcagggtcctgggcccagtctgggctgacgcagccgccctcactgtctggggcccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattcnctggctcaagtctggcacctcacgtcctccctggccatcactggctccaggctgatgatgagctgattattacgtgccagtcctatcgacactaatctcagttggtcgttgggggtctttcgggcggtagggaccgaggctcggtaccggtcggtcgggtcaggcccaaggcctcgccccgtcggtccacgttccgtcgttcccctaccctcctaccctacttaccgtcgtaccgtggacgtcgggtctcggcgaacggtccgacgagtacgntagcnnntnnncnnn

SEQ ID NO: 92219 - DNA, 656 bp, Homo sapiens
  misc_feature: GYAE6OF01EOZW9.18.73.G07.1.454.CMB.1.raw
  modified_base (645)..(647): a, c, t, g, unknown or other
  misc_feature (645)..(647): n is a, c, g, or t
  modified_base (649)..(652): a, c, t, g, unknown or other
  misc_feature (649)..(652): n is a, c, g, or t
  modified_base (654)..(656): a, c, t, g, unknown or other
  misc_feature (654)..(656): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacacgccccaaacttgtcatctatggtaacaataatcggccctcgagggtccctgccgattctctggctccagtctggcacctcacgcctccctggccatcacgtcgggctccgaggctgatgatggaggtctgtattattactcgcctagtcctagtcgactagtggaggtcgtaggtacggtttgggtttacgttaagttcggtttcgtttacgggtattccggttacggggaaccctaaacggggttccctaacccggttacccttaaacggtccgaaccggaacccccgtaaacgggaccccctaaacccccgttcgttaccgttaccctaacccgtttcccgtttcccgttaccccccgtccccttacccttacctaactttacccgtacccggttaacgttcgggacggtccgggtaccgtgggaccgaaacgggcgtaccgtaagtaggcnnncnnnncnnn

SEQ ID NO: 92220 - DNA, 711 bp, Homo sapiens
  misc_feature: GYAE6OF01DPFA9.18.73.G07.1.454.CMB.1.raw
  modified_base (699)..(699): a, c, t, g, unknown or other
  misc_feature (699)..(699): n is a, c, g, or t
  modified_base (704)..(704): a, c, t, g, unknown or other
  misc_feature (704)..(704): n is a, c, g, or t
  modified_base (706)..(708): a, c, t, g, unknown or other
  misc_feature (706)..(708): n is a, c, g, or t
  modified_base (710)..(711): a, c, t, g, unknown or other
  misc_feature (710)..(711): n is a, c, g, or t
tcagtacgagtatgcacgaccggtgctcgatttagctctacgctcagggtcctgggcccagtctgtgctgacgcagccgccctcagtgtctgggccccagggcagagggtcaccatctcctgcacgtgggagccacctccaacagtcggggcgggttatgatgtacactggtaccagcagcttccgagggacacgcccccaaactcctcattctttggtagcaacaatccggccctcgacggggtccctgaccgtattctctggctccaagtctcggccacctcacgccctccctcggccactccacgtcgggcctccgaggctggaggatggaggctgacttacttacgtcgaccacgttcctagtcgaactagttggacggtcgttaggtaggtttcgggtttacgttagttcggtttccggtttacgggtacgttaccggttaccggggaacccgttaacgggttacccgtaacccggtttacccgttaaacgtaccgaaccggtacccccgaaaccgggtaccccctaaacccccgttcgtaccgttaccctaccgttccgtttcccgttaccccctacccccgttcccttaccctaaccgtttacccgttaccggttaccgttacgggtaccgggtccggggtaccggttaccgggaccggtaacgggcccggtaacgtaacgttacggctacngcgcncnnngnn

SEQ ID NO: 92221 - DNA, 746 bp, Homo sapiens
  misc_feature: GYAE6OF01B7HYL.18.73.G07.1.454.CMB.1.raw
  modified_base (739)..(739): a, c, t, g, unknown or other
  misc_feature (739)..(739): n is a, c, g, or t
  modified_base (741)..(741): a, c, t, g, unknown or other
  misc_feature (741)..(741): n is a, c, g, or t
  modified_base (743)..(743): a, c, t, g, unknown or other
  misc_feature (743)..(743): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacacgaccccaaacttgtcatctataggtaacaataatccggccctcgacggggtccctcgcccgtattctcgtcggctaccaagtcgtggaccacctcacgtccctcctggcctatccacgtcgggcctaccgaggtcgtaggaggagtacggacggtactagtaacttacgttacgtcgtacctacgttcctagtacgaactagtacggtacggtcgttaggtaacggtttggtttacgttagttcggtttccgttacgggtaacgttccgggttaaccgggaaccgttaacgggttacccgttaaccccggttaccgttaaacggtcccgaaccggtaccccgaaaccgggtaccccctaaaccccgttccgtaccgttacccgtacgtttcccgtttccccggttacccccgtacccctttaccctacccgttaccttaacccgtttccggtaaaccgtcgggtaacccgggtccggggtaccgttacgggacccggtaaccgggtacccggtactaacggttacggacctgacgtagcgtacgcgancngngtc

SEQ ID NO: 92222 - DNA, 579 bp, Homo sapiens
  misc_feature: GYAE6OF01CK1N9.18.73.G07.1.454.CMB.1.raw
  modified_base (565)..(565): a, c, t, g, unknown or other
  misc_feature (565)..(565): n is a, c, g, or t
  modified_base (570)..(579): a, c, t, g, unknown or other
  misc_feature (570)..(579): n is a, c, g, or t
tcagtacgagtatgcacgaccggtgctcgatttagctctacgctcagggtcctgggcccagtctgggctgacgcagccgccctcactgtctggggcccccagggcagagggtcagcatcaactgcactgggaccagttccaacatcggggcaaattatgatgtacactggtaccagcaacttccaggaacacgacccccaaacttgtcatctatggtaacaataactcggccctcgaggggtccctgccgattctctggcctcaagtctggacacctcacgtccctccctggccatccacgtcgggcctccgaggctggatgagtgaggtctagtatttattactcgacctacgtctatacgactacttaactctcgagttcgggtcgttggggtcgttcgggacgggacgggacctgggtctcggaccggttggtcgggtacacggacccgtaggcctcccgccccgtcgtccctactccgttacgttcccccacccttcctacctacttacccgtaccgttacgtggaccggtcgggcctgggaccgtaggccgtacagtcgnatcgnnnnnnnnnn

SEQ ID NO: 92223 - DNA, 569 bp, Homo sapiens
  misc_feature: GYAE6OF01EY9TR.18.73.G07.1.454.CMB.1.raw
  modified_base (274)..(274): a, c, t, g, unknown or other
  misc_feature (274)..(274): n is a, c, g, or t
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
  modified_base (327)..(327): a, c, t, g, unknown or other
  misc_feature (327)..(327): n is a, c, g, or t
  modified_base (507)..(507): a, c, t, g, unknown or other
  misc_feature (507)..(507): n is a, c, g, or t
  modified_base (558)..(558): a, c, t, g, unknown or other
  misc_feature (558)..(558): n is a, c, g, or t
  modified_base (560)..(561): a, c, t, g, unknown or other
  misc_feature (560)..(561): n is a, c, g, or t
  modified_base (563)..(569): a, c, t, g, unknown or other
  misc_feature (563)..(569): n is a, c, g, or t
tcagtacgagtatgcacgaccggtgctcgatttagctctacgctcgagggtcctgggcccagtctgggctgacgcagcccgccctcactgtctgggggccccctaggggcagagggtcagcatcgaactgccactgggtaccagttccgaacatcggggcaaattatgatgtacactggtaccagcaacttccaggtaacacgccccctaaacttcgtcatctataggtaaacaataatccggccctcgacggggtcccctcgccccgattccncgtaggcttccaagtctggccacctcagcctcctggccatccacgntcgcncngctgatgatgacggtctagtatttacttactcgtcctacgtacctatacgtactaacttaactctacgtacggttcggtcggtcggggttcgttcgggcgggtacggaccgacggtcgtcgtaccggtcggtcggtcgacgacccgacgtcgtccgccctcggtccactcctcgttcccnccctccctccactacctcgtactcgacgcggcgtcggcgacggcgcatagncnncnnnnnnn

SEQ ID NO: 92224 - DNA, 537 bp, Homo sapiens
  misc_feature: GYAE6OF01E32Q9.18.73.G07.1.454.CMB.1.raw
  modified_base (350)..(350): a, c, t, g, unknown or other
  misc_feature (350)..(350): n is a, c, g, or t
  modified_base (414)..(414): a, c, t, g, unknown or other
  misc_feature (414)..(414): n is a, c, g, or t
  modified_base (511)..(511): a, c, t, g, unknown or other
  misc_feature (511)..(511): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
  modified_base (532)..(533): a, c, t, g, unknown or other
  misc_feature (532)..(533): n is a, c, g, or t
tcagtacgagtatgcacgaccggtgctcgatttagctctacgctcagggtcctgggcccagtctgggctgacgctagccgccctcactgtctgggccccagggcagaggggtcagcatcaaactcgccactgggaccagttccaacatcggggcaaacttatgatgtacactggtaccagacaacttccaggaacacgccccaaacttgtcgatcctataggtaaacaattaactcggccctcgacggggtcccctgcccgtattcctctggcctccaagtctggccacctcgacgcctcctggccatcgacgttgggctcgaggctgatgatggagctgaattagtacncgacctaagttcctagtcgactactatctcgagtcggtcgtcgggtctcggacgacggacagcngaccgtgtcggtctacgaccagtctcgccctacgctactcgtcttcccgcctactcactctcgtactgacgccggtcgcgcacggtcgacacgtcgncgcgcgacgcgacgngacncnnctcg

SEQ ID NO: 92225 - DNA, 599 bp, Homo sapiens
  misc_feature: GYAE6OF01CV1JK.18.73.G07.1.454.CMB.1.raw
  modified_base (529)..(529): a, c, t, g, unknown or other
  misc_feature (529)..(529): n is a, c, g, or t
  modified_base (587)..(587): a, c, t, g, unknown or other
  misc_feature (587)..(587): n is a, c, g, or t
  modified_base (589)..(590): a, c, t, g, unknown or other
  misc_feature (589)..(590): n is a, c, g, or t
  modified_base (593)..(599): a, c, t, g, unknown or other
  misc_feature (593)..(599): n is a, c, g, or t
tcagtacgagtatgcacgaccggtgctcgatttagctctacgctcagggtcctgggcccagtctgggctgacgcagccgccctcactgtctggggcccccagggcagagggtcagcatcaactgcactgggaccagttccaacagtcggggacaaattatgatgtacactggtaccagcaactccaaggaacacgacccccaaattgtcatctagtaggtaaacaataacgtccggccctcgacggggtcccctcgcccgtattcctcgtcggcctacgaaagttccgtggccaccctccacgtccctccctggacccatcgaccgttcgggcctcccgaggtcctgactgagtggagcttaggtattattaaccgtgctagctactagtaatacgaaacgccaaccagactaccttctacttagttcgttaccgttacggaacgtccgggaactaacggtcaccgttcccgtaggcccacgacccgacgaccccaacccactcgtcctacgtccctcccgttaccccnccctacctcctaacgtaccgtccgacggcgtcccggcgtcgacgacggcgcgactgancnnacnnnnnnn

SEQ ID NO: 92226 - DNA, 671 bp, Homo sapiens
  misc_feature: GYAE6OF01BOCOY.18.73.G07.1.454.CMB.1.raw
  modified_base (662)..(662): a, c, t, g, unknown or other
  misc_feature (662)..(662): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
  modified_base (671)..(671): a, c, t, g, unknown or other
  misc_feature (671)..(671): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacagtcggggcgggttatgatgtacactggtaccagcagcttccgagggacacgccccaaactcctcattctttggtagcaacaatccggccctcgtaggggtttctaagtcgtcttctctcggctccaagtctggacaacgccggccctccctcgaccatcctcgtgggcctccgaggctggacggacgaggctagtatttacttactgaccagtctacaatactaacgaacgcagacacgcctaactactaacgttccgttacggtaaccgtacgggaaccaacgggttccaacccggttacgtaacggtccaaccggacccccgtaaacggaccccaaaccccgtcgttagtacccctaccttacccgtttcccggttaccccccgtcccttacccttaccccgtaacgtttacccgttacccggttacctacggggaccgggttcccggtaacgtaccggggaccaacggggtacccaccgttagttaaccggcgtacgatcgcggactcgagtcacncncngtcgn

SEQ ID NO: 92227 - DNA, 685 bp, Homo sapiens
  misc_feature: GYAE6OF01EQQS5.18.73.G07.1.454.CMB.1.raw
  modified_base (302)..(302): a, c, t, g, unknown or other
  misc_feature (302)..(302): n is a, c, g, or t
  modified_base (676)..(676): a, c, t, g, unknown or other
  misc_feature (676)..(676): n is a, c, g, or t
  modified_base (679)..(685): a, c, t, g, unknown or other
  misc_feature (679)..(685): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacacgaccccaaacttgtcatctataggtaacaataatccggccctcgacggggtccctcgcccgtattctcgtcggctccaacgtctcggcctacctcacgtcctcccgtgccntccacgtcgggctccgaggctggatgagtggagtctgtatttacttacgtcgcctagttcctaagtactacgtaacttaactcgttacgtaggttcggttccgggtcgggggtttccgttcggggcgggtaacgggaccgtcggcgttacggaccgttcgggtcggggtacctaccggacccgtaacgggtcccttcccgggtaccccccggttcggttacccgtacccgtttcccggtttccccgtttccccccgtccccgtttcccctacccgttaaacctacccgtttaccggtaccgttcggaccgggtcccgggtacggttaccggacgggaaaccgggttcccgaacggtaacgtcggcaggtcacgngcnnnnnnn

SEQ ID NO: 92228 - DNA, 667 bp, Homo sapiens
  misc_feature: GYAE6OF01C5YWG.18.73.G07.1.454.CMB.1.raw
  modified_base (132)..(132): a, c, t, g, unknown or other
  misc_feature (132)..(132): n is a, c, g, or t
  modified_base (303)..(303): a, c, t, g, unknown or other
  misc_feature (303)..(303): n is a, c, g, or t
  modified_base (650)..(650): a, c, t, g, unknown or other
  misc_feature (650)..(650): n is a, c, g, or t
  modified_base (652)..(652): a, c, t, g, unknown or other
  misc_feature (652)..(652): n is a, c, g, or t
  modified_base (661)..(661): a, c, t, g, unknown or other
  misc_feature (661)..(661): n is a, c, g, or t
  modified_base (663)..(663): a, c, t, g, unknown or other
  misc_feature (663)..(663): n is a, c, g, or t
  modified_base (665)..(665): a, c, t, g, unknown or other
  misc_feature (665)..(665): n is a, c, g, or t
  modified_base (667)..(667): a, c, t, g, unknown or other
  misc_feature (667)..(667): n is a, c, g, or t
tcagtacgagtatgcacgaccggtgctcgatttagctctacgctcagggtcctgggcccagtctgtgctgacgcagccgccctcagtgtctcgggccccagggcagaggtcaccatctcctgcacgtgggancacctccaacagtcggggcggttatgatgtacactggtaccagctaacttccaaggaacacgaccccaaattgacatctagtagtaacaataactccggccctgacgggtccctgcccgtattcctcgtggccttaccaagttcgtcggacctacctcgacgcccttccgnggaccatcacgtcgggctcaggctagatgatgagtcttgattatcgtgctagtcctagacgactactaatctagacgttggtcgtcgggggttactccggggaggaaccggacgacggtccgtacgggttaccccgggtggttacgggtccaaccggtacccggaacggtccctccccgtccccggttaccgggtccctaacccgtttccggtttccccggtttccccccgtaaccccttccccgttaaccctaaacccgttcctaacccgggtttccgtaacggcggggtccgggacttacggggacccttaaagggggaccctaaccggtaaacgtcgagagcgngngcgacacancngngn

SEQ ID NO: 92229 - DNA, 521 bp, Homo sapiens
  misc_feature: GYAE6OF01B45VX.18.73.G07.1.454.CMB.1.raw
  modified_base (308)..(308): a, c, t, g, unknown or other
  misc_feature (308)..(308): n is a, c, g, or t
  modified_base (507)..(509): a, c, t, g, unknown or other
  misc_feature (507)..(509): n is a, c, g, or t
  modified_base (513)..(521): a, c, t, g, unknown or other
  misc_feature (513)..(521): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacacgacccccaaattgtcatctatggtaacaataatcggccctcgaggggtccctgcccgattctctgctccaagtctggcacctcagcctcctggccatcactgggcctccgaggctgntgatgaggctgattattctgccagtcctatcgacactaatctctagtggtcgtggggttctcgggcggagggccaggctcggaccgtcggtcgggtcacgcccgaaggcctcgccccgtcggtcctacgtccttccgttccctacccttcctcctactacctcgtacgtcgcgcggtcgtggcacggcgacgtgtacgnnngacnnnnnnnnn

SEQ ID NO: 92230 - DNA, 701 bp, Homo sapiens
  misc_feature: GYAE6OF01DRC0A.18.73.G07.1.454.CMB.1.raw
  modified_base (236)..(236): a, c, t, g, unknown or other
  misc_feature (236)..(236): n is a, c, g, or t
  modified_base (471)..(471): a, c, t, g, unknown or other
  misc_feature (471)..(471): n is a, c, g, or t
  modified_base (492)..(492): a, c, t, g, unknown or other
  misc_feature (492)..(492): n is a, c, g, or t
  modified_base (616)..(616): a, c, t, g, unknown or other
  misc_feature (616)..(616): n is a, c, g, or t
  modified_base (681)..(681): a, c, t, g, unknown or other
  misc_feature (681)..(681): n is a, c, g, or t
  modified_base (686)..(686): a, c, t, g, unknown or other
  misc_feature (686)..(686): n is a, c, g, or t
  modified_base (689)..(689): a, c, t, g, unknown or other
  misc_feature (689)..(689): n is a, c, g, or t
  modified_base (691)..(692): a, c, t, g, unknown or other
  misc_feature (691)..(692): n is a, c, g, or t
  modified_base (694)..(694): a, c, t, g, unknown or other
  misc_feature (694)..(694): n is a, c, g, or t
  modified_base (697)..(701): a, c, t, g, unknown or other
  misc_feature (697)..(701): n is a, c, g, or t
tcagtacgagtatgcacgaccggtgctcgatttagctctacgctcagggtcctgggcccagtctgccctgactcagcctgcctccgtgtctgggtctcctggacagtcgatcaccatctcctgcactaggaaccagcagtggtacgttggttaggttaataactatcgtctccgtaggtaaccaacacgccaacccgaggaccaaaccgaccccccaaaatcaattagtaatttanagtatcgtacctaactaacgtcccgggcccttacggttacgggtttactaacgtcgtcctttctgtcggtacctacctaaggttccgtaggaacccaaaccgtacccggtcccttaccccgtagaccctacgttccgtaccggttccgggacctacccggagggtacgtaacgggaacgggaccggtaggtacttaacgttaattttaaccgcgtacgactacgtcctagtaaanaaacgtaccgaagtccgaacncgtaacgacctaacgtacgtaaacgttccggtaaacggtaacgtaacgggaacctacgtccgtaccgtacgtacgtacacgacccgaccgacccaacctcgctacctactccttcccgtccccncccttcctacctacttaccgtcgtaccgtaggaccggtccggacgtacggaccgacggcgaacgngtacngtncnncncannnnn

SEQ ID NO: 92231 - DNA, 746 bp, Homo sapiens
  misc_feature: GYAE6OF01B8W1A.18.73.G07.1.454.CMB.1.raw
  modified_base (232)..(232): a, c, t, g, unknown or other
  misc_feature (232)..(232): n is a, c, g, or t
  modified_base (272)..(272): a, c, t, g, unknown or other
  misc_feature (272)..(272): n is a, c, g, or t
  modified_base (720)..(720): a, c, t, g, unknown or other
  misc_feature (720)..(720): n is a, c, g, or t
  modified_base (727)..(727): a, c, t, g, unknown or other
  misc_feature (727)..(727): n is a, c, g, or t
  modified_base (731)..(731): a, c, t, g, unknown or other
  misc_feature (731)..(731): n is a, c, g, or t
  modified_base (737)..(737): a, c, t, g, unknown or other
  misc_feature (737)..(737): n is a, c, g, or t
  modified_base (739)..(740): a, c, t, g, unknown or other
  misc_feature (739)..(740): n is a, c, g, or t
  modified_base (742)..(742): a, c, t, g, unknown or other
  misc_feature (742)..(742): n is a, c, g, or t
  modified_base (744)..(744): a, c, t, g, unknown or other
  misc_feature (744)..(744): n is a, c, g, or t
tcagtacgagtatgcacgaccggtgctcgatttagctctacgctcaggggtcctgggcccagtctgggctgacgcagccgccctcactgtctcggggccccagggcaggagggtcagcatcaactgcacgtggggaccaggttaccaacagtcggggactaaattatgactgtacacgtggtacagtcaacttccaaggaacacgacccctaaattgtcatctataggtaanaataacgtcggccctacgacggggtccctcgccgtattcnctcggcctacgtacgtcgtcggcctacctcgaccgtccctcccgtcggacctactccgtacggtcggggccttaccggacggtcgtagagtacgtagtacggacgggtcttagtatttacgttactcgtacgtacgttccttagtacaacgtaactactacgtacggtacggttgggttcgggttcgggggtacgtccggggaccggggacgggtacccggcgggtacggtcgggtaccggttacgggtcgggtaccgaccgggaccgtacggtcccgttacccggtccccggttaccggtccgttaccccgttccggttcccctttacccccggtcccctttaccctacccggtaacctttaccccggttacgttccgggtaacgggtccccgggtagggttaccgggtacgggaaccgggtacggaacccggtgtaaggtaccggntacggcncgtntcgtcngnngngngc

SEQ ID NO: 92232 - DNA, 669 bp, Homo sapiens
  misc_feature: GYAE6OF01B12L5.18.73.G07.1.454.CMB.1.raw
  modified_base (660)..(660): a, c, t, g, unknown or other
  misc_feature (660)..(660): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacacgccccaaacttgtcatctataggtaacaataatccggccctcgacggggtccctcgcccgtattctcgtcggctccaagtctcggccacctcacgtccctcccgtggccatccacgtcgggcctccgaggtcctggaggatggaggctagtactattactcgtaccgtacgtcctagtcgacgtagtacggacggtcgtaggtaggttcggtttacggtattcggttccgttacgggtacgttcggtacgggaccgtaacggttccctaacccggttaccttaaaggtcctacggaccccgaaacggccccctaaccccttgtccgtacctaccgttccgtttcccgttcccccgcccttccctacctaacgttccctacgttacctcgggaacggcccggggttactacggggacccgtaaagggtacccgtaacgtaacggttacgcgtacgacgactacgcagtanaccngngtc

SEQ ID NO: 92233 - DNA, 645 bp, Homo sapiens
  misc_feature: GYAE6OF01CGHSB.18.73.G07.1.454.CMB.1.raw
  modified_base (628)..(629): a, c, t, g, unknown or other
  misc_feature (628)..(629): n is a, c, g, or t
  modified_base (634)..(634): a, c, t, g, unknown or other
  misc_feature (634)..(634): n is a, c, g, or t
  modified_base (637)..(637): a, c, t, g, unknown or other
  misc_feature (637)..(637): n is a, c, g, or t
  modified_base (641)..(645): a, c, t, g, unknown or other
  misc_feature (641)..(645): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacacgccccaaacttgtcatctataggtaaacaaataactccggccctcgacggggtccctcgcccgtattcctcgtggtcctccaagtctggccacctcacgccctccctcggccactccacgtcgggcctccgacggtctgatcgagtggaggtctagtaattacttactcgacgtacgttacctagtcgtaactacttaaactctacgtagttcggttcggtggggttccgttcgggcgggtacgggacgtagggtccgtacggtacccgggttggtcgggtacgaccggtcccggaacggtccctcccgggtcccccgttcggtacccgtaccgttccgttccccgttccccgtcccccttaccgttccctaacttacccgttcgtaccgtgggaccggtccgggtccgacggacgtaacggcgactacgtggatcnncgtancgngacnnnnn

SEQ ID NO: 92234 - DNA, 486 bp, Homo sapiens
  misc_feature: GYAE6OF01CBKW9.18.73.G07.1.454.CMB.1.raw
  modified_base (327)..(327): a, c, t, g, unknown or other
  misc_feature (327)..(327): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
  modified_base (373)..(373): a, c, t, g, unknown or other
  misc_feature (373)..(373): n is a, c, g, or t
  modified_base (393)..(393): a, c, t, g, unknown or other
  misc_feature (393)..(393): n is a, c, g, or t
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
  modified_base (465)..(465): a, c, t, g, unknown or other
  misc_feature (465)..(465): n is a, c, g, or t
  modified_base (471)..(471): a, c, t, g, unknown or other
  misc_feature (471)..(471): n is a, c, g, or t
  modified_base (474)..(486): a, c, t, g, unknown or other
  misc_feature (474)..(486): n is a, c, g, or t
tcagtacgagtatgcacgaccggtgctcgatttagctctacgctcagggtccgtgggcccagtctgggctgacgcagccgccctcactgtctgggccccagggcagagggtcagcatcaactgcactgggaccagttccaacagtcgggcaaattatgatgtacactggtaccagcaacttccaggaacagccccaaattgtcatctatggtaacaataactcggccctcgacggggtccctgcccgtattctctggctccaagtctggcacctcacgccctcctggccatcactgggctccagctgatgatgagctgatttatacngccagtcctatganactaatntacagtgtacgtggggtcttcgggnggagggccagctgaccgtgnggtcagccagcncgcccngtcnctctcgtcccncctcncntactcgtatgacgcggtctagggctaaggcgntaacgngtnnnnnnnnnnnnn

SEQ ID NO: 92235 - DNA, 900 bp, Homo sapiens
  misc_feature: GYAE6OF01EGD8S.18.73.G07.1.454.CMB.1.raw
  modified_base (868)..(868): a, c, t, g, unknown or other
  misc_feature (868)..(868): n is a, c, g, or t
  modified_base (875)..(875): a, c, t, g, unknown or other
  misc_feature (875)..(875): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacagtcggggcgggttatgatgtacacgtggtaccagcagcttccgagggcacgaccccaaactcctactattcgtttagggacactaacgtaacgtcccggtacccgtacggacggggtcccctcggtaacccgtatttccgtcgtacggtcctaccgtaacggttcgtacgggcctaaccccgttcaaccggtcccccttcccggttacggacccctaacgttccgtaacccgggttccgggggtcccctttacccgggtaacggggtacccgttaggggtaacggggtaacgttacgggtacgggttacctttaaccgggtaaaccttttaacgttacccggtccggtaacccttaccggttaccttaacggtacgtaaacctaggggttacgacgggtacggtttacggggtacggtttacgggttttaccgttaaggtttccggtttaaccggtttccgggtaaacggttccggggttaaaccggggtaacccgttaaaccggggttaccccttaaccccgggtttaaccgtaaacggtacccgtaacccggtaaccccgtaacccggtaccccccgttaaccccgtttcgtaccgtaccccttaccgtttccccgtttcccccgttacccccttaccgtactaaccgttaccgtaccggttcgtacggtacggggtacccggtacgttacgggaacctacggtacccgattaacgaccgtancggtacncgtacgctacgtgtacgtctgcgac

SEQ ID NO: 92236 - DNA, 746 bp, Homo sapiens
  misc_feature: GYAE6OF01CK7S3.18.73.G07.1.454.CMB.1.raw
  modified_base (734)..(734): a, c, t, g, unknown or other
  misc_feature (734)..(734): n is a, c, g, or t
  modified_base (739)..(741): a, c, t, g, unknown or other
  misc_feature (739)..(741): n is a, c, g, or t
  modified_base (743)..(744): a, c, t, g, unknown or other
  misc_feature (743)..(744): n is a, c, g, or t
  modified_base (746)..(746): a, c, t, g, unknown or other
  misc_feature (746)..(746): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacacgccccaaattgcatctatacggtaacaataactcggtccctcgacgggtccctgcccgtattctctcggtcctccaagtctggccacctcagccctcctggccactcaccgtgggcctccgaggtccttagactaggactaggtacggtacttagtaactttacgttacctacggaccctagttcccttaagtcgaacctaggtggtaaccggtcgttaggttaacggttcgggtttaccgttaacgttcggtttaccggtttacgggtacgttcccggtaacgggggtaaccccgttaacgggttaccccgtaaaccccgggttaacgttaaaccggtaccgtaaccggaacccccgtaaacccggtaacccccctaacccccgttcgtacggttaaccctaccgttccccgtttacccgttaccccccctaacccttttacccgtacccgtaaacctttacccgttaaccggttactaaccggggtccggtaccgggtcgtaccggaccggtaaacgtccggaaactaaccgttggctaangctannncnngn

SEQ ID NO: 92237 - DNA, 721 bp, Homo sapiens
  misc_feature: GYAE6OF01CA0PN.18.73.G07.1.454.CMB.1.raw
  modified_base (656)..(656): a, c, t, g, unknown or other
  misc_feature (656)..(656): n is a, c, g, or t
  modified_base (710)..(710): a, c, t, g, unknown or other
  misc_feature (710)..(710): n is a, c, g, or t
  modified_base (715)..(715): a, c, t, g, unknown or other
  misc_feature (715)..(715): n is a, c, g, or t
  modified_base (717)..(719): a, c, t, g, unknown or other
  misc_feature (717)..(719): n is a, c, g, or t
  modified_base (721)..(721): a, c, t, g, unknown or other
  misc_feature (721)..(721): n is a, c, g, or t
tcagtacgagtatgcacgaccggtgctcgatttagctctacgctcagggtcctgggcccagtctgggctgacgcagccgccctcactgtctcggggccccagggcagagggtcagcatcaactgcacgtgggaccagttccaacagtcggggacaaattatgatgtacactggtaccagcaacttcaggaacacgaccccaaattcgcatctagtaggtaacaataactcggcctcgacggggtccctcgcccgtattcctcgtcgctacgaagtctcggccacctcacgccctccgtcggcccatcctacggtcgggcctccgacgggtctagacgtggaacgttggaacgggtcttaggttaactttaacgtttaccgtacgtacccgtaacgtttcccgtaaagttctaaacccgtaactttaacttccgtacgtaggtttcgggtcggggtttcgggggttaccgtttcgggaccgggggaacgggtacccgacgggaccgtttcgggaacccggggttggttaccgggtaccgaccggtaacccggtaagggcccgttacccgtcccccggttaacgggcccttaaccgttccgttccccgtttaaccccggtccctacccgtaccgttaaccttcccgtacggttaccgngggtaccggtccgggtcttacgggaccgtacgggacccacgtagtcggatgctngcgcnannngn

SEQ ID NO: 92238 - DNA, 734 bp, Homo sapiens
  misc_feature: GYAE6OF01B2GWX.18.73.G07.1.454.CMB.1.raw
  modified_base (724)..(724): a, c, t, g, unknown or other
  misc_feature (724)..(724): n is a, c, g, or t
tcagtacgagtatgcacgaccggtgctcgatttagctctacgctcagggtcctgggcccagtctgggctgacgcagccgccctcactgtctgggcccccagggcagagggtcagcatcaactgcactgggaccagttccaacatcgggcaaattatgatgtacactggtaccagcaacttaccaggaaccacgtccccaaacttcgtacatctaatgtaacaataactcggccctcgacgggttccctacgcccgtattccgtcgtcggtcttaccgaaggtctacgggccacctcgacgccctcccgtggcctacgtcaacgttcgggcctccgaggtcctgagtcgaagtcgaagggtctaggtaactttacgttaactggaccgaacgtcctaactaacgttaaacgttaaccgaaacgaccgaacccgtaagacctaactcccgttacttaacgtcggttacccgttacgggtaaaccgtcggggtaaaccgtaacggtaccccgtaccggttacccgttaacggtccaaaccggaccccgtaaccgggaacccctaaaccgaccgttctacctaacccttccgtaccgttcccccgacccgtcccgttaccctaaacttcccttaccgggttactacccggggtaacgtccgggtacgtaaccgggtaacccgaaaccgggtccggtaacctaagggtaaccttgaacgcactacacanactcgtcacg

SEQ ID NO: 92239 - DNA, 743 bp, Homo sapiens
  misc_feature: GYAE6OF01BY9NJ.18.73.G07.1.454.CMB.1.raw
  modified_base (724)..(724): a, c, t, g, unknown or other
  misc_feature (724)..(724): n is a, c, g, or t
  modified_base (729)..(729): a, c, t, g, unknown or other
  misc_feature (729)..(729): n is a, c, g, or t
  modified_base (731)..(731): a, c, t, g, unknown or other
  misc_feature (731)..(731): n is a, c, g, or t
  modified_base (736)..(737): a, c, t, g, unknown or other
  misc_feature (736)..(737): n is a, c, g, or t
  modified_base (739)..(739): a, c, t, g, unknown or other
  misc_feature (739)..(739): n is a, c, g, or t
  modified_base (741)..(741): a, c, t, g, unknown or other
  misc_feature (741)..(741): n is a, c, g, or t
  modified_base (743)..(743): a, c, t, g, unknown or other
  misc_feature (743)..(743): n is a, c, g, or t
tcagtacgagtatgcacgaccggtgctcgatttagctctacgctcagggtcctgggcccagtctgggctgacgcagccgccctcactgtctgggccccaggcagagggtcagcatcaactgcactgggaccagttccaacatcggggcaaattatgatgtacactggtaccagcaacttccaggaacacgcccccaaacttgtcatctataggtaacaataagtccggccctcgacgggtccctcgcccgtacttctcctggcctaccaagtcgtcggccacctccacgccctccgtcggccactccgacgtcgggcctaccgacggtcctgatcgaggtacggtacggtacttagtaacttttacgttaaccgtcgtaccctacgttaccctaagttaccgaaccttaacgttaacttaccgtacgtaaggttcgggttccggttcggggttccggttaccgggcgggaacgggtccgtaacggtccggtaccggtaaccgggttcggtacgggtacccgtaccggaccccggtaacggtccccgttcccgtccccccggtttacggtaccccgtaacccctttcccgttaccccggtttaccccccctaccccgttaccccttacccgttaacccgttaccccgtttacccggttaaccggtcggaccggggtcccggttaccggaccgggaccggtaaccggtccgaacgtacgtacggtncgtgncngctanncngngn

SEQ ID NO: 92240 - DNA, 888 bp, Homo sapiens
  misc_feature: GYAE6OF01AW6ZR.18.73.G07.1.454.CMB.1.raw
  modified_base (864)..(864): a, c, t, g, unknown or other
  misc_feature (864)..(864): n is a, c, g, or t
  modified_base (870)..(870): a, c, t, g, unknown or other
  misc_feature (870)..(870): n is a, c, g, or t
  modified_base (876)..(876): a, c, t, g, unknown or other
  misc_feature (876)..(876): n is a, c, g, or t
  modified_base (883)..(883): a, c, t, g, unknown or other
  misc_feature (883)..(883): n is a, c, g, or t
  modified_base (886)..(886): a, c, t, g, unknown or other
  misc_feature (886)..(886): n is a, c, g, or t
  modified_base (888)..(888): a, c, t, g, unknown or other
  misc_feature (888)..(888): n is a, c, g, or t
tcagtacgagtatgcacgaccggtgctcgatttagctctacgctcagggtcctgggcccagtctgggctgacgcagccgccctcactggtctcggggccccagggcaggaggggtcagcatcaactgcacgtgggaccagttaccaacagtcggggactaattatgatcgtacactggtaccagactaactaccaaggaacaccgaccccaaacttgcactctaatacggtaaacaaactaacgtccggtccctacggtaccggggttccctcgcccgtacttccgtccgtcggtaccctaccgtaacgttccgtcggcctacccgttaccgaccgtccccgttcccgtaccggtacctacgttaccgaaccgtttccggggccccgttcccggaaacgggtcttacgtagttaggtagttcgggtaggttacgtttacgtaacgttttaacgttaccggtacgttaccccctaacggtttaacccttaaggttaaccggaaacccttaaaacctttaacgttaccccggtacgttacgggggttttacgggggttcggggtttcccggggggtttaacccggggtttccggggaccgggggtaccggggtaacccgtgggtaccccgtacggggttaccccggttcggggttaccgggggtaccgaaccccgggtacccggaccgggttacccggttccccccgtacccgggtttacccgtaccgttaccggttcccccgttcccggttaccccctccccgtttacccctaccgttacccgtttacccttacgttcccggtacgggtaccggggaccggttcgggaacgtacgggtacggaccgtacgaagtccgagtagtcncccggngtctancgacgcncgngn

SEQ ID NO: 92241 - DNA, 673 bp, Homo sapiens
  misc_feature: GYAE6OF01CPR7K.18.73.G07.1.454.CMB.1.raw
  modified_base (634)..(634): a, c, t, g, unknown or other
  misc_feature (634)..(634): n is a, c, g, or t
  modified_base (660)..(660): a, c, t, g, unknown or other
  misc_feature (660)..(660): n is a, c, g, or t
  modified_base (664)..(673): a, c, t, g, unknown or other
  misc_feature (664)..(673): n is a, c, g, or t
tcagtacgagtatgcacgaccggtgctcgatttagctctacgctcagggtcctgggcccagtctgggctgacgcagccgccctcactgtctggggcccccagggcaggagggtcagcatcaactgcacgtgggaccagttccaacagtcggggactaaattatgatgtacactggtaccagcaacttaccgaaggaaccaccgaccccctaaacttgtctatctaagtaggtaaactaaataactccggccctcgacggggtccctcgcccgtattccgtcgtcggcctaccgaagttccgtcggacctacctccgaccgtccccttcccgtcggcccatccgacgtcgggtcctccgacggtcgtaggacgtgtacgtggacggtctaggttaactttacgttaccgtcgtaccgtacgttaccttagtacgtaacctaacttaactcgtacgtaggttcgggttcggttcgggggttcgtaccggggacgggaacggacggtacggtcggtcggtaccggttcggtcgggtcacggtaccggtaacggtcccgtcccggccccgttacggtacctccgttccttcccgtcccctccctcctctacctcgttacgtacgtcggcggtaccggngtacgggacgacgcgtacgtagtagnatgnnnnnnnnnn

SEQ ID NO: 92242 - DNA, 755 bp, Homo sapiens
  misc_feature: GYAE6OF01CDPVS.18.73.G07.1.454.CMB.1.raw
  modified_base (135)..(135): a, c, t, g, unknown or other
  misc_feature (135)..(135): n is a, c, g, or t
  modified_base (146)..(146): a, c, t, g, unknown or other
  misc_feature (146)..(146): n is a, c, g, or t
  modified_base (213)..(213): a, c, t, g, unknown or other
  misc_feature (213)..(213): n is a, c, g, or t
  modified_base (267)..(267): a, c, t, g, unknown or other
  misc_feature (267)..(267): n is a, c, g, or t
  modified_base (706)..(706): a, c, t, g, unknown or other
  misc_feature (706)..(706): n is a, c, g, or t
  modified_base (746)..(747): a, c, t, g, unknown or other
  misc_feature (746)..(747): n is a, c, g, or t
  modified_base (749)..(749): a, c, t, g, unknown or other
  misc_feature (749)..(749): n is a, c, g, or t
  modified_base (751)..(751): a, c, t, g, unknown or other
  misc_feature (751)..(751): n is a, c, g, or t
  modified_base (753)..(753): a, c, t, g, unknown or other
  misc_feature (753)..(753): n is a, c, g, or t
  modified_base (755)..(755): a, c, t, g, unknown or other
  misc_feature (755)..(755): n is a, c, g, or t
tcagtacgagtatgcacgaccggtgctcgatttagctctacgctcagggtcctgggcccagtctgggctgacgcagcccgcctcactgtcgtcgggccccagggcagagggtcaccatcctcctgcacgtgggancacctcaacgngtcgggcgggttatgatcgtacacgttggaccagcgtagctccgaggaccaccgacccctaatcctntactttcgttaggacacaacacgtccggccctaggaccgggtccctaggacctnttccgtcgtcgtcctacaacggttctaccgccgccttccgaaccggttcccctccggtcggaacctcgttaccgcggttccggacctccggtaaggccgttaaggaacggcgtttcggacggtctagtttaacccgtattttaccggccggtaaccctaggtttaccctaagcggtaaaccttgggtccgggtataacgttgggttaaacgggttttcggttaactttggttaacggttccgtttcggaaccggttccggtaccggggtaaccctaaccggttccgtaaccccgttcggaaaccgtccgaacccgcccgggaacctacccctaccctccggttaccgtccctacctttacccggtcccttaaccccttcccgtaccctaaccgttacccgttaacccgggttccgtagtccgggtacgggtacccggtntaccgggccgtacggcctaagtcgaacgtcacgctgcgtnnancngngn

SEQ ID NO: 92243 - DNA, 493 bp, Homo sapiens
  misc_feature: GYAE6OF02II4Y3.18.73.G07.1.454.CMB.1.raw
  modified_base (328)..(328): a, c, t, g, unknown or other
  misc_feature (328)..(328): n is a, c, g, or t
  modified_base (484)..(493): a, c, t, g, unknown or other
  misc_feature (484)..(493): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcagcttccagggacagcccccaaaactcctcatctttggtagcaacaatcggccctcaggggtcccctgaccgattctctggctccaagtctggcacctcagcctccctggccatcactgggctccaggctgaggatgaggctgactattacngccagtcctatgacatgaggctgagtggttcgtatgtctttcggatcgtgggaccaaggtcaccgtctaagtcagcccaaggcccaaccctctgtcactctcgttcccacccttcctccatacctcgtactgacgcgggctggcaaggcgcatagnnnnnnnnnn

SEQ ID NO: 92244 - DNA, 750 bp, Homo sapiens
  misc_feature: GYAE6OF02J4JJ5.18.73.G07.1.454.CMB.1.raw
  modified_base (737)..(743): a, c, t, g, unknown or other
  misc_feature (737)..(743): n is a, c, g, or t
  modified_base (745)..(750): a, c, t, g, unknown or other
  misc_feature (745)..(750): n is a, c, g, or t
tcagtacgagtatgcacgaccggtgctcgatttagctctacgctcagggtcctgggcccagtctgggctgacgcagccgccctcactgtctggggccccagggcagagggtcagcatcactgcacgtcggaccagttaccaacagtacgggataaattatgtaactcgtacacgttacggtaccacgtacctaaccttaccgaacggaaccaccgtaccccctaaatttcgtacctaagttaccgttaagtaacggtaaacctaaccgttaaccgtcccgggtacccgttaccgggtacccgggtcccctccggtcccgttacttcccgttaccggtccggtaccctaccggtaaccgttccgtaccggcccctaacccttacccgaccggttccccccttccgtaccgggaccccttaacgtaccgtaccggtttccggggcccttaccggacggttcgtaaggtacgttaaggcgttacgggtacggttacttacggttaactttaccgttaaccgtccgaaccggttactactaacgtacgtacctacgttacgtcggtacggtcgggttccgggtcgggttcgggtccggacggcggacgacgtcgtcgtacggcgtcggacgcaccgtccgacgcctccgccgtactcctaccgttcctcccgtccctcctaccgtacgtacgttaccggtatacgggtcgccgggtccaccggagaccgacgcacgtagcnnnnnnncnnnnnn

SEQ ID NO: 92245 - DNA, 526 bp, Homo sapiens
  misc_feature: GYAE6OF02HQKPA.18.73.G07.1.454.CMB.1.raw
  modified_base (509)..(509): a, c, t, g, unknown or other
  misc_feature (509)..(509): n is a, c, g, or t
  modified_base (514)..(526): a, c, t, g, unknown or other
  misc_feature (514)..(526): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctccaagtctggcacctcagcctccctggccatcactgggcctccaggctgatgatgagctgattatactgccagtcctatgacactaatctcagtggtcgtgggggtcttcgggcgggtagggaccgagggtcctcggtacccggttcggtcggggtccgacggccccgaagggcctccggcccccttcggttccacgttcctcgttccccacccttcctccactacctcgtactgacgcgggctggcaggcncatgnnnnnnnnnnnnn

SEQ ID NO: 92246 - DNA, 492 bp, Homo sapiens
  misc_feature: GYAE6OF02GW4F8.18.73.G07.1.454.CMB.1.raw
  modified_base (480)..(492): a, c, t, g, unknown or other
  misc_feature (480)..(492): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctccaagtctggcacctcagcctccctggccatcactgggctccaggctgatgatgaggctgattattactgccagtcctatgacactaatctcagtggtctgggggtcttcgggcggagggccaggctgaccgtcgtgggtcagcccaaggctcgcccctcggtccactctcgttcccgccctcctccatcctcgtactgagcgggctggcaaggcgcagtagnnnnnnnnnnnnn

SEQ ID NO: 92247 - DNA, 490 bp, Homo sapiens
  misc_feature: GYAE6OF02G45A8.18.73.G07.1.454.CMB.1.raw
  modified_base (478)..(490): a, c, t, g, unknown or other
  misc_feature (478)..(490): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacataatcggccctcaggggtccctgcccgattctctggctccaagtctggcacctcacgcctccctggccatcactgggctccaggctgatgatgaggctgattattactgccagtcctatgacacttaatctcagtggtctgggggtcttcggcggtagggaccaggctgaccgtcgtgggtcagccctaaggctcgcccctcggtcactctgttcccaccctcctccatacctcgtactgagcggctgcaggcgcagtgnnnnnnnnnnnnn

SEQ ID NO: 92248 - DNA, 482 bp, Homo sapiens
  misc_feature: GYAE6OF02HNWA7.18.73.G07.1.454.CMB.1.raw
  modified_base (473)..(482): a, c, t, g, unknown or other
  misc_feature (473)..(482): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctccaagtctggcacctcagcctcctggccatcactgggctccaggctgatgatgaggctgattatactgccagtcctatgacatgaggctgagtggttctatgtctttcggatcgtgggaccaaggtcaccgtcctaagtcagcccaagccaaccctctcgtcactctcgtcccacctcctccatactcgtactgacgcggctggcaggcgcatagnnnnnnnnnn

SEQ ID NO: 92249 - DNA, 506 bp, Homo sapiens
  misc_feature: GYAE6OF02JA8RE.18.73.G07.1.454.CMB.1.raw
  modified_base (372)..(372): a, c, t, g, unknown or other
  misc_feature (372)..(372): n is a, c, g, or t
  modified_base (495)..(506): a, c, t, g, unknown or other
  misc_feature (495)..(506): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctccaagtctggccacctcacgcctcccctggccatccactgggctccaggctgaggatgaggctgactattactgccagtcctatgacatgagctgagtggttcgtatgtcttggntcgtggaccaggtcaccgtctaagtcacgcccaacggcccaaccccttctcgtccaccttccttcgttccccaccctccctaccacttacctcgtactgacgcgggtctggcaggcacgatgnnnnnnnnnnnn

SEQ ID NO: 92250 - DNA, 492 bp, Homo sapiens
  misc_feature: GYAE6OF02ISPTJ.18.73.G07.1.454.CMB.1.raw
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
  modified_base (479)..(483): a, c, t, g, unknown or other
  misc_feature (479)..(483): n is a, c, g, or t
  modified_base (485)..(492): a, c, t, g, unknown or other
  misc_feature (485)..(492): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctccaagtctggcacctcagcctccctggccatcactgggctccaggctgatgatgaggctgattatactnccagtcctatgacactaatcnagtgtctgggggtcttcggcggngggaccaggctgaccgtcggtgggtcagccaaggctcgcccctcggtcactctcgttcccaccctcctccactacctcgtactgacgcgggctcggcaggcgacagtgnnnnngnnnnnnnn

SEQ ID NO: 92251 - DNA, 524 bp, Homo sapiens
  misc_feature: GYAE6OF02HEB0B.18.73.G07.1.454.CMB.1.raw
  modified_base (326)..(326): a, c, t, g, unknown or other
  misc_feature (326)..(326): n is a, c, g, or t
  modified_base (514)..(514): a, c, t, g, unknown or other
  misc_feature (514)..(514): n is a, c, g, or t
  modified_base (516)..(517): a, c, t, g, unknown or other
  misc_feature (516)..(517): n is a, c, g, or t
  modified_base (519)..(524): a, c, t, g, unknown or other
  misc_feature (519)..(524): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcagcttccagggacagcccccaaactcctcatctttggtagcaacaatccggccctcaggggtccctgaccgattctctggctccaagtctggcacctcagcctccctggccatcactgggctccaggctgagatgaggctgactattacngccagtcctatgacagtgaggctgagtggttcgtatgtcttcggatcgtgggaccaaggtcaccgtctaagtcacgcccaacggcccaaccctctcgtccaccttccgtccgttccccgccccttcctccctacttaccgttccgtacctcggacggccgggtctcgggacaacgggccgcaagtagncnncnnnnnn

SEQ ID NO: 92252 - DNA, 492 bp, Homo sapiens
  misc_feature: GYAE6OF02JE60I.18.73.G07.1.454.CMB.1.raw
  modified_base (325)..(325): a, c, t, g, unknown or other
  misc_feature (325)..(325): n is a, c, g, or t
  modified_base (482)..(485): a, c, t, g, unknown or other
  misc_feature (482)..(485): n is a, c, g, or t
  modified_base (487)..(492): a, c, t, g, unknown or other
  misc_feature (487)..(492): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcagcttccagggacagcccccaaaatcctcatctttggtagcaacaatcggccctcgaggggtccctgaccgattctctggctccaagtctggcacctcagcctccctggccatcactgggctccaggctgagatgagctgactattacngccagtcctatgacatgagctgagtgttctatgtctggatcgtgggacaggtcaccgtctaagtcacgcccaacggcccaaccctctcgtccactctcgttcccgcctccctacctactactcgtactggacgcgggctacggcgaaggcgcatagnnnncnnnnnn

SEQ ID NO: 92253 - DNA, 468 bp, Homo sapiens
  misc_feature: GYAE6OF02F6GMA.18.73.G07.1.454.CMB.1.raw
  modified_base (347)..(347): a, c, t, g, unknown or other
  misc_feature (347)..(347): n is a, c, g, or t
  modified_base (408)..(409): a, c, t, g, unknown or other
  misc_feature (408)..(409): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
  modified_base (440)..(440): a, c, t, g, unknown or other
  misc_feature (440)..(440): n is a, c, g, or t
  modified_base (456)..(456): a, c, t, g, unknown or other
  misc_feature (456)..(456): n is a, c, g, or t
  modified_base (458)..(458): a, c, t, g, unknown or other
  misc_feature (458)..(458): n is a, c, g, or t
  modified_base (460)..(468): a, c, t, g, unknown or other
  misc_feature (460)..(468): n is a, c, g, or t
tcagtacgagtatgcacgaccggtgctcgatttagctctacgctcagggtcctgggcccagtctgggctgacgcagccgccctcactgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcacgccctccctggccatcactgggctccaggctgaggatgaggctgactattactgccagtcctatgacatganactgagtgttctatgtcttggatcgtggaccaggtcaccgtctagcacgccaagcccaccnngtcactctctcccncctcncatactcgtacngagcggctgccaggcnangnnnnnnnnn

SEQ ID NO: 92254 - DNA, 485 bp, Homo sapiens
  misc_feature: GYAE6OF02FVMNP.18.73.G07.1.454.CMB.1.raw
  modified_base (412)..(412): a, c, t, g, unknown or other
  misc_feature (412)..(412): n is a, c, g, or t
  modified_base (471)..(471): a, c, t, g, unknown or other
  misc_feature (471)..(471): n is a, c, g, or t
  modified_base (474)..(485): a, c, t, g, unknown or other
  misc_feature (474)..(485): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcgggttatgatgtacactggtaccagcagcttccagggacagcccccaaactcctcatctttggtagcaacaatcggccctcaggggtccctgaccgattctctggctccaagtctggcacctcagccctcctggccatcactgggctccaggctgagatgaggctgactattactgccagtcctatgacatgagctggagtggttcgtatgtcttcggatcgtggaccaggtcaccgtctaagcagcccaggcccaaccctntacgtcactctcgtcccaccctcctaccactactcgtactgacgcggctggcaggcacntannnnnnnnnnnn

SEQ ID NO: 92255 - DNA, 493 bp, Homo sapiens
  misc_feature: GYAE6OF02IFD7O.18.73.G07.1.454.CMB.1.raw
  modified_base (230)..(230): a, c, t, g, unknown or other
  misc_feature (230)..(230): n is a, c, g, or t
  modified_base (327)..(327): a, c, t, g, unknown or other
  misc_feature (327)..(327): n is a, c, g, or t
  modified_base (476)..(476): a, c, t, g, unknown or other
  misc_feature (476)..(476): n is a, c, g, or t
  modified_base (482)..(493): a, c, t, g, unknown or other
  misc_feature (482)..(493): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggacagcccccaaacttgtcatctatggtaacaataatcggccctnaggggtccctgcccgattctctggctccaagtctggcacctcagcctccctggccatcactgggcctccgaggttgatgatgaggctgactattacngccagtcctatgacatgaggctgagttggttctatgtcttcggatcgtggacaaggtcaccgtctaagtcagcccaaggcccaaccctctcgtcactctcgttccccacctcctccactaccttcgtacttgacgcggctgggcaggcngatagnnnnnnnnnnnn

SEQ ID NO: 92256 - DNA, 510 bp, Homo sapiens
  misc_feature: GYAE6OF02GK733.18.73.G07.1.454.CMB.1.raw
  modified_base (360)..(360): a, c, t, g, unknown or other
  misc_feature (360)..(360): n is a, c, g, or t
  modified_base (437)..(437): a, c, t, g, unknown or other
  misc_feature (437)..(437): n is a, c, g, or t
  modified_base (498)..(498): a, c, t, g, unknown or other
  misc_feature (498)..(498): n is a, c, g, or t
  modified_base (500)..(501): a, c, t, g, unknown or other
  misc_feature (500)..(501): n is a, c, g, or t
  modified_base (503)..(503): a, c, t, g, unknown or other
  misc_feature (503)..(503): n is a, c, g, or t
  modified_base (505)..(510): a, c, t, g, unknown or other
  misc_feature (505)..(510): n is a, c, g, or t
tcagtacgagtatgcacgaccggtgctcgatttagctctacgctcagggttccgtgggcccagtctgggctgacgccagccgccctcaccttgtctggggccccagggcagagggtcagcatcaactgcactgggaccagttccgaacatcggggcaaagttatgatgtacacttggtaccagccaacttccaggaacagcccccaaaattgtcatctagtggtaacaataatcggcccgtcaggggtccctgcccgattctctggcctccaagtcctggcacctcagcctccctgggcccatccactcgggcctccgaggctgatggatggaggctgacctattactgccagtcctagngacatgagctgagtggttcgtatggtcttggatctgggaccaaggtcaccgtctaagtcagcccaagcctaaccctntgtcactctcgttcccgcctcctccatactcgtactgacgcggctggcaaggcgacatagntnnangnnnnnn

SEQ ID NO: 92257 - DNA, 520 bp, Homo sapiens
  misc_feature: GYAE6OF02GDJPC.18.73.G07.1.454.CMB.1.raw
  modified_base (325)..(325): a, c, t, g, unknown or other
  misc_feature (325)..(325): n is a, c, g, or t
  modified_base (348)..(348): a, c, t, g, unknown or other
  misc_feature (348)..(348): n is a, c, g, or t
  modified_base (507)..(507): a, c, t, g, unknown or other
  misc_feature (507)..(507): n is a, c, g, or t
  modified_base (509)..(509): a, c, t, g, unknown or other
  misc_feature (509)..(509): n is a, c, g, or t
  modified_base (511)..(513): a, c, t, g, unknown or other
  misc_feature (511)..(513): n is a, c, g, or t
  modified_base (515)..(520): a, c, t, g, unknown or other
  misc_feature (515)..(520): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctccaagtctggcacctcagcctcctggccatcactgggctccaggctgatgatgaggctgattattacngccagtcctatgacactaatctntagtggtcgtgggggtcttcgggcggagggaccaggctgaccgtcggtcgggtcacgcccgaaggctccggcccccgttcggtccacctccgttcgttccccacccttccctccactacctcgtactgacgtccgggctcgggcaacggcgacagtagncngnnncnnnnnn

SEQ ID NO: 92258 - DNA, 516 bp, Homo sapiens
  misc_feature: GYAE6OF02H53TG.18.73.G07.1.454.CMB.1.raw
  modified_base (499)..(499): a, c, t, g, unknown or other
  misc_feature (499)..(499): n is a, c, g, or t
  modified_base (504)..(516): a, c, t, g, unknown or other
  misc_feature (504)..(516): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctccagtctggcacctcagcctccctggccatcactgggctccaggctgatgatggaggctgatttattacgtcgccagttcctatcgactacttaatctacacggttggtcgttcgggggttcttcgggcgggtagggaccagggtctggaccgtcggtgggcacggcccaggcctcgcccctggtcacgtctccgttcccaccctcctccactactcgtactgcgcggctcggcacgcgcgngtacnnnnnnnnnnnnn

SEQ ID NO: 92259 - DNA, 526 bp, Homo sapiens
  misc_feature: GYAE6OF02GC4ZD.18.73.G07.1.454.CMB.1.raw
  modified_base (513)..(514): a, c, t, g, unknown or other
  misc_feature (513)..(514): n is a, c, g, or t
  modified_base (516)..(517): a, c, t, g, unknown or other
  misc_feature (516)..(517): n is a, c, g, or t
  modified_base (519)..(526): a, c, t, g, unknown or other
  misc_feature (519)..(526): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtcccctgcccgattctctggctccaagtctggcacctcagcctccctggccatcactgggctccaggctgatgatgagctgattattactgcctagtcctatgacactaatctcagtgtcgtggggtctcggcggaggacgaggctcgaccggtcggtgggtcacgacccgaggcctcgcccccgttcggtcctactcctcgttccccgcccttccctccacttcctacgtacgtcggacgccggtcgtcggtaccgacgggtccgcgtacgtacgnngnncnnnnnnnn

SEQ ID NO: 92260 - DNA, 586 bp, Homo sapiens
  misc_feature: GYAE6OF02GTJEK.18.73.G07.1.454.CMB.1.raw
  modified_base (567)..(567): a, c, t, g, unknown or other
  misc_feature (567)..(567): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (581)..(581): a, c, t, g, unknown or other
  misc_feature (581)..(581): n is a, c, g, or t
  modified_base (584)..(586): a, c, t, g, unknown or other
  misc_feature (584)..(586): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcacggggtccctgcccgattctctggctccaagtctggcacctcacgcctccctggccatccacgttcgggcctccgaggtcctgatgatgaggtctgatttattactgccagtcctatcgaactactaatctcagtggtcgtggggtcttcgggcgagggccgaggtcgtcggaccggtcggtcgggtcacgcccgaaggccctccggcccccgttacgtcctaccgttccgttaccgttcccccgtccccttcccgtccctaaccttaccgtccgttccgtcggacgggtccgggtccgtcgggtaccgaacgggtccgaccgtaacggtacggntacgcncngctgcngcnnn

SEQ ID NO: 92261 - DNA, 585 bp, Homo sapiens
  misc_feature: GYAE6OF02GUFHW.18.73.G07.1.454.CMB.1.raw
  modified_base (406)..(406): a, c, t, g, unknown or other
  misc_feature (406)..(406): n is a, c, g, or t
  modified_base (570)..(570): a, c, t, g, unknown or other
  misc_feature (570)..(570): n is a, c, g, or t
  modified_base (575)..(576): a, c, t, g, unknown or other
  misc_feature (575)..(576): n is a, c, g, or t
  modified_base (578)..(578): a, c, t, g, unknown or other
  misc_feature (578)..(578): n is a, c, g, or t
  modified_base (580)..(585): a, c, t, g, unknown or other
  misc_feature (580)..(585): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcgacggggtccctgcccgattctctggctccaagtctggcacctcacgcctcctggccatcactgggctccaggctgatgagtggaggtctagtatttattaccgtcgcctagtcctatcgaacacttaactctcgtagttcggtcgtgggggttcttcgggcgggacgggaccgnggctcggaccgtcggtgggtcgacgacccgacggtccgtccgccccgttcggtcctaccttccgttcccgttccccgtccccttccctccctaccgttacccttccggtaccgttgggaccgggtccgggtcggtcgggaccggaacggccgtacgacggtgcncgtgnncncnnnnnn

SEQ ID NO: 92262 - DNA, 567 bp, Homo sapiens
  misc_feature: GYAE6OF02JZGQB.18.73.G07.1.454.CMB.1.raw
  modified_base (190)..(190): a, c, t, g, unknown or other
  misc_feature (190)..(190): n is a, c, g, or t
  modified_base (202)..(202): a, c, t, g, unknown or other
  misc_feature (202)..(202): n is a, c, g, or t
  modified_base (251)..(251): a, c, t, g, unknown or other
  misc_feature (251)..(251): n is a, c, g, or t
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (349)..(349): a, c, t, g, unknown or other
  misc_feature (349)..(349): n is a, c, g, or t
  modified_base (538)..(538): a, c, t, g, unknown or other
  misc_feature (538)..(538): n is a, c, g, or t
  modified_base (558)..(567): a, c, t, g, unknown or other
  misc_feature (558)..(567): n is a, c, g, or t
tcagtacgagtatgcacgaccggtgctcgatttagctctacgctcagggtcctgggcccagtctgggctgacgcagccgccctcactgtctggggccccagggcgagagggtcagcatcaactgcactgggaccagttcccaacagtcggggcaaattatgatgtacactggtacagcaactccaggacngacccccaattntcatctagtgtaaacataatcggcctcacggggtccctgcccgatttcnctgctaccatcgtcggctacncacnccctcctgccatcgacgtcgggactcgacggactgatcgagtcggagtcagtattatctgcctagtcctagtnaacgtactaatctacgattcgggttcggtggggttaccttgggaccgggtaagggacgacggtcggtacgttcggtggtacgggtcaccggtacgacgtccgtacccgtcccgtcgtccgaccttcgtacccgtcccctaccctccgtcgttaacctccgtggtacctcggacggaccggtcgcggtanacgcgtacagctagctacgnnnnnnnnnn

SEQ ID NO: 92263 - DNA, 550 bp, Homo sapiens
  misc_feature: GYAE6OF02GTQWZ.18.73.G07.1.454.CMB.1.raw
  modified_base (340)..(340): a, c, t, g, unknown or other
  misc_feature (340)..(340): n is a, c, g, or t
  modified_base (370)..(370): a, c, t, g, unknown or other
  misc_feature (370)..(370): n is a, c, g, or t
  modified_base (399)..(399): a, c, t, g, unknown or other
  misc_feature (399)..(399): n is a, c, g, or t
  modified_base (475)..(475): a, c, t, g, unknown or other
  misc_feature (475)..(475): n is a, c, g, or t
  modified_base (499)..(499): a, c, t, g, unknown or other
  misc_feature (499)..(499): n is a, c, g, or t
  modified_base (508)..(508): a, c, t, g, unknown or other
  misc_feature (508)..(508): n is a, c, g, or t
  modified_base (538)..(538): a, c, t, g, unknown or other
  misc_feature (538)..(538): n is a, c, g, or t
  modified_base (540)..(543): a, c, t, g, unknown or other
  misc_feature (540)..(543): n is a, c, g, or t
  modified_base (545)..(550): a, c, t, g, unknown or other
  misc_feature (545)..(550): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacacgccccaaattgtcatctatggtaacaataatcggccctgacggggtcctagcccgattctcctggcctccaagtctaggccacctcagccctcctggcccagtccactcgggcctccgaggctagatgatcgagcttagtattattacngcctaatcctattcgaactacgttaactcncgtagtcggtcgtgggggtcccttcgggnggacgggacacgggtctcggtaccgtggtcgggtcacgtccgaaggcctccgcccgtcggctactcgtcgttcccncctcctccactaccgtgtacccgngccgtcggntcgggtacaacggtcggaccagttacgctncnnnncnnnnnn

SEQ ID NO: 92264 - DNA, 539 bp, Homo sapiens
  misc_feature: GYAE6OF02GFU99.18.73.G07.1.454.CMB.1.raw
  modified_base (528)..(528): a, c, t, g, unknown or other
  misc_feature (528)..(528): n is a, c, g, or t
  modified_base (530)..(539): a, c, t, g, unknown or other
  misc_feature (530)..(539): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggcctcacggggtccctgcccgattctctggctccaagtctggcaccttcacgcctcccctggccatccactcgggctccgaggctgatgatggaggctagtattattactcgcctagtcctatgactactaatcgtacagtgtcgtgggggtcttcgggcggaggaccgaggtctcggacgtcgtgggcacgcccgaaggctccgccccgttcgtcacgtcctcgttccccgccccttcctacctacttaccgtacgttacgtcggacggtccggcgtcggacgacggtcgacagttaggcangnnnnnnnnnn

SEQ ID NO: 92265 - DNA, 529 bp, Homo sapiens
  misc_feature: GYAE6OF02G7KRO.18.73.G07.1.454.CMB.1.raw
  modified_base (348)..(348): a, c, t, g, unknown or other
  misc_feature (348)..(348): n is a, c, g, or t
  modified_base (421)..(421): a, c, t, g, unknown or other
  misc_feature (421)..(421): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (517)..(517): a, c, t, g, unknown or other
  misc_feature (517)..(517): n is a, c, g, or t
  modified_base (521)..(521): a, c, t, g, unknown or other
  misc_feature (521)..(521): n is a, c, g, or t
  modified_base (523)..(529): a, c, t, g, unknown or other
  misc_feature (523)..(529): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcgggttatgatgtacactggtaccagcagcttccagggacagcccccaaactcctcatctttggtagcaacaatcggccctcaggggtttctaatcgcttctctggctccaagtctggcaacacggcctccctgacccatctcgtgggcctccgaggctggaggacgaggctgatttattactgcagctcatatacacncaccagcactctctatgtcttacggacgtcggaccaacgtcaccgttcaggtccacgccaacggcccaacccntcgtccaccttcctcgttcccccaccttcctcctaacttaccgtcgtacctggaccgccgggtctcggacgaacggccgacctagtacgnacntgntacncnnnnnnn

SEQ ID NO: 92266 - DNA, 481 bp, Homo sapiens
  misc_feature: GYAE6OF02F0JZ6.18.73.G07.1.454.CMB.1.raw
  modified_base (347)..(347): a, c, t, g, unknown or other
  misc_feature (347)..(347): n is a, c, g, or t
  modified_base (388)..(388): a, c, t, g, unknown or other
  misc_feature (388)..(388): n is a, c, g, or t
  modified_base (413)..(413): a, c, t, g, unknown or other
  misc_feature (413)..(413): n is a, c, g, or t
  modified_base (424)..(424): a, c, t, g, unknown or other
  misc_feature (424)..(424): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (472)..(481): a, c, t, g, unknown or other
  misc_feature (472)..(481): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaattgtcatctatggtaacaataatcggccctcgacggggtccctgcccgattctctggctccaagtctggcacctcacgcctccctggcccatccacgtcgggcctccgaggctggatgatggaggctgatttatactgccagtcctancgactactaatcgtcagtgtcgtggggtcttggcggaggcnggtctgcgtcggtggcagccagccncgcccgtcgcnctctcgtcccncctcncatctcgtctgacgcggctgcgagcgnagngnnnnnnnnnn

SEQ ID NO: 92267 - DNA, 618 bp, Homo sapiens
  misc_feature: GYAE6OF02FIN2N.18.73.G07.1.454.CMB.1.raw
  modified_base (272)..(272): a, c, t, g, unknown or other
  misc_feature (272)..(272): n is a, c, g, or t
  modified_base (605)..(605): a, c, t, g, unknown or other
  misc_feature (605)..(605): n is a, c, g, or t
  modified_base (607)..(608): a, c, t, g, unknown or other
  misc_feature (607)..(608): n is a, c, g, or t
  modified_base (610)..(618): a, c, t, g, unknown or other
  misc_feature (610)..(618): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaattgtcatctatggtaacataatcggccctcaggggtccctgccgattctctggctaccaagtctggcaccctnacgccctccctggccatccactgggcctccgagctgatgatgaggctgtacttattactgcctagtccttatcgacctaacttaactctacgaggtcggttacgttcgggggttacgttccggggacgggacgggacccgagggtccgtcgggtacccggtcggtacgggttccaccggtacccgaacgggtcccgtccggtaccccccggttccggtccctaccgttcccttacccggttaccccctacccccttcccgtaccctacgttacccgttaccgttacgttacggaccggtccggacgtcggaccgaacggccgactagtacgcncnncnnnnnnnnn

SEQ ID NO: 92268 - DNA, 580 bp, Homo sapiens
  misc_feature: GYAE6OF02IIXSF.18.73.G07.1.454.CMB.1.raw
  modified_base (276)..(276): a, c, t, g, unknown or other
  misc_feature (276)..(276): n is a, c, g, or t
  modified_base (561)..(561): a, c, t, g, unknown or other
  misc_feature (561)..(561): n is a, c, g, or t
  modified_base (566)..(566): a, c, t, g, unknown or other
  misc_feature (566)..(566): n is a, c, g, or t
  modified_base (570)..(580): a, c, t, g, unknown or other
  misc_feature (570)..(580): n is a, c, g, or t
tcagtacgagtatgcacgaccggtgctcgatttagctctacgctcagggtcctgggcccagtctgggctgacgcagccgccctcactgtctggggccccagggcaggagggtcagcatcaactgcactgggaccagttccaacatcggggcaaattatgatgtacactggtaccagcaacttccaggaacacgccccaaacttgtcatctatggtaacaataatcggccctgaggggtccctgcccgattctctggcctcaaggtctggcacctcncgccctcccgtaggcctatccgacttcgggctcccgaggtcctgactggatgacggtctgaatttatacgtgacctagtccctatacgactagtaactctacgacggttggttacgttgggggttaccttcggggccgggtaacggtacgacggctcgaccggtcggtcggtcgacgccgaacgtcgtcgaccccttcggtccgtaccttccgttccgttccccgcccgttccctaccgtacttaccgtccgtactcgacgtccggtacgtcgacgacgcgacgngtacncgcnnnnnnnnnnn

SEQ ID NO: 92269 - DNA, 647 bp, Homo sapiens
  misc_feature: GYAE6OF02FH9H0.18.73.G07.1.454.CMB.1.raw
  modified_base (632)..(632): a, c, t, g, unknown or other
  misc_feature (632)..(632): n is a, c, g, or t
  modified_base (639)..(639): a, c, t, g, unknown or other
  misc_feature (639)..(639): n is a, c, g, or t
  modified_base (644)..(644): a, c, t, g, unknown or other
  misc_feature (644)..(644): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacacgccccctaaacttgtcatctatagtaacaataatcggccctcgacggggtccctgcccgattctctggcctccaagtctggccacctcacgccctcctggcccatcctacgtggggccctccgaggctagatcgatggaggctgtattacgttactcgcctagtcctatcgaactacgtaatctctaggtcggttcgttcggggttcttcgggcggacgggaccgacggtcgcggtaccggtcggtcgggtaccacggaccccgaaggtcccgtccggtcccccgttccgtacctaccgttccgcccgtttcccccggtccccttacccgtaccctacgtttacccgtaccggttaccgttacgggaaccggtcccggggtaccggtcgggtaaccggtacgggacccgtaaccgtaacggtaacggcgtcgaactgacgngtcgtgngcgtngcg

SEQ ID NO: 92270 - DNA, 698 bp, Homo sapiens
  misc_feature: GYAE6OF02JEFLS.18.73.G07.1.454.CMB.1.raw
  modified_base (156)..(156): a, c, t, g, unknown or other
  misc_feature (156)..(156): n is a, c, g, or t
  modified_base (295)..(295): a, c, t, g, unknown or other
  misc_feature (295)..(295): n is a, c, g, or t
  modified_base (675)..(675): a, c, t, g, unknown or other
  misc_feature (675)..(675): n is a, c, g, or t
  modified_base (681)..(681): a, c, t, g, unknown or other
  misc_feature (681)..(681): n is a, c, g, or t
  modified_base (685)..(685): a, c, t, g, unknown or other
  misc_feature (685)..(685): n is a, c, g, or t
  modified_base (690)..(690): a, c, t, g, unknown or other
  misc_feature (690)..(690): n is a, c, g, or t
  modified_base (693)..(694): a, c, t, g, unknown or other
  misc_feature (693)..(694): n is a, c, g, or t
  modified_base (696)..(697): a, c, t, g, unknown or other
  misc_feature (696)..(697): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcgggcaaattangatgtacactggtaccagcaacttccaggaacacgccccaaattgtcatctatggtaacaataatcggcctcgacggggtccctgcccgtattctcgtggcctaccgaagttctcggcacccttcaccgtcccttcccncggccactccgacgtcgggcctccgacgggtctggacgtgagttcggaggcctagtaatttacgttacgtcgacctacggtccttaagtcgtaacctaactaacgttcgtacgtacggttcggttaccgggttcgggggttcccgttcggggaccgggtaacgggtaacccggtaacggtccgtacgggacccggttcgggtacggttaccgacggacccggtaacgggtcccgttaccccggtaccccggttcggtaccctaccgtttccgtcccgtttcccccgaccccttccgtacccgtaccttacccttaccgggttaagccgggtaccggtcgggtaccgtaccgggaccgtaacggtccgtacgacgtacggnacgtanacgngcgcngcnncnnc

SEQ ID NO: 92271 - DNA, 769 bp, Homo sapiens
  misc_feature: GYAE6OF02ITZIL.18.73.G07.1.454.CMB.1.raw
  modified_base (123)..(123): a, c, t, g, unknown or other
  misc_feature (123)..(123): n is a, c, g, or t
  modified_base (164)..(164): a, c, t, g, unknown or other
  misc_feature (164)..(164): n is a, c, g, or t
  modified_base (755)..(755): a, c, t, g, unknown or other
  misc_feature (755)..(755): n is a, c, g, or t
  modified_base (763)..(763): a, c, t, g, unknown or other
  misc_feature (763)..(763): n is a, c, g, or t
  modified_base (765)..(765): a, c, t, g, unknown or other
  misc_feature (765)..(765): n is a, c, g, or t
  modified_base (767)..(768): a, c, t, g, unknown or other
  misc_feature (767)..(768): n is a, c, g, or t
tcagtacgagtatgcacgaccggtgctcgatttagctctacgctcagggtcctgggcccagtctgggctgacgcagcccgccctcactgtctggggccccagggcagagggtcagcatcactncacgtcggactacgttaccaacaggtcgggactaaattagngtatacgtacacgtcggtaaccagacctaacttccgaacggaacaccgaccccctaaacgtttctactactactacgttaaggtaaactaactaaccgtccggcccgtacggtaccggggttcccctacggacccgtacttccttcggtccggtccctaccgtaacgttccgtcggtacctaccctcgaccgtcccttccgtcggacctaactcgtacgtcgggtacctccggagtctagacttggacgtggacgtctagttattaccgtcgtcgactacgtctacgtaactacgaaccgaacgtccaacgtacgtcctaacttcgttacgttacgttccgttacgttaaccgggtaacgtaccggtaaccgtacggtacccgtacggttaccgttacggaccgtacccggtaacccgaacccgaccccgtaacctaccggttacctaccttaccgttacccgtttaccctacccccttaaccgttaccctacccttaaccggttaacccgttaccgttaaccggtcggtacccgggttaccggtacgtacccgggacgtaaccggtccgaacgtaaccgtgccagttccncgactcancncnnc

SEQ ID NO: 92272 - DNA, 484 bp, Homo sapiens
  misc_feature: GYAE6OF02GUSL6.18.73.G07.1.454.CMB.1.raw
  modified_base (464)..(464): a, c, t, g, unknown or other
  misc_feature (464)..(464): n is a, c, g, or t
  modified_base (471)..(475): a, c, t, g, unknown or other
  misc_feature (471)..(475): n is a, c, g, or t
  modified_base (477)..(484): a, c, t, g, unknown or other
  misc_feature (477)..(484): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctccaagtctggcacctcagcctcctggccatcactgggctccagctgatgatgaggctgattattactgccagtcctatgacactaatctcagtggtctgggggtcttcggcggagggaccaggctgaccgtgtgggtcagcccaaggctcgcccctggcactctcgtcccaccctcctccatactcgtactgagcggctggcaggcncagtagnnnnngnnnnnnnn

SEQ ID NO: 92273 - DNA, 694 bp, Homo sapiens
  misc_feature: GYAE6OF02FSVSM.18.73.G07.1.454.CMB.1.raw
  modified_base (224)..(224): a, c, t, g, unknown or other
  misc_feature (224)..(224): n is a, c, g, or t
  modified_base (673)..(673): a, c, t, g, unknown or other
  misc_feature (673)..(673): n is a, c, g, or t
  modified_base (691)..(691): a, c, t, g, unknown or other
  misc_feature (691)..(691): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacacgccccaaattgtcatcctatagtaacaataacncggtccctacgacggggtcctcgccgattctctgcctcaagtctgctacctcgacgtccctcctcggcctacgtacctacggtcgggtcctaccggtacggtcgtagggtaacggtacgtcggtaacggtcttagtaaccgtttacgttaccgtacgaccgtacgttacctagtacgtaacgtagtacggacggtcgttacggtacggtttacggtttccgttacgttcggttacggttccggtacgttcggaccgggtaacctacggttcccgtaccggttacgtaacgtccgaccgtacccgaaccgcccttaacccgtgtccttacccgtactcccgtttccgtacccctacccgttccctaccttacgttacccgttacgtccgttacgggccgtacccgggtatccgggtaaccggacgggtacctaccggtaacgttagcgtntacgctgcttggctcagnacg

SEQ ID NO: 92274 - DNA, 669 bp, Homo sapiens
  misc_feature: GYAE6OF02HGTY6.18.73.G07.1.454.CMB.1.raw
  modified_base (158)..(158): a, c, t, g, unknown or other
  misc_feature (158)..(158): n is a, c, g, or t
  modified_base (213)..(213): a, c, t, g, unknown or other
  misc_feature (213)..(213): n is a, c, g, or t
  modified_base (365)..(365): a, c, t, g, unknown or other
  misc_feature (365)..(365): n is a, c, g, or t
  modified_base (392)..(392): a, c, t, g, unknown or other
  misc_feature (392)..(392): n is a, c, g, or t
  modified_base (558)..(558): a, c, t, g, unknown or other
  misc_feature (558)..(558): n is a, c, g, or t
  modified_base (654)..(654): a, c, t, g, unknown or other
  misc_feature (654)..(654): n is a, c, g, or t
  modified_base (657)..(657): a, c, t, g, unknown or other
  misc_feature (657)..(657): n is a, c, g, or t
  modified_base (660)..(660): a, c, t, g, unknown or other
  misc_feature (660)..(660): n is a, c, g, or t
  modified_base (662)..(662): a, c, t, g, unknown or other
  misc_feature (662)..(662): n is a, c, g, or t
  modified_base (664)..(664): a, c, t, g, unknown or other
  misc_feature (664)..(664): n is a, c, g, or t
  modified_base (666)..(669): a, c, t, g, unknown or other
  misc_feature (666)..(669): n is a, c, g, or t
tcagtacgagtatgcacgaccggtgctcgatttagctctacgctcagggtcctgggcccagtctgggctgacgcagccgccctcactgtcgtcggggccccagggcaggagggtcagcatcaactgcacgtagggaccagttccaacagtccgggganaaattatgatgtacactggtaccagcaacttccgaggaacacgaccccaaagttntacatcgtaatagtaaactaaataacgtccggccctcgtaacggggtccctacggaccgtatttcgcgtcggtccttaccgaagttcgcggccaaccttcggaccgtccctccgttcggacctatccggtacgttcggcctaccgaggctanagtgatggcgtgtatacttagttacgngccgttagtcctaagtacgtaactaacgtacttcgacgtaggttccggtaggtttcggggtccgttcggggacgacgggacgtacgtcgttacggacgggtttacggcgtaacggacgtacccgaacggttccccgaccgttcccggtacggtacctccgttaccnccgttaacccgtccctttaccgacccttaacgttacccgtacgttaccggtcggtaaccggcgggttacgcggaacgacggaccgttgacgtagcnctnacngncnannnn

SEQ ID NO: 92275 - DNA, 861 bp, Homo sapiens
  misc_feature: GYAE6OF02JXPNJ.18.73.G07.1.454.CMB.1.raw
  modified_base (160)..(160): a, c, t, g, unknown or other
  misc_feature (160)..(160): n is a, c, g, or t
  modified_base (213)..(213): a, c, t, g, unknown or other
  misc_feature (213)..(213): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggacagttccaacagtccggggacaaattatnatgtacactacggtaccagacaacttaccgaggaacacgaccccctaaacttntacatactagtacggtaaacaataacgtccggccctacgacgggttccacggtacccgtattccgtagtcggtacctaccaacggttctacggccctaacctccgtaaccgtcccgttccccgcgaacccgtacttaccgacccgttcgggacccttaccggaaccgtaccgttaggtaaccgtggtaacggtaagggtacggtaacgttacgggttaattttaaccccttacggtaccgtacccgttaagttacccctaaaggttacgaaaccctttaactaacgttcccgtaaggtaacggtttgggttacccggggttacgggggttaccggttacccgggggtaccggggtaaccgggtaaacggtccggggtacctaaccggggtttcccgggtaaccggggtttacgggtaacccgtaacccgggtacccgtaaacccggggttacccgtcccccggttacccggttaccggtaccggttacccgtttcccggtaaccccgtttaccccgttaacccccgttcgttacccgttaaccgttacgttacgtaccggttccggggacggttaccgggtcacccgggtacgtaccggacgttaccaagggctacgtgaccgattacgcgcgacgtaggcgtcgtgc

SEQ ID NO: 92276 - DNA, 674 bp, Homo sapiens
  misc_feature: GYAE6OF02IF6NB.18.73.G07.1.454.CMB.1.raw
  modified_base (645)..(645): a, c, t, g, unknown or other
  misc_feature (645)..(645): n is a, c, g, or t
  modified_base (654)..(654): a, c, t, g, unknown or other
  misc_feature (654)..(654): n is a, c, g, or t
  modified_base (665)..(665): a, c, t, g, unknown or other
  misc_feature (665)..(665): n is a, c, g, or t
  modified_base (668)..(668): a, c, t, g, unknown or other
  misc_feature (668)..(668): n is a, c, g, or t
  modified_base (670)..(670): a, c, t, g, unknown or other
  misc_feature (670)..(670): n is a, c, g, or t
  modified_base (672)..(672): a, c, t, g, unknown or other
  misc_feature (672)..(672): n is a, c, g, or t
tcagtacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtacagctaacttccaggaacacgacccctaaacttgtacatctataggtaacaataactcggcctcgacggggtccctcgacccgtattctctcggcctaccaagttctcggccacctcgacgtccctccgtggcctagtccacgtcgggcctaccgaggtcctgatggatggacggtcttgtaactttacgttacgtcgtacctagttaccttacgtcgaactaacttaaacttctaggtacgttgggttccggtcgggggtttccgtcggggtaccgggtacgggaaccgtgggtcgtaccgtccgggtacggtacgggtacgaccggtaccgtaacggcccgtacccgtcccggttccggtacgtaccgttccgtttcccggtccctccccgttccctaccgttaaccgttaccgtaccggttacgtcgggtaccggtacgggtcgtacgggtacggacgggcgtacgtacgnggtcacgtnacgtgacgtcncgncncngc

SEQ ID NO: 92277 - DNA, 207 bp, Homo sapiens
  misc_feature: GYAE6OF01BEI2W.49.47.E03.1.454.CMB.1.raw
  modified_base (202)..(207): a, c, t, g, unknown or other
  misc_feature (202)..(207): n is a, c, g, or t
tcagagtcgagagacacgaccggtgctcgatttagactcgcgcacagagagaagggcacgaccggtgctcgatttagctctacgctcagggcacgaccggtgctcgatttagtcacgcgagaagggaaaggggctggccctgacgtgtttctgttcccacctcctctctctcgactctgagcgggctggcaaggcgcatagnnnnnn

SEQ ID NO: 92278 - DNA, 168 bp, Homo sapiens
  misc_feature: GYAE6OF01CLQXS.49.47.E03.1.454.CMB.1.raw
  modified_base (168)..(168): a, c, t, g, unknown or other
  misc_feature (168)..(168): n is a, c, g, or t
tcagagtcgagagacacgaccggtgctcgatttagactcgcgcacagagagaagggcacgaccggtgctcgatttagtcacgcgagaaagggaaggggctggccctgacgtgtttctgttcccgccctcctctctctcgactctgagcgggctggcaaggcgcatagn

SEQ ID NO: 92279 - DNA, 134 bp, Homo sapiens
  misc_feature: GYAE6OF01BFHYH.49.47.E03.1.454.CMB.1.raw
  modified_base (132)..(134): a, c, t, g, unknown or other
  misc_feature (132)..(134): n is a, c, g, or t
tcagagtcgagagacacgaccggtgctcgatttagactcgcgcacagagagaagggcacgaccggtgctcgatttagactcgcgcacagagagaagggcctatcccctgagcgggctggcaaggcgcatagnnn

SEQ ID NO: 92280 - DNA, 216 bp, Homo sapiens
  misc_feature: GYAE6OF01DNXHX.49.47.E03.1.454.CMB.1.raw
  modified_base (216)..(216): a, c, t, g, unknown or other
  misc_feature (216)..(216): n is a, c, g, or t
tcagagtcgagagacacgaccggtgctcgatttagactcgcgcacagagagaagggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagn

SEQ ID NO: 92281 - DNA, 255 bp, Homo sapiens
  misc_feature: GYAE6OF02I1SND.49.47.E03.1.454.CMB.1.raw
  modified_base (213)..(213): a, c, t, g, unknown or other
  misc_feature (213)..(213): n is a, c, g, or t
  modified_base (220)..(255): a, c, t, g, unknown or other
  misc_feature (220)..(255): n is a, c, g, or t
tcagagtcgagagacacgaccggtgctcgatttagactcgcgcacagaggagaagggcacgacaggttgctcgatttagagagagtgtgttgggtttgggggaagaggaagactgaccgtcccccccaggacgttcaggtgctgggcacagcggcctggctgcctggtcaaggtactacttcctctctcgactctgagcggctggcaacggcncattagnnnnnnnnnnnnnnnnnnnnnnnnnnnnnnnnnnnn

SEQ ID NO: 92282 - DNA, 244 bp, Homo sapiens
  misc_feature: GYAE6OF01BKOQO.14.33.C11.1.454.CMB.1.raw
  modified_base (244)..(244): a, c, t, g, unknown or other
  misc_feature (244)..(244): n is a, c, g, or t
tcagcgtctagtaccacgaccggtgctcgatttagagtgagctcgttgggttgggtgtggtggtctccactcccgccttgacgaggctgattattactgccactcatatagaagtagtactactcctgtggtttcggcggagggaccaagctgaccgtcctaggtcagcccaaggctgcccctcggtcactctgttcccgccctcctcgtactagacgctgagcgggctggcaaggcgcatagn

SEQ ID NO: 92283 - DNA, 250 bp, Homo sapiens
  misc_feature: GYAE6OF01EIWZM.14.33.C11.1.454.CMB.1.raw
  modified_base (248)..(250): a, c, t, g, unknown or other
  misc_feature (248)..(250): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggtttcggcggagggaccaagctgaccgtcctaggtcagcccaaggctgccccctcggtcactctgttcccgccctcctcgtatctctcgctgagcgggctggcaaggcgcatagnnn

SEQ ID NO: 92284 - DNA, 249 bp, Homo sapiens
  misc_feature: GYAE6OF01CR7CW.14.33.C11.1.454.CMB.1.raw
  modified_base (249)..(249): a, c, t, g, unknown or other
  misc_feature (249)..(249): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccgccctcctcgtactagacgctgagcgggctggcaaggcgcatagn

SEQ ID NO: 92285 - DNA, 248 bp, Homo sapiens
  misc_feature: GYAE6OF01BK4QG.14.33.C11.1.454.CMB.1.raw
  modified_base (248)..(248): a, c, t, g, unknown or other
  misc_feature (248)..(248): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggtttcggcggagggaccaagctgaccgtcctaggtcagcccaaggctgccccctcggtcactctattcccaccctcctcgtactagacgctgagcgggctggcaaggcgcatagn

SEQ ID NO: 92286 - DNA, 249 bp, Homo sapiens
  misc_feature: GYAE6OF01D9DOE.14.33.C11.1.454.CMB.1.raw
  modified_base (249)..(249): a, c, t, g, unknown or other
  misc_feature (249)..(249): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccaccctcctcgtactagacgctgagcgggctggcaaggcgcatagn

SEQ ID NO: 92287 - DNA, 249 bp, Homo sapiens
  misc_feature: GYAE6OF01B25OU.14.33.C11.1.454.CMB.1.raw
  modified_base (248)..(249): a, c, t, g, unknown or other
  misc_feature (248)..(249): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggtttcggcggagggaccaagctgaccgtcctaggtcagcccaaggctgccccctcggtcactctgttcccaccctcctcgtatctctcgctgagcgggctggcaaggcgcatagnn

SEQ ID NO: 92288 - DNA, 251 bp, Homo sapiens
  misc_feature: GYAE6OF01CUW2P.14.33.C11.1.454.CMB.1.raw
  modified_base (249)..(251): a, c, t, g, unknown or other
  misc_feature (249)..(251): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccgccctcctcgtactagacgctgagcgggctggcaaggcgcatagnnn

SEQ ID NO: 92289 - DNA, 266 bp, Homo sapiens
  misc_feature: GYAE6OF01CTGH4.14.33.C11.1.454.CMB.1.raw
  modified_base (248)..(266): a, c, t, g, unknown or other
  misc_feature (248)..(266): n is a, c, g, or t
tcagcgtctagtaccacgaccggtgctcgatttagagtgagctcgttgggtttgggggtgtggtggtctccactcccgccttgacgaggctgattacttactgccactcatatagaagtagtactactcctgtggttttcggcggaggaccaagctgaccgtcctaggtcagcccaaggctgccccctggtcactctgttcccaccctcctcgtactagacgctgagcgggctggcaaggcgcatagnnnnnnnnnnnnnnnnnnn

SEQ ID NO: 92290 - DNA, 173 bp, Homo sapiens
  misc_feature: GYAE6OF01CPO3T.14.33.C11.1.454.CMB.1.raw
  modified_base (173)..(173): a, c, t, g, unknown or other
  misc_feature (173)..(173): n is a, c, g, or t
tcagcgtctagtaccacgaccggtgctcgatttagagtgagctcgttgggtttgggggaagaggaagactgacggtcccccaggagttcaggtgctgggcacagcggccctgggctgcctggtcaaggactacttccgtactagacgctgagcgggctggcaaggcgcatagn

SEQ ID NO: 92291 - DNA, 249 bp, Homo sapiens
  misc_feature: GYAE6OF01C30A1.14.33.C11.1.454.CMB.1.raw
  modified_base (249)..(249): a, c, t, g, unknown or other
  misc_feature (249)..(249): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccaccctcctcgtatctctcgctgagcgggctggcaaggcgcatagn

SEQ ID NO: 92292 - DNA, 190 bp, Homo sapiens
  misc_feature: GYAE6OF01BYADW.14.33.C11.1.454.CMB.1.raw
  modified_base (174)..(190): a, c, t, g, unknown or other
  misc_feature (174)..(190): n is a, c, g, or t
tcagcgtctagtaccacgaccggtgctcgatttagagtgagctcgttgggtttgggggaagaggaagactgaccggtcccccaggagttcaggtgctgggcacagcggccctgggctgcctggtcaaggactacttccgtactagacgctgagcgggctggcaaggcgcatagnnnnnnnnnnnnnnnnn

SEQ ID NO: 92293 - DNA, 249 bp, Homo sapiens; identical to SEQ ID NO: 92284
  misc_feature: GYAE6OF01A4I7B.14.33.C11.1.454.CMB.1.raw
  modified_base (249)..(249): a, c, t, g, unknown or other
  misc_feature (249)..(249): n is a, c, g, or t

SEQ ID NO: 92294 - DNA, 249 bp, Homo sapiens; identical to SEQ ID NO: 92286
  misc_feature: GYAE6OF01BES5I.14.33.C11.1.454.CMB.1.raw
  modified_base (249)..(249): a, c, t, g, unknown or other
  misc_feature (249)..(249): n is a, c, g, or t

SEQ ID NO: 92295 - DNA, 525 bp, Homo sapiens
  misc_feature: GYAE6OF01EAJ4N.14.33.C11.1.454.CMB.1.raw
  modified_base (515)..(515): a, c, t, g, unknown or other
  misc_feature (515)..(515): n is a, c, g, or t
tcagcgtctagtaccacgaccggtgctcgatttagagtgagctcgttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgtattataactttgtctctggtaccaacaacaccaggcaaagcccccaaactcatcatttatgaagtctctaagcggccctcagggtatctaatcgcttctctggctccaagtctggcaacacggcctccctgtaccgtctctggcctccagactgaggacgaggctagtattatactgccactcatataagaagtagtactactcttgttggtttcggcggtaggaccagctgaccgtcctaggtcacgcccgaagcctcgcccccgtgtccncgtcgtcccg

SEQ ID NO: 92296 - DNA, 267 bp, Homo sapiens
  misc_feature: GYAE6OF01BG2S8.14.33.C11.1.454.CMB.1.raw
  modified_base (251)..(267): a, c, t, g, unknown or other
  misc_feature (251)..(267): n is a, c, g, or t
tcagcgtctagtaccacgaccggtgctcgatttagagtgagctcgttgggtttgggggtggtggtaggtctccactcccgccttgacgaggctgattattactgccactcatatagaagtagtactactcctgtggttttcggcggagggaccaagctgaccgtcctaggtcagcccaaggctgccccctcggtcactctgttcccgccctcctcgtactagacgctgagcgggctggcaaggcgcatagnnnnnnnnnnnnnnnnn

SEQ ID NO: 92297 - DNA, 249 bp, Homo sapiens; identical to SEQ ID NO: 92284
  misc_feature: GYAE6OF01BOD8Z.14.33.C11.1.454.CMB.1.raw
  modified_base (249)..(249): a, c, t, g, unknown or other
  misc_feature (249)..(249): n is a, c, g, or t

SEQ ID NO: 92298 - DNA, 506 bp, Homo sapiens
  misc_feature: GYAE6OF01D7JOL.14.33.C11.1.454.CMB.1.raw
  modified_base (255)..(255): a, c, t, g, unknown or other
  misc_feature (255)..(255): n is a, c, g, or t
  modified_base (468)..(468): a, c, t, g, unknown or other
  misc_feature (468)..(468): n is a, c, g, or t
  modified_base (483)..(483): a, c, t, g, unknown or other
  misc_feature (483)..(483): n is a, c, g, or t
  modified_base (500)..(500): a, c, t, g, unknown or other
  misc_feature (500)..(500): n is a, c, g, or t
  modified_base (503)..(503): a, c, t, g, unknown or other
  misc_feature (503)..(503): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacaccaggcaaacgccccaaactcatcatttangaagtctctaagcgcctcgagggtatctaatcgcttctctggctccaagtctggcaacacggcctcctgaccgtctcgtcggcctccagactgaggacgaggctgattatactcgcctactcatatagaagtatactactctgttgtttcggcggtaggacaagctgaccgtctaggtcacgccaagctcgcccctcggtcactctcgtcccncctctctactgacgntgcgcggctcggcgagngcntgc

SEQ ID NO: 92299 - DNA, 588 bp, Homo sapiens
  misc_feature: GYAE6OF01EY18C.14.33.C11.1.454.CMB.1.raw
  modified_base (243)..(243): a, c, t, g, unknown or other
  misc_feature (243)..(243): n is a, c, g, or t
tcagcgtctagtaccacgaccggtgctcgatttagagtgagctcgttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtnattataacttgtctcctgtaccaacaacaccaggacaaacgcccccaaactcatcatttatgaagtctactaagccggccctcgagggtatctaatcgcttctctgctccaagtctggcaacaccggcctcccgtgaccgtctcgtcggccctccagactggacggacgaggctagtattacttactcgccactcaataataagtaagtaacgtacttactccgttggttcggttttccgggacgggtaacggtaccgaacggtccgtacggtacccgttccgtacggtccgacgaccccgaaggccctcccggcccccgtccggtccctacgtccgttaccccg

SEQ ID NO: 92300 - DNA, 250 bp, Homo sapiens
  misc_feature: GYAE6OF01E3UQM.14.33.C11.1.454.CMB.1.raw
  modified_base (250)..(250): a, c, t, g, unknown or other
  misc_feature (250)..(250): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttccccgccctcctcgtactagacgctgagcgggctggcaaggcgcatagn

SEQ ID NO: 92301 - DNA, 517 bp, Homo sapiens
  misc_feature: GYAE6OF01A2PRU.14.33.C11.1.454.CMB.1.raw
tcagcgtctagtaccacgaccggtgctcgatttagagtgagctcgttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacaccaggcaaagcccccaaactcatcatttatgaagtctctaagcggccctcaggggtatctaatcgcttctctggctccaagtctggcaacacggcctccctgaccgtctctcggcctccagactgaggacgaggctgattattactgccactcatatagaatagtactactcctgtggtttcggcggaggaccaagctgaccgtctaggtcacgcccaaggcctcgccccctgcactcgtcccg

SEQ ID NO: 92302 - DNA, 604 bp, Homo sapiens
  misc_feature: GYAE6OF01APB3N.14.33.C11.1.454.CMB.1.raw
  modified_base (436)..(436): a, c, t, g, unknown or other
  misc_feature (436)..(436): n is a, c, g, or t
  modified_base (517)..(517): a, c, t, g, unknown or other
  misc_feature (517)..(517): n is a, c, g, or t
  modified_base (549)..(549): a, c, t, g, unknown or other
  misc_feature (549)..(549): n is a, c, g, or t
tcagcgtctagtaccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttgcagtaacaccaagtacaggaatattaacctgtttccatcgactacgcctttcggcctcgccttaggggtcactcaccctgccccgattacgtggacaggacccttggtcttccggcgagcggcttttcacccgtctttatcgttacttatgtcagcattcgctacttctgactacctccagcatcgcctcacngcacaccttcacagctacacgaaccgcctacccctaacccaacaaccgcaataacgcgtcgctcgccgcacgccttcggcnctacgttcgggtttacctcccccggttttacnccgtttcccttccccggtaccctacttcccgttagacgttaccgtacggacccgg

SEQ ID NO: 92303 - DNA, 249 bp, Homo sapiens
  misc_feature: GYAE6OF01DSIUJ.14.33.C11.1.454.CMB.1.raw
  modified_base (248)..(249): a, c, t, g, unknown or other
  misc_feature (248)..(249): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggtttcggcggagggaccaagctgaccgtcctaggtcagcccaaggctgccccctcggtcactctgttcccaccctcctcgtactagacgctgagcgggctggcaaggcgcatagnn

SEQ ID NO: 92304 - DNA, 250 bp, Homo sapiens
  misc_feature: GYAE6OF01C0HUO.14.33.C11.1.454.CMB.1.raw
  modified_base (249)..(250): a, c, t, g, unknown or other
  misc_feature (249)..(250): n is a, c, g, or t
tcagcgtctagtaccacgaccggtgctcgatttagagtgagctcgttgggtttggggggtgtggtggtctccactcccgccttgacgaggctgattattactgccactcatatagaagtagtactactcctgtggttttcggcggagggaccaagctgaccgtcctaggtcagcccaaggctgccccctggtcactctgttcccaccctcctcgtatctctcgctgagcgggctggcaaggcgcatagnn

SEQ ID NO: 92305 - DNA, 534 bp, Homo sapiens
  misc_feature: GYAE6OF01B47OC.14.33.C11.1.454.CMB.1.raw
  modified_base (255)..(255): a, c, t, g, unknown or other
  misc_feature (255)..(255): n is a, c, g, or t
  modified_base (376)..(376): a, c, t, g, unknown or other
  misc_feature (376)..(376): n is a, c, g, or t
  modified_base (497)..(497): a, c, t, g, unknown or other
  misc_feature (497)..(497): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacaccaggcaaacgcccccaaatcatcatttangaagtctctaagcgccctcagggtatctaatcgcttctctggctccaagtctggcaacacggcctccctgaccgtctctggcctccagactgaggacgaggctgattattactgcctactnatatagaagtagtactactccgtgttggtttcggcggaggaccagctgaccgtctacggtcacgccaaggctccgcccccgtgtcctactctctccccaccctcctccgtactacgccgtntcggcggcgggcgtggtaccgaacggcgacaagngng

SEQ ID NO: 92306 - DNA, 251 bp, Homo sapiens
  misc_feature: GYAE6OF01E05FF.14.33.C11.1.454.CMB.1.raw
  modified_base (249)..(251): a, c, t, g, unknown or other
  misc_feature (249)..(251): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccaccctcctcgtactagacgctgagcgggctggcaaggcgcatagnnn

SEQ ID NO: 92307 - DNA, 537 bp, Homo sapiens
  misc_feature: GYAE6OF01DMU10.14.33.C11.1.454.CMB.1.raw
  modified_base (244)..(244): a, c, t, g, unknown or other
  misc_feature (244)..(244): n is a, c, g, or t
  modified_base (430)..(430): a, c, t, g, unknown or other
  misc_feature (430)..(430): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
tcagcgtctagtaccacgaccggtgctcgatttagagtgagctcgttggggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaaccacattgacgttggtnattataactttgtctcctgtaccaacaacaccaggcaaagcccccaaactcatcattatgaagtctactaagccggccctcgagggtatctaatcgcttctctggctccaagtctggacaacgaccggcctccctcgaccgtctctcggccctccagtctaggacggacgaggctgtattattacngcctatcatatagaaagtagtaactctctgttggtttcggcggacggacagcgtgaccgtcgtaggtcacgacccgaggcctcgaccccgtgtacncctnttacccg

SEQ ID NO: 92308 - DNA, 509 bp, Homo sapiens
  misc_feature: GYAE6OF01CF64X.14.33.C11.1.454.CMB.1.raw
  modified_base (255)..(255): a, c, t, g, unknown or other
  misc_feature (255)..(255): n is a, c, g, or t
  modified_base (464)..(464): a, c, t, g, unknown or other
  misc_feature (464)..(464): n is a, c, g, or t
  modified_base (509)..(509): a, c, t, g, unknown or other
  misc_feature (509)..(509): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaatcatcatttangaagtctctaagcggccctcgagggtatctaatcgcttctctggctccagtctggcaacacggcctcctgaccgtctcgtgcctccagactgagacgagctgattatactgccactcatatagaagtagtactactctgttggtttcggacggaggacagctcgaccgtctagtcacgccaagctccgcccctcgtcactctcgtcccncctctcgtacacgcgtctgcgcgggctcggacgaggcgacagtgn

SEQ ID NO: 92309 - DNA, 522 bp, Homo sapiens
  misc_feature: GYAE6OF01C0D5A.14.33.C11.1.454.CMB.1.raw
  modified_base (256)..(256): a, c, t, g, unknown or other
  misc_feature (256)..(256): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaatcatcattttangaaagtctctaagcggccctcaggggtatctaatcgcttctctggctccaagtctggcaacacggcctccctgaccgtctctggcctccagactgaggacgaggctgattatactgccactcatatagaagtagtactactcctgtggttttcggcggagggaccaagctgaccgtcctaggtcagcccaagcctcgcccctcggcactctcgttcccacccttcctcgtatctctcgctgagcgggctcggacaggcncngtacg

SEQ ID NO: 92310 - DNA, 588 bp, Homo sapiens
  misc_feature: GYAE6OF01ANNTL.14.33.C11.1.454.CMB.1.raw
tcagcgtctagtaccacgaccggtgctcgatttagagtgagctcgttggggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccacattgacgttggtgattataactttgtctcctggtaccaacaacaccaggacaaacgccccaaactcatcatttatgaagtctactaacgcgccctcgagggtatctaatcgcttctctcggtctcgaagtcgtggacaacgaccgccctccgtcgtaccgtctcgtcgccctaccagactggacggacgaggtctagtattattactcgacctactcatagtaagtaagtacgtactacgttcgtggttcggtttacgggacggtacggacctaagtccgtacggtacccgttccgtaggtccgacgcccgtaaggtccgtccggtacccccgtaggtcctaccgttcgttcccccgg

SEQ ID NO: 92311 - DNA, 595 bp, Homo sapiens
  misc_feature: GYAE6OF01DNWGN.14.33.C11.1.454.CMB.1.raw
  modified_base (181)..(181): a, c, t, g, unknown or other
  misc_feature (181)..(181): n is a, c, g, or t
  modified_base (194)..(194): a, c, t, g, unknown or other
  misc_feature (194)..(194): n is a, c, g, or t
  modified_base (595)..(595): a, c, t, g, unknown or other
  misc_feature (595)..(595): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaanattgacgttggtnattataactttgtctctgtaccaacaacacccagacaaacgccccaaactcatctatttatagaagtctactaagcggccctacgaggggtatctaatcgcttctctggctccaagtctggcaacaccggccctccctgaccgtctcgtcggcctccagactgacggacgaggctagattattactgaccactacatatagaagttaagtactactcttgtttcggtttcggacggaggaccgaagtctcgtaccgtcgttacggtcacgacccaagggcctccggcccccgttcggtacctaccgttcctccgtttaccccacccccgttccttccgtaacgtacgaccgtcgtcggacggccgggtccgtagggtaccgaacgggtccgacacgtaggn

SEQ ID NO: 92312 - DNA, 583 bp, Homo sapiens
  misc_feature: GYAE6OF01C8D84.14.33.C11.1.454.CMB.1.raw
  modified_base (219)..(219): a, c, t, g, unknown or other
  misc_feature (219)..(219): n is a, c, g, or t
  modified_base (248)..(248): a, c, t, g, unknown or other
  misc_feature (248)..(248): n is a, c, g, or t
  modified_base (265)..(265): a, c, t, g, unknown or other
  misc_feature (265)..(265): n is a, c, g, or t
  modified_base (284)..(284): a, c, t, g, unknown or other
  misc_feature (284)..(284): n is a, c, g, or t
  modified_base (304)..(304): a, c, t, g, unknown or other
  misc_feature (304)..(304): n is a, c, g, or t
  modified_base (360)..(360): a, c, t, g, unknown or other
  misc_feature (360)..(360): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccatgtctgggtctcctggacagtcgatcaccatctcctgcactggaaccagtagtgacgttggttattattaatttgtctctgtacaacngcaccagcaacgccccaaatcattattangagtcaatacgcgcctnagagtttcaatcgcttctntggctcaagtctggacaacncgcctcctgagcatctcgtggctcgagctaggacgagagctagatttatactgacngtctactatactaattatacgactaaggtaacttgggttcggttttcgggacggtaacggggacctaagggtcgtaacccgttcgtaacggtcgaacgacccgaaggccttccgacccccgttcgggtactccgttccgtccgttaccccggcccttcgtaccgtacgtacggaaccgtcggttacggaggccgggccgttagggaccgaacggcgcgtaacg

SEQ ID NO: 92313 - DNA, 506 bp, Homo sapiens
  misc_feature: GYAE6OF01B7PHE.14.33.C11.1.454.CMB.1.raw
  modified_base (487)..(487): a, c, t, g, unknown or other
  misc_feature (487)..(487): n is a, c, g, or t
  modified_base (502)..(503): a, c, t, g, unknown or other
  misc_feature (502)..(503): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctctggtaccaacaacaccaggcaaagcccccaaatcatcatttatgaagtctctaagcggccctcaggggtatctaatcgcttctctggctccaagtctggcaacacggcctccctgaccgtctctggcctccagacctgaggacgaggctgattatactgccactcatatagaagtagtactactcctgtgtttcggcggaggacagctcgacgtcctagtcacgccgaagctcgcccctcggtcactctcgtcccgcctcctctactctctcgctgngcggcgtggcgagcnngag

SEQ ID NO: 92314 - DNA, 753 bp, Homo sapiens
  misc_feature: GYAE6OF01CT9W0.14.33.C11.1.454.CMB.1.raw
tcagcgtctagtaccacgaccggtgctcgatttagagtgagctcgttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctctggacagtcgatcaccatctcctgcactggaaccaactattgacggttggtgtaatttattaactttcgtcttccgtggtaaccaacaacaccaggacaaacgccccaaactcactctaatttatagtaacgtcctacgtaacgccgacccttcgaaggggtacttcgtaaattccgctttcttcgtcggtcctaccgtaaagtccgtacggacctaaacccgccggtaccccttccccgtaccgtacccgttccttccgtcggtccccttaccgacgtaccgtacggaacggtacggtaacggtcttagtactttaacttacgtccgtaccctaaccgttactaacttaagttaaaggttaacgttaacgttaacccgttaccgtttaccgttcgggtttacgggtttttaccggggacgggtaacggggtaacccgaaaggtccgttaccggtaccccggttaccgttacgggaacccgtaccggtaccccggtaaacgggtcccgttaccccgggtacccccccttgggttacccctccggttccccgtttacccccg

SEQ ID NO: 92315 - DNA, 551 bp, Homo sapiens
  misc_feature: GYAE6OF01BSQS4.14.33.C11.1.454.CMB.1.raw
  modified_base (259)..(259): a, c, t, g, unknown or other
  misc_feature (259)..(259): n is a, c, g, or t
  modified_base (300)..(300): a, c, t, g, unknown or other
  misc_feature (300)..(300): n is a, c, g, or t
  modified_base (437)..(437): a, c, t, g, unknown or other
  misc_feature (437)..(437): n is a, c, g, or t
tcagcgtctagtaccacgaccggtgctcgatttagagtgagctcgttgggtttgggctctgctgctcctcaccctcctcactcagggcacagggtcctggcccagtctgccctgactcagcctgcctccgtgtctgggtctcctggacagtcgatcaccatctcctgcactggaaccaacattgacgttggtgtattataactttgtctctggtaccaacaacaccaggaccaaacgacccccaaactcatctatttangaagtctctaacgcgccctgagggtatctaatcgtcttctntcgctaccaagtctggcaacgacggccctcctcgaccgtctctcggcctcagactggaggacgaggctatagttacttacgtcgactactctatagtagtagtatactacttctgttggttcggacggaggacagcncgtaccgctagcacgacacgctccgccgtcgctactccgtccttcccacccttccgtacgtaccgtaggacctcggtagcggccggtacgtcgggacgacgggactcgagtgcg

SEQ ID NO: 92316 - DNA, 662 bp, Homo sapiens
  misc_feature: GYAE6OF01CCY68.14.33.C11.1.454.CMB.1.raw
  modified_base (239)..(239): a, c, t, g, unknown or other
  misc_feature (239)..(239): n is a, c, g, or t
tcagcgtctagtaccacgaccggtgctcgatttagagtgagctcgttgggtttggggggggtctcaggaggcagcgctctcaggacatctccaccatggcctgggctctgctgctcctcaccctcctcactcagggcacagggtcctgggcccagtctgccctgactcagcctgcctcgtgtctgggtctccgtggacagtcgatccaccatcctcctgccacgtacggaaaccaactnttggacgttggtgtaattataactttgtctcctggtaaccaacaaccaccaggacaaacgcccccaaactcatcatttatgaagtctactaagccggccctgagggtatctaactcgcttctctgtctacaagtctaggcaacgacggccctcccgtcgacccgttctccgtcggtccctaccgacgaccgtggacggacggacggtctaggtaatttaagttaccgtcgaccctaactactaattaagtaagtaaagttaacgttaccgttaccttccgttaggtttcgggttttaccgggccgggtaacgggtaacccgaaggtccgtacggtaacccggttccgttaaggtaccgaccgacccgtaaggcccgttcccggacccccccgttgtaccccttaccgttcccgtttacccccg

SEQ ID NO: 92317 - DNA, 630 bp, Homo sapiens
  misc_feature: GYAE6OF01C3VKR.14.33.C11.1.454.CMB.1.raw
  modified_base (307)..(307): a, c, t, g, unknown or other
  misc_feature (307)..(307): n is a, c, g, or t
  modified_base (364)..(364): a, c, t, g, unknown or other
  misc_feature (364)..(364): n is a, c, g, or t
tcagcgtctagtaccacgaccggtgctcgatttagagtgagctcgttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaaccaacattgacgttggtgtattataacttgtctcctggtaaccaacaacaccaggacaaacgccccaaactcatcaatttangaacgtctactaacgcgccctacgagggtactactaactcgctttctcgtcggtccncctaagtctcgggacaacgaccggccctccctcgaccgtctcgtcggtcctcagactgacggacgaggcctagtaagttacttacgtcgacctactcaatactaagtaacgtaacgttacctacgttccttaggttcggttttacggcgggtaacggtaaccgaagtccgtacgacccggttaccgtacgggtcctaacggaccccgtaacgggacccgttacccggtcccccgtacgggttcccaccgttcccgtttacccccgg

SEQ ID NO: 92318 - DNA, 662 bp, Homo sapiens
  misc_feature: GYAE6OF01A3I7E.14.33.C11.1.454.CMB.1.raw
  modified_base (327)..(327): a, c, t, g, unknown or other
  misc_feature (327)..(327): n is a, c, g, or t
  modified_base (343)..(343): a, c, t, g, unknown or other
  misc_feature (343)..(343): n is a, c, g, or t
  modified_base (387)..(387): a, c, t, g, unknown or other
  misc_feature (387)..(387): n is a, c, g, or t
tcagcgtctagtaccacgaccggtgctcgatttagagtgagctcgttgggtttgggctctgctgctcctcaccctcctcactcagggcacagggtcctggcccagtctgccctgactcagcctgcctccgtgtctgggtctcctggacagtcgatcaccatctcctgcactggaaccaacattgacgttggtgtatttataactttgtcttccgtaggtaccaaacaaccacccgaggaccaaacgcccccaaactcatactattatgaagtctactaagccggccctgagggtatctaatcgcttctctgctcagtctaggcaacncgcctcctgacccgtntccgtcggcctccagacgtgacgacgaggctagtattacttcgngcacgcttacaatacttaacgtattacgcgtaagtaacgttggtttaggtttaccggggacggacgggtaaccgagggtaccggtaccggtacccgttaaggactaccgacccggtaacggtccctaccggccccccgtttacgggtaccctaccgtttccgttcccgtttacccccgacccttttccgttaccgttaacccgtaccggtaccgtccgtaggtacccgggacgggtcccgttacgggaccggtacggaccgaccgttagtacgcg

SEQ ID NO: 92319 - DNA, 594 bp, Homo sapiens
  misc_feature: GYAE6OF01BXH8P.14.33.C11.1.454.CMB.1.raw
  modified_base (525)..(525): a, c, t, g, unknown or other
  misc_feature (525)..(525): n is a, c, g, or t
tcagcgtctagtaccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtcccccttcgcagtaacaccaagtacaggaatattaacctgtttcccatcgactacgcctttcggcctcgccttaggggtcactcaccctgccccgattaacgtggacaggaacccttggtcttccggcgagcgggtcttttcacccgtctttatcgttacttatgtcagcatttcgctacttctgactacctccagcatcgcctcacagcactaccttcacaggcttacacgaaccgcctccccaaccaacaacgcaataacgcgtcgctcgcccgcacgccgttcggtncgtacgttgggtttaccgtccccgtttcacttcccttccccgctacttctagacgttacgtaggtaccg

SEQ ID NO: 92320 - DNA, 513 bp, Homo sapiens
  misc_feature: GYAE6OF01BZWQ0.14.33.C11.1.454.CMB.1.raw
  modified_base (364)..(364): a, c, t, g, unknown or other
  misc_feature (364)..(364): n is a, c, g, or t
  modified_base (424)..(424): a, c, t, g, unknown or other
  misc_feature (424)..(424): n is a, c, g, or t
  modified_base (509)..(509): a, c, t, g, unknown or other
  misc_feature (509)..(509): n is a, c, g, or t
  modified_base (513)..(513): a, c, t, g, unknown or other
  misc_feature (513)..(513): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaacgccccccaaactcatcatttatgaagtctctaagcggccctcgaggggtatctaatcgcttctctggctccaagtctggcaacacggcctccctgaccgtctctgccctcagactgaggacgaggctntattattactcgccactcatatagaagtatactactctgtggtttcggcggaggacagcngaccgtctaggtcagccagctcgcccctgtcactctcgttcccgcctcctcgtactacgcgctgcgcgggcgtggcgaaggcacngtgn

SEQ ID NO: 92321 - DNA, 586 bp, Homo sapiens
  misc_feature: GYAE6OF01BKIK9.14.33.C11.1.454.CMB.1.raw
tcagcgtctagtaccacgaccggtgctcgatttagagtgagctcgttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaactattgacgttggtgtattataactttgtctctggtaccaacaacaccaggcaaacgacccccaaactcatcatttatgaagtctctaagccggccctgagggtatctaatcgtcttctctgctcagtctggcaacgacgccctccgtgacccgtctcgtcggcctccgagactgaggacgtaggctaggtattacttacgtcgacctacctctacttagtaacgtaagttacttactacttccgtggtttcggttttacgggcggtaacgggacctagtccgtacggtacccgtcgtaggtccgacggacccgtaacggcctccggcccccgttacggtcctccgtcgttcccccg

SEQ ID NO: 92322 - DNA, 811 bp, Homo sapiens
  misc_feature: GYAE6OF01DZEAM.14.33.C11.1.454.CMB.1.raw
tcagcgtctagtaccacgaccggtgctcgatttagagtgagctcggttggggtttgggggggggtctcaggaggcagcgctctcaggacatctccaccatggcctgggctctgctgctcctcaccctcctcactcagggcacgagggtcctgggcccagtctgccctgactcacgcctgcctcgtgtcgtgggtcctccgtggactagtcgaactccacctatcctcctgccacgtacggaaaccaactagttaggacggtttgggtataatttaacttaactttcgtcctccgtacggtaaccaaacaaccacccgaagaccaaaccgacccccaaactcgatacctaatttatacgtaagtcctacgtaacggccggtacccgttacgtaaggggttactaactaacgtcgttccttacgtcgtacgtaccttaccgtaaacggtcgtacggaacctaaccgtacccgggtacccttccccgtcgtacccgttccgttccgttccggtacccttaccgaacgtaccgtagggaacggtaacggacggtacttagtaactttacgttacctacgtacctactactaagttaacgttaaggtaaacgtttaacgttaaccgttaccgtttacggttcgggttttacgggttaacccggggtacgggtaaaccgggaaccgtaacgggttccgtaaccgggtaacccggttaccggttaacgggtacccgaaccggtaccccggtaaaccgggcccttaccccgggtccccccgttacgggtaacccttcccgttcccggtttaccccccgg

SEQ ID NO: 92323 - DNA, 599 bp, Homo sapiens
  misc_feature: GYAE6OF01DQQ57.14.33.C11.1.454.CMB.1.raw
  modified_base (253)..(253): a, c, t, g, unknown or other
  misc_feature (253)..(253): n is a, c, g, or t
  modified_base (589)..(589): a, c, t, g, unknown or other
  misc_feature (589)..(589): n is a, c, g, or t
  modified_base (599)..(599): a, c, t, g, unknown or other
  misc_feature (599)..(599): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattatactttgtctcctgtaccaacaaccaccagacaaacgccccaaatcatcatttanagaagtctactaacgccggccctcgaagggtatactaatcgtcttctctcggcctaccaagtcgtcggaccaaccgaccggcccttcccgtcgtacccgttctccgtcgccctcagtacgtggaggacgtaggtcctagtactttatacctcgacctactacaattagtaagtaagttactaccttacttccgtggtttcggttacgggacggtacggacctaagcgtacgaccgtcgtagtcgacgccgagcctacccggccctgtcctcttcgtccgttcccaccctcgtacgtacgtacgccgtagtggacggtccggtagtcggacgaacgntacgagtcgn

SEQ ID NO: 92324 - DNA, 252 bp, Homo sapiens
  misc_feature: GYAE6OF01DV3E6.14.33.C11.1.454.CMB.1.raw
  modified_base (249)..(252): a, c, t, g, unknown or other
  misc_feature (249)..(252): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccaccctcctcgtatctctcgctgagcgggctggcaaggcgcatagnnnn

SEQ ID NO: 92325 - DNA, 252 bp, Homo sapiens
  misc_feature: GYAE6OF01ESXGL.14.33.C11.1.454.CMB.1.raw
  modified_base (247)..(252): a, c, t, g, unknown or other
  misc_feature (247)..(252): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggtttcggcggaggaccaagctgaccgtcctaggtcagcccaaggctgccccctcggtcactctgttcccaccctcctcgtactagacgctgagcgggctggcaaggcgcatagnnnnnn

SEQ ID NO: 92326 - DNA, 925 bp, Homo sapiens
  misc_feature: GYAE6OF01DHG6N.14.33.C11.1.454.CMB.1.raw
tcagcgtctagtaccacgaccggtgctcgatttagagtgagctcgttgggtttgggctctgctgctcctcaccctcctcactcagggcacagggtcctggcccagtctgccctgactcagcctgcctccgtgtcgtgggtctcctggacagtcgatcaccatctcctgcactaggaaccaacattggacgttggtgtatttattaactttgtcctcctcggtaaccaacaaccacccgaggaccaaaaccgacccccaaactcacttactagtttatagtaacgttcctacgtaacggccggtcccgtacgtacggggttactacgttaactccgtcttccttccgtcggtacctaccgtaacgtccgtacggaccaaccgtaccggtccccttcccgtaccgtacccgttccgttccgtccggtacccttaccgaacggtaccgtaggaaccgggacggtaacgggtaccttagtaacgttttaactttaccgtaccgtacccctaacgttacctaattaaacgttaaacgtaaacggtttaaccgtttaacccttaaccgtttcccggttttagggttttaccggggtttttaccggggacggggtaaaccgggtaaccgtaaaccgggttccgttaaccggtaaccccggtttacccggttaaccgggtaccggtaaacccgggtaccccggtaaacggttccccggtacccccggttacccccccggtttacccgggttaccctacccggtttccccgttccccggttaccccccggttaccccgtttacccccgttacggttaaccccggttaaccggtacccggtaccggtttacccggggaaccggggttccccggggtacccggtaaccggggtacccgggtaaaccgggtacccggtaacccgtaaggttagggcc

SEQ ID NO: 92327 - DNA, 789 bp, Homo sapiens
  misc_feature: GYAE6OF01CNZYH.14.33.C11.1.454.CMB.1.raw
tcagcgtctagtaccacgaccggtgctcgatttagagtgagctcgttgggtttggggggggtctcaggaggcagcgctctcaggacatctccaccatggcctgggctctgctgctcctcaccctctcactcaggcacgagggtcctgggcccagtctcgccctgactcagcctgcctcgtgtcgtggtctccgtgacagtcgatcacatcctctgcacgtacgaaccaactattaggtacggttaggtagtaatttaacttaacgttttcgtaccttccgttacggtaaccaaaccaaccaacccgaggaaccaaacccgtacccccctaaaacctcctaactacctaattttacgtacgtaaacgttacctacgttaacggacccggtaccccgttacggtaacggggttactacgtaaccgttcgtccttcgtcgtacggtctaccgtaacggtcgtacggaccaaccgcccggtccctaccgtcgtacccgttctcgtccggtccctaccgacgtacgtaggacggtacgtaacgtcgtagttacttacgttaccaccgtacctaccttagtaactaacgttaaacggtaacgttaaaccggttaccttacccgttcgttaggggttttaccggtttacccggggacggtaacgggtaacccgtaaggtccgtaaccgggtaccccgttaacggtaccggtaaccgtaacccgaccccgggtaaacgtcccggttcccccgtacccccggttacgtacccccgttcctcccgggtttacccccccg

SEQ ID NO: 92328 - DNA, 254 bp, Homo sapiens
  misc_feature: GYAE6OF01DHRP2.14.33.C11.1.454.CMB.1.raw
  modified_base (252)..(254): a, c, t, g, unknown or other
  misc_feature (252)..(254): n is a, c, g, or t
tcagcgtctagtaccacgaccggtgctcgatttagagtgagctcgttgggtttggggggtgtggtggtctccactcccgccttgacgaggctgattattactgccactcatatagaagtagtactactcctgtggttttcggcggagggaccaagctgaccgtcctaggtcagcccaaggctcgccccctcggtcactctgttccccaccctcctcgtactagacgctgagcgggctggcaaggcgcatagnnn

SEQ ID NO: 92329 - DNA, 266 bp, Homo sapiens
  misc_feature: GYAE6OF01EX6UE.14.33.C11.1.454.CMB.1.raw
  modified_base (251)..(266): a, c, t, g, unknown or other
  misc_feature (251)..(266): n is a, c, g, or t
tcagcgtctagtaccacgaccggtgctcgatttagagtgagctcgttgggtttggggggtgtgggtggtctccactcccgcttgacgaggctgattattactgccactcatatagaagtagtactactcctgtggttttcggcggagggaccaagctgaccgtcctaggtcagcccaaggctgccccctggtcactctcgttcccaccctcctcgtactacgacgctgagcgggctggcaaggcgcatagnnnnnnnnnnnnnnnn

SEQ ID NO: 92330 - DNA, 694 bp, Homo sapiens
  misc_feature: GYAE6OF01BCT3M.14.33.C11.1.454.CMB.1.raw
  modified_base (251)..(251): a, c, t, g, unknown or other
  misc_feature (251)..(251): n is a, c, g, or t
tcagcgtctagtaccacgaccggtgctcgatttagagtgagctcgttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtgacagtcgatcaccatcctcctgacacgtaggaaaccaactattgacgtttggtanaactttaattaactttgtcctccgtacggtaaccaaacaacaccaaggcaaaacgcccccaaatcaactctatttacagtaacgtactacgtaacgccggtaccctacggaacgggtactccttaaagccgttccttcctcgttaggccctaccaagtttccgtacggacctaaccggacccggtccctcccgttacgtcccgtcttcgttccggcccttacgacgttacgaggtaacggaccgtaaggtccgttaagtaactttaacgtactcggacctactaacgttaataactaaaggtaaccgttacgttaactaaccgttccgtttaaggttcggggtttacgggacggaacgggtacacggtccgtagtacccgtcgttagaccgtacggaccctaccggcttacccgcccccgttaggtcctacgtcccttacccg

SEQ ID NO: 92331 - DNA, 753 bp, Homo sapiens
  misc_feature: GYAE6OF01CNJU3.14.33.C11.1.454.CMB.1.raw
  modified_base (559)..(559): a, c, t, g, unknown or other
  misc_feature (559)..(559): n is a, c, g, or t
  modified_base (571)..(571): a, c, t, g, unknown or other
  misc_feature (571)..(571): n is a, c, g, or t
tcagcgtctagtaccacgaccggtgctcgatttagagtgagctcggttggggtttgggggggggtctcaggaggcagcgctctcaggacatctccaccatggcctgggctctgctgcctcctccaccctcctcactcgagggccacgtacgggtcctcgggcccagtctcgccctgactcacgcctcgcctcgtgtcgtcggtctcgtggacagtcgactccacctatcctctcgacctacgtacggaaaccaagtagttacgtacggttggtagttaactttaactttaccgttttcgtaccttaccgtacggtaaaacccaaaccgaacccaacccggaacggaaccaaaaccccgtaccccctaaaatctaacttacttaattacacgtaactcctaacgtacgccgtacctagggtaggtactactactcgtccttcgtcgtcgtactacgtacgttcgacgaaccaaccgtcccgtcctccgtacgtcctcgtccgtacgaccctacggacgtcggtagggaacggacgtacgtacttagtaactttacgtccnccgtactactanaacgttaagtaacgtaacgttacttaccgttacgttccggtttagggttacgggttaccggacgggaaccgtactacgggtccgtaccggtacccgttacgggacgaacccgccggtaaccggtacccggttccctaccccccggtcccgttaccggtcctacccgtttcccggtacccccc

SEQ ID NO: 92332 - DNA, 755 bp, Homo sapiens
  misc_feature: GYAE6OF01C6USA.14.33.C11.1.454.CMB.1.raw
  modified_base (255)..(255): a, c, t, g, unknown or other
  misc_feature (255)..(255): n is a, c, g, or t
tcagcgtctagtaccacgaccggtgctcgatttagagtgagctcgttggggtttgggggggtctcaggaggcagcgctctcaggacatctccaccatggcctgggctctgctgctcctcaccctcctcactcagggcacgagggtcctgggccccagtcctcgccctgactcagcctgcctcgtgtcgtgggtctccgtggacaggtcatcaccgattcctctgccacgtacgaaccatagttcgtaagttggtntaattaacttacttgtcctcgtacgtaaccaacgaaccaccgacgaaccaacccgaacccctaactacctatacttaagtttatagtaacttcgtactaacggccggtacccgtacggtaagggttactacgtaacgttcgttctttcctcgtcgtctacgaacgttcgccggaactaaccgtccgcccttcgtacgtacgttccctacgtccgtaccttaccgacggtacggtacgggaacgaacgggtacggtacttacggttaactttacgtaccgtcgtaacccgttacctaagtaacgtaagtaacggttaacgtaaccgttcttaaccgtcgtttaacgggtttcgggtttaccggacggggtaacggtaaaccgtcgtaccggttaccggtacccggttacggtaccgggtacctacccgggtacggtaacccggttcccgtacccccgggtcccggttacccggtaaccttcccgttcccgttacccccggg

SEQ ID NO: 92333 - DNA, 623 bp, Homo sapiens
  misc_feature: GYAE6OF01CL5A5.14.33.C11.1.454.CMB.1.raw
  modified_base (196)..(196): a, c, t, g, unknown or other
  misc_feature (196)..(196): n is a, c, g, or t
  modified_base (366)..(366): a, c, t, g, unknown or other
  misc_feature (366)..(366): n is a, c, g, or t
  modified_base (391)..(391): a, c, t, g, unknown or other
  misc_feature (391)..(391): n is a, c, g, or t
  modified_base (527)..(527): a, c, t, g, unknown or other
  misc_feature (527)..(527): n is a, c, g, or t
tcagcgtctagtaccacgaccggtgctcgatttagagtgagctcgttgggtttgggcgtctgctgctcctcaccctcctcactcagggcacagggtcctgggcccagtctgccctgactcagcctgcctccgtgtctgggtctcctggacagtccgatcaccatctcctgcactggaaccaacattgacgttggtntattataacttgtctcctggtaccaacaacaccaggacaaacgcccccaaatcatctatttatgaagtctactaagcgccctcgaggggtactctaatcgcttctctcggctaccgagtctcggacaaccgtcggccctcccgtgaccgtctcgtcgcctccagtaccgngacggacgagctagtattacgttcngtccactcaattacgtaagtaagttaacgtacttaccttccgttggtttacgggtttcggacgggtagggacctaggcgtacgtaccgtacgtacgtcgaaccgtaccgagtccgtaccgtcccccgtgttacccncttccgtcgttacctcccgtaccctacccgttcctaacggtacgacccggtcgtcggaccgggtcggtccgtcggaacgtaccgggctcgaagtcg

SEQ ID NO: 92334 - DNA, 722 bp, Homo sapiens
  misc_feature: GYAE6OF01D18YY.14.33.C11.1.454.CMB.1.raw
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgtattataactttgtcctcctaggtaccaacaaccacccaggtacaaacgcccccaaactcatctattatagtaagtctactaagccggtaccctgtaaggggtatactaatcgtacttcctcgtggcctaccgaagtctggaccaacgccggtcctcctcgaccgtctcgtacggccctacgagactaggacggacgaggtctgaatttacttacgcgcctactcaatagtaacgtaattacgtaactacttcgttgggtttcgggtttacgggacggaacgggtaaccgtaagtccgtacggtaccccgtcgttaacgggtacctacggaccccggtaaggtcccgttacccggtccccccggttacggttccctaacccgtttcccgtttacccggttccccccaacccccgtttacccgtttacccggtacctttcccggtttaccccgtaggttacccgttacggggacgggtcccggggacccgttaacggggacccggaacggtacccggtagtaggtacgg

SEQ ID NO: 92335 - DNA, 636 bp, Homo sapiens
  misc_feature: GYAE6OF01CXONO.14.33.C11.1.454.CMB.1.raw
  modified_base (137)..(137): a, c, t, g, unknown or other
  misc_feature (137)..(137): n is a, c, g, or t
  modified_base (224)..(224): a, c, t, g, unknown or other
  misc_feature (224)..(224): n is a, c, g, or t
  modified_base (252)..(252): a, c, t, g, unknown or other
  misc_feature (252)..(252): n is a, c, g, or t
  modified_base (395)..(395): a, c, t, g, unknown or other
  misc_feature (395)..(395): n is a, c, g, or t
  modified_base (444)..(444): a, c, t, g, unknown or other
  misc_feature (444)..(444): n is a, c, g, or t
  modified_base (486)..(486): a, c, t, g, unknown or other
  misc_feature (486)..(486): n is a, c, g, or t
  modified_base (532)..(532): a, c, t, g, unknown or other
  misc_feature (532)..(532): n is a, c, g, or t
tcagcgtctagtaccacgaccggtgctcgatttagagtgagctcgttggggtttggggggggtctcaggaggcagcgctctcaggacatctccaccatcggcctgggctctgctgcctccctcaccctcctcactcngggcacgagggtccgtgggcccagtctcgcctgactcagcctgccctcgtgtcgtggtcctccgtggacagttcgaactccaccgtntccgtcctgactacgtacgaaaccagtnttggacgttggtatattacttacgttgtcctcgtacgtaaccaaccaacaccgagacaaaccgaccccaaactcactactattatatacgtctacgagccggtcctacggaggtactactatcgtctttcacgtcgactaccncgtacgtcggaccaacgccgtcctcccgtacgccgttctcgacgtcccncgaagtcgacggcgtacgcgtactgttattactcgcactacnatactaagtaatacgttactaccgttcgtggtttcgggttaccggngggtaacgaacgtaccgcgttacccggtaccgtacggtaggtaccgacggaaccccgtagcccgttcccggacccccttggtaccctccggttccgttcccccg

SEQ ID NO: 92336 - DNA, 255 bp, Homo sapiens
  misc_feature: GYAE6OF01DHX7P.14.33.C11.1.454.CMB.1.raw
  modified_base (248)..(255): a, c, t, g, unknown or other
  misc_feature (248)..(255): n is a, c, g, or t
tcagcgtctagtaccacgaccggtgctcgatttagagtgagctcgttgggttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccaccctcctcatactagacgctgagcgggctggcaaggcgcatagnnnnnnnn

SEQ ID NO: 92337 - DNA, 734 bp, Homo sapiens
  misc_feature: GYAE6OF01ANJPW.14.33.C11.1.454.CMB.1.raw
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
  modified_base (259)..(259): a, c, t, g, unknown or other
  misc_feature (259)..(259): n is a, c, g, or t
tcagcgtctagtaccacgaccggtgctcgatttagagtgagctcgttgggtttgggggggtcgtcgaggaggcgagcgctctcaggacatctccaccatggcctgggctctgctgctcctcaccctcctcacgtcacgggcacacgggtccctgggcccctagtctcgaccctgactccagcctgcctcgtgtctgggtctactnaactgtcatcaccagtcctcctgacactaggaaccactntttgacggtttggtnaatttattactttcgtacttcctacggtacctaactaaccgaccacgacaaccgaccccgaacctactactactattatacgagttactacgtaacgcccgtacgtcctaacgggtactaccgtaatcgtcttactcgaggtcccacgtactacgttcgactaacacccgtccctaccgtacgtaccccgttcgttcctaccggtcctaccccgtaggaacccgttcggaacggtaccgaacgggtccctaggtttaaccgtttacgttaacgtcgttaacccgacccgttaagaaccgttaagtaacggtaacgttaaccggttaacttacccgttaccgttaggtttaccgggttacgggtaccgtaggggtaaacccagggtcctaaccgggtcccgttaccgtaacgttccggaaaccgtaccggtacgacccgtccggtacccccttacgtaccgtctacccggttcccg

SEQ ID NO: 92338 - DNA, 731 bp, Homo sapiens
  misc_feature: GYAE6OF01E2EZY.14.33.C11.1.454.CMB.1.raw
  modified_base (232)..(232): a, c, t, g, unknown or other
  misc_feature (232)..(232): n is a, c, g, or t
  modified_base (680)..(680): a, c, t, g, unknown or other
  misc_feature (680)..(680): n is a, c, g, or t
tcagcgtctagtaccacgaccggtgctcgatttagagtgagctcgttggggtttgggggggggtctcaggaggcagcgctctcaggacatctccaccatggcctgggctctgctgcctcctcaccctcctcactcagggcacgagggtcctgggcccagtctcgccctgactcatcctgccctccgtgtcgtcgggtcctccgtggacacgtcgatccaacctatcctcctnctacctacggaaaccctactagttcggtacgtttggtataacttttaacttaacgtttcgtcttccgttacggtaaacccaaacaaccaaccgtaggaaccaaaccgtccccccaaaactccgtaataccgttaatttagtaacgtaacggttacctaacgtaacggtcccggtacccctagggacgggttaacttacgtaaactccgtctttactcgtacgtccctaacgaagtccgtaggacctaaccgaccgtccctaccgtcgtaccctcgtaccgttcggccctaccgacgtaacgtacggaacggacgtacgggtcttaacgttacgttaacttaccgtcgaaccctataactagtaactaagtaagttactaactacgttacggttggttacgggttccggacggaccggactaacgtcgtacggaccgtacgtacggacncccggaacctacggcccgtaccctccctaccgtcctacgtccggtaccccg

SEQ ID NO: 92339 - DNA, 718 bp, Homo sapiens
  misc_feature: GYAE6OF01EEPSI.14.33.C11.1.454.CMB.1.raw
  modified_base (259)..(259): a, c, t, g, unknown or other
  misc_feature (259)..(259): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttgtgattataacttgtctcctgtaaccaacaaccaccgaggacaaacgcccccaaactcactctatttancgtaagtctactaagccgcctcgagggtatctaactcgcttctcgtgtcctacaacgtctcggacaacgacggcctccgtcgaccgtctctcggcctccagacgtaggacggacgacggcgtagtattattacgtcgtaccacgttactaattacgtaacggtaagttaccgttaacctaaccttcccgtttaggtttacgggttttaccggggaacggggtaaccgggaacccgtaacgtaccgtaccgtacccggttaccgtaacggttaccacggaccccgaaggtacccgtacccggtcccccgttacggttaccctaaccgttcctttacccggttccccgtaccccgttcccggttacccgttaaccgtaccggaccggttaccgtacggggtacccgggaccggggttacccgacggggtccggaaacggggccgaaccgttaagccgtacg

SEQ ID NO: 92340 - DNA, 255 bp, Homo sapiens
  misc_feature: GYAE6OF01ECXU9.14.33.C11.1.454.CMB.1.raw
  modified_base (243)..(243): a, c, t, g, unknown or other
  misc_feature (243)..(243): n is a, c, g, or t
  modified_base (249)..(255): a, c, t, g, unknown or other
  misc_feature (249)..(255): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactctgtggtttcggcggaggaccaagctgaccgtcctaggtcagcccaaggctcgccccctcggtcactctcgttcccacctcctcgtactagacgctgacgcgggctggacaaggcncatagnnnnnnn

SEQ ID NO: 92341 - DNA, 654 bp, Homo sapiens
  misc_feature: GYAE6OF01CXOT6.14.33.C11.1.454.CMB.1.raw
  modified_base (228)..(228): a, c, t, g, unknown or other
  misc_feature (228)..(228): n is a, c, g, or t
  modified_base (255)..(255): a, c, t, g, unknown or other
  misc_feature (255)..(255): n is a, c, g, or t
  modified_base (313)..(313): a, c, t, g, unknown or other
  misc_feature (313)..(313): n is a, c, g, or t
  modified_base (470)..(470): a, c, t, g, unknown or other
  misc_feature (470)..(470): n is a, c, g, or t
tcagcgtctagtaccacgaccggtgctcgatttagagtgagctcgttggggtttggggggggtctcaggaggcagcgctctcaggacatctccaccatggcctgggctctgctgcctcctcaccctcctcactcagggcacgagggtcctgggcccagttctgccctgacctcagtcctgcctccgtgtcgtgggtcctccgtggacaggtcgatccacatccgtccngcacgtcggaaccatattgacgttggntattatactttgctacgtgtaccaacacgaccagacaaacgccccaatcatctattancgtaactctacgaagccggtaccctcggtagggttactacgtaactcgtctttactcgtacggccttaccgtaagtcgtagaccaaccgtcggtccctccgtacgtcctacgtcgtacgtccctaccgagtacgtaggacggagtacgtacgtagtnttacgtactacctacctaacgtactaagttaagtaacgtaacgttactaacgttaccgtgttcgggtttacggttccggggagggtaaccgtaacgtacgtcgtaccggtacccggttcgacggttaccaccggtcccggaacgtccgtacccgacccgttcgtactccgttcccgttaccccg

SEQ ID NO: 92342 - DNA, 667 bp, Homo sapiens
  misc_feature: GYAE6OF01BHI96.14.33.C11.1.454.CMB.1.raw
  modified_base (189)..(189): a, c, t, g, unknown or other
  misc_feature (189)..(189): n is a, c, g, or t
  modified_base (208)..(208): a, c, t, g, unknown or other
  misc_feature (208)..(208): n is a, c, g, or t
  modified_base (228)..(228): a, c, t, g, unknown or other
  misc_feature (228)..(228): n is a, c, g, or t
tcagcgtctagtaccacgaccggtgctcgatttagagtgagctcgttgggttgggggggtctcaggaggcagcgctctcaggacatctccaccatggcctgggctctgctgcctcctcaccctctcactcagggcacgagggtcctgggcccagtctcgcctgactcagcctgcctcgtgtctgggtcnccgtgactagtcatcactntctctgctactagaaccatnttgtacgttgatactttataacttgtctctagtaaccaactacaccgagaccaaccgaccccaaatcactactatttcgatacgtctacgtacgccggtctacggtaggttactacgtaactccgtctttacgtcgtcgtccttacaacggtcgtacggactaaccgccgtaccctccgacgtaccctcgtacgtccgccttaccgacgtacgaggaacggtcggtacggtacttacgttaatttaccgttaccgtacgtacccttaagttactaagtaaccttaagggtaaccttaaggttacccttaaccggtcgttttaacgggttccggttacgggaccggtaaggacttacggtcgtaacggtcccgttcgtaacgtccgaccgtaccgtacgggccttacccggcccgtagttccctcgtccgtttaccccgg

SEQ ID NO: 92343 - DNA, 708 bp, Homo sapiens
  misc_feature: GYAE6OF01BT9KD.14.33.C11.1.454.CMB.1.raw
  modified_base (303)..(303): a, c, t, g, unknown or other
  misc_feature (303)..(303): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctccgtggtaccaacaacacccaggaccaaacgacccccaaactcatcatttatgaatctactaagccggccctgaggggtatctaatcgctttcncgtcggctccaagtcgtcggaccaacacggtccctccgtgaccgttctcgtcggccctaccgagtaccgtggaacggacgaggtctagtaattattactcgtaccctactactaagttaacgtaagtaacgtttaacgttaacttaaccgttccgtttagggtttcgggttttaccggggacgggtaacgggaaccctaaggtccgttaccgaccgttccgttaacgggtaccaacggtacccccgtaaagggcccttccccggaccccccgttcggttacccttaaccgtttcccgttaccccgttccccctaacccgttccccgttaacggttaccgttaacgaccggtacgttacggacggggtccgtcggtacgggaccggaacgggccgactaagtggac

SEQ ID NO: 92344 - DNA, 779 bp, Homo sapiens
  misc_feature: GYAE6OF01DLZS0.14.33.C11.1.454.CMB.1.raw
tcagcgtctagtaccacgaccggtgctcgatttagagtgagctcgttgggtttgggctctgctgctcctcaccctcctcactcaggtcacgagggtcctcgggcccagtctcgccctgacctcgagcctcgcctccggtgtcgtcgggtcctccgtggacagtcgactcaccatcctctgcacgtcgaaacactagttcggtacgttggtagtattagttaactttcgtctacgtacgtaaccaacaaccaccgagaccgtaaaccgacccctaaactcgtactctattagtagtaacgtcctacgtacgccggtccgtacggtacggtactacgtaacgtcgtccttaccgtcgtacggacctaccgtaacgtcgtacggacctaaccggtccggtccctccgtacggtccgttctccgacggtccctacacggtacgtacgggaacgggtacgacggttacttacggtaactttacgtccgtaccgtacctactacaagttacgtaacggtaacgtaccgttaaccttacgttcggttggtttacgggttacgggacggtaccggtaacgtacgtacggtaccgtaccggttacgtaacgtaccgtaccggacccgtaccggtacccgtccccggtaccccgttacggtacccgttccgttccgttccccgttacccccgttcccgttaccggttaccggtaccgttacggtaccggtcggtacggtacgggaccgggtcggtacggtaccggtaacggacgtacgtacgttcgacg

SEQ ID NO: 92345 - DNA, 896 bp, Homo sapiens
  misc_feature: GYAE6OF01BXATL.14.33.C11.1.454.CMB.1.raw
  modified_base (476)..(476): a, c, t, g, unknown or other
  misc_feature (476)..(476): n is a, c, g, or t
tcagcgtctagtaccacgaccggtgctcgatttagagtgagctcgttgggtttgggctctgctgctcctcaccctcctcactcagggcacgagggtcctgggcccagtctgccctgactcagcctgcctccgtgtcgtgggtctcctggacagtcgatcacatctcctgctacgtagaaccaactagttgacgttggatattagtaactttgctcctaggtaaccaacaaccaccgacggacaaaaccgtccccaaatctaagtactaattttaacgagtaacgtcctaacgtaaggcccggaccgtaggtaacggggtattacctaaagtcgtaccttacgtacgtggtaacctaccgtaaacggttcggacggaaccctaaccggacccggtcccttacccgtagtacgtaccgtaacgttccgttcggtaccggtaccctacggaaccggtcgtaagggacgggtaaaccggnggttaccgttaggtaaattttaccgacgtagtaccgtagtaccttaacgtaagtttaacttaaacgttaacgttaaaggtacccgtaaaggttaacggtttagggttttacccgggtttaccggggaccggggtaaaaccggggttaaactaacgggggtttaaccctaacggggtttacccgtaaacggggttacccgaaacggttaacccccgggtaaacggttcccggtaacccccgtttcccccgggtttagtaaccccggtttaactttccccggttaacccgtttaacccccccgacccgtttaccgggttaaaccggtaaccggttaaccgggtaccgggtaacccgtagggaccgggttaccgggggtaactacgggggaacccttaacggggtcccgtaaaggtaacccgg

SEQ ID NO: 92346 - DNA, 900 bp, Homo sapiens
  misc_feature: GYAE6OF01DX6OB.14.33.C11.1.454.CMB.1.raw
tcagcgtctagtaccacgaccggtgctcgatttagagtgagctcgttgggtttgggctctgctgctcctcaccctcctcactcagggcacagggtcctgggcccagtctcgccctgactcagcctcgcctccgtggttcgtcgggtctccgtggacagtcgactccaccatcctcctgacacgtacggaaccaacgtagttggtacggtttggtagttaactttaacgtttaaccgttttgttcccttaccgttacgggtaaacccaaaccaaacccgacccgaacggaacccgtaaaccccgaacccccctaaacttacctacttaccttaacgttttaacgtaggtaaaccgttacctaacgtaaccgggcccggtaccccgttaacgggtaacggggttaacttaaccttaaacgttccgtacctttcgtccgtacggtccttaaccgtaacggtccgtacggacccaaccggtacccggtccccttccggtaccgttacccgtttccggtccgtaccggtaccctaccgtacggacgtacgggaacgggacggtacgtacgtacgttatttaacgtactaccgtacctactacgtaagttaacgtaaggtacgtaacgttaccttacgttccggtttgggtttacgggttaccgggagggtaaccggtaacgtacgtcggtaccggtacccgttcggttaacggacgaccgaccgtaccgttcccggtacccgtccccggttacgttacccgttaccttccccgttaccccgttacccccgtacccgttaccgttacccgtaaccggttaaccggtccggttacggaccggggttaccggggacggggttacccgacgggttaaccgggacggttacccggtaacgtcgtggaccg

SEQ ID NO: 92347 - DNA, 749 bp, Homo sapiens
  misc_feature: GYAE6OF01BZLQ6.14.33.C11.1.454.CMB.1.raw
  modified_base (251)..(251): a, c, t, g, unknown or other
  misc_feature (251)..(251): n is a, c, g, or t
  modified_base (325)..(325): a, c, t, g, unknown or other
  misc_feature (325)..(325): n is a, c, g, or t
  modified_base (461)..(461): a, c, t, g, unknown or other
  misc_feature (461)..(461): n is a, c, g, or t
tcagcgtctagtaccacgaccggtgctcgatttagagtgagctcgttgggtttgggggggggtctcaggaggcagcgctctcaggacatctccaccatggcctgggctctgctgctcctcaccctcctcactcgagggcacagggtcctgggccagtctgccctgactcagcctgcctcgtgtcgtgggtctctggacagtcgatcaccactctcctgctacgtacgaaaccaactattggtacgttggtntattattaacgtttgtcctcgtacggtaccaactaaccaccgagacaaaccgcccctaaatcatactatttagngtacggtacaagtaacgtccggtccttaggtacgggtttactacgtcgtcttctacgtcgtctactagttctacggacctaaccgaccggtccctacccgtacgacctacttccgtacggtcggcccttaaccggnggtacgtacgggtaaccggtacggtacgttacgttaggtttaattttagtttaacggtcgtaccgtacgtaccttacaacgttacgtcggtacccgttaaccgcgggtaacctagtaccgttaacgttacgttaacgggttcgggttttaccggggggtttaccggggggacccggggttaacgggtaaacgggttcccggttaaccccgggttcgggtaaccggttaccgaacccgggtacccggtaacggttccccgtccccggtaccccggttccggttaccccg

SEQ ID NO: 92348 - DNA, 693 bp, Homo sapiens
  misc_feature: GYAE6OF01B9S02.14.33.C11.1.454.CMB.1.raw
  modified_base (143)..(143): a, c, t, g, unknown or other
  misc_feature (143)..(143): n is a, c, g, or t
  modified_base (206)..(206): a, c, t, g, unknown or other
  misc_feature (206)..(206): n is a, c, g, or t
  modified_base (347)..(347): a, c, t, g, unknown or other
  misc_feature (347)..(347): n is a, c, g, or t
  modified_base (406)..(406): a, c, t, g, unknown or other
  misc_feature (406)..(406): n is a, c, g, or t
tcagcgtctagtaccacgaccggtgctcgatttagagtgagctcgttggggtttgggggggggtctcaggaggcagcgctctcaggacatctccaccatggcctgggctctgctgctcctcaccctcctcactcagggcacgngggtcctgggcccagtctcgccctgactcacgcctcgcctccgtgtcgtgggtctcgtggacngtcgatccacctatcctctcgacacgtacggaaaccaactagttcgacgttggtataattaacttacgtttcgtccttccgtacgtaaccaaaccaacccaaccgacgaccaaaccgaccccctaaactcactactattanagaactctacgacggcgcctggtaggtactactatctcttctctcgcctacgtagtcgngaccaaccgccggtccttcccggtcgacccgttcccgtacggccctaccgacgtacgtacggaaccgggtagtacggtctagttacttaaccttacgtcgaccctataactactaagtaagtaacttaaccgttaacttaccttcgttgggtttacgggtttaccgggagggtaccgaacgtacgcgttaccggtaccgtacggtacgacccgaccggaaccggacggtccccgttcccggtccccgttccggtaaccttcccgttcccgttaccccgttacccccg

SEQ ID NO: 92349 - DNA, 282 bp, Homo sapiens
  misc_feature: GYAE6OF01BHKFK.14.33.C11.1.454.CMB.1.raw
  modified_base (139)..(139): a, c, t, g, unknown or other
  misc_feature (139)..(139): n is a, c, g, or t
  modified_base (182)..(182): a, c, t, g, unknown or other
  misc_feature (182)..(182): n is a, c, g, or t
  modified_base (241)..(241): a, c, t, g, unknown or other
  misc_feature (241)..(241): n is a, c, g, or t
  modified_base (263)..(282): a, c, t, g, unknown or other
  misc_feature (263)..(282): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactctgtggtttcgngggagggaccaagctgaccgtcctagggtcagcccaaggttcnccccctcggtccacgtcttcgttccccgccctcctcggtactagacgctggacgccggntgggaccaagggcgtacagtgnnnnnnnnnnnnnnnnnnnn

SEQ ID NO: 92350 - DNA, 529 bp, Homo sapiens
  misc_feature: GYAE6OF01E41M2.14.33.C11.1.454.CMB.1.raw
  modified_base (296)..(296): a, c, t, g, unknown or other
  misc_feature (296)..(296): n is a, c, g, or t
  modified_base (309)..(309): a, c, t, g, unknown or other
  misc_feature (309)..(309): n is a, c, g, or t
  modified_base (529)..(529): a, c, t, g, unknown or other
  misc_feature (529)..(529): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctgtaccaacaacacccaggcaaagcccccaaactcatcatttatgaagtctctaagccggccctcaggggtatctaatcgcttcnctggctccaagtntggcaacacggcctccctgacctctctggcctccagactgaggacgagctgattatactgccatcatatagaagtagtactactcctgtcggtttcggcggaggaccaagctgaccgtcctagcgcgccaaggctcgccccctcggtccactcctcgttcccgccctcctccgtacctagaccgatcggacgcggtcgtcggcgaacggagcagtacgtn

SEQ ID NO: 92351 - DNA, 940 bp, Homo sapiens
  misc_feature: GYAE6OF01B0W5D.14.33.C11.1.454.CMB.1.raw
  modified_base (187)..(187): a, c, t, g, unknown or other
  misc_feature (187)..(187): n is a, c, g, or t
tcagcgtctagtaccacgaccggtgctcgatttagagtgagctcgttgggtttgggctctgctgctcctcaccctcctcactcagggcacgagggtcctgggcccagtctcgccctgactcagcctgccctcgtgtcgtgggtctccgtggacagtcgatccaccatcctcctgctacgtggaaccngctagtggtacgtttgggtagttaatagtagtcgtccgtacctaggtaaccaaaccaaccgacccgaggacccaaacccgacccccctaaatcgtaattacggttaatttaggtacggtaacggtaccgtaagttaaccgttcccggtaccccgttacggttacggggttttacctaacgttccgttacctttccgttccgtacggtccgttaccgtacggttccgacccgggtacccaaacccggtaccccggtacccccttaccccgtacggtaccccgtacgttccgttaccgggttccgggtcccggtacccggaaggggttccgtaacggggtaaccgggtaaccggttacgttaccgtttaaggttaaacttttacgtttaacgtttaccggacctaacggttaccctacgtaacgttacgtaccgtaccggtaccgtcgaccgaacgtactaacgtaccgttaaggtttccggggtttacgggggttccgggggaaccgggggttaaccggtacgggttacccggtaacccggttccggtaaccggtacccgtaacccgggtaccccggtaaccgggtcccgttaccccgggttaccccccgttacgggttcccttaccccgttcccgttacccccgtttaacccccgttacccgttaccccgttacgttcccgttcccttccggttacccggtaccggtacgggtaccgggtacccgggtccgggtacggaaccggtaacccggg

SEQ ID NO: 92352 - DNA, 194 bp, Homo sapiens
  misc_feature: GYAE6OF01BQZ91.14.33.C11.1.454.CMB.1.raw
  modified_base (173)..(194): a, c, t, g, unknown or other
  misc_feature (173)..(194): n is a, c, g, or t
tcagcgtctagtaccacgaccggtgctcgatttagagtgagctcgttgggtttgggggaagaggaagactgacggtcccccaggagttcaggtgctgggcacagcggccctgggctgcctggtcaaggactacttccgtactagacgctgagcgggctggcaaggcgcatagnnnnnnnnnnnnnnnnnnnnnn

SEQ ID NO: 92353 - DNA, 710 bp, Homo sapiens
  misc_feature: GYAE6OF01AZMW9.14.33.C11.1.454.CMB.1.raw
tcagcgtctagtaccacgaccggtgctcgatttagagtgagctcgttggggtttgggggggggtctcaggaggcagcgctctcaggacatctccaccatggcctgggctctgctgctcctcaccctcctcactcagggcacagggtcctgggcccagtctgccctgactcagcctgcctccgtgtcgtgggtctcgtggactagtcgatcaccatccgtcctgcactacggaaccaactgttgtacgttggtagtattattactttgtcttcctagtaccaacaaccaccgagaccaaccgacccccaactacatactatttatagtaacgtctactaacggccggcctggtagggtactacgtactctcttctcgtcggtccctacgtaagtcgtacggaccaccgaccggtccctcccgtcgtaccgtctccgacggtccctcgtacgtacgtaggaaccggtacggacggtcgttaagttaactttacgttacgtccgtaccctactactaagttaagtaaggttaacggtacttaaccgttaccgttacggtttcggtttacgggtttccgggaggggtaaaccggtaccggtaacgttccggttaaccggtaccgttaccggtacggtaccgtaaccgggacccggaaccggtcccgttacccggtacccccgttacggtcccgtaccgtttccccgtaccccgg

SEQ ID NO: 92354 - DNA, 247 bp, Homo sapiens
  misc_feature: GYAE6OF02GXJIA.14.33.C11.1.454.CMB.1.raw
  modified_base (246)..(247): a, c, t, g, unknown or other
  misc_feature (246)..(247): n is a, c, g, or t
tcagcgtctagtaccacgaccggtgctcgatttagagtgagctcgttgggtttggggtgtggtggtctccactcccgccttgacgaggctgattattactgccactcatatagaagtagtactactcctgtggtttcggcggagggaccaagctgaccgtcctaggtcagcccaaggctgccccctcggtcactctgttcccgccctcctcgtctagacgctgagcgggctggcaaggcgcatagnn

SEQ ID NO: 92355 - DNA, 249 bp, Homo sapiens
  misc_feature: GYAE6OF02GXWYK.14.33.C11.1.454.CMB.1.raw
  modified_base (248)..(249): a, c, t, g, unknown or other
  misc_feature (248)..(249): n is a, c, g, or t
tcagcgtctagtaccacgaccggtgctcgatttagagtgagctcgttgggtttggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccatcctcctcgtatctctcgctgagcgggctggcaaggcgcatagnn

SEQ ID NO: 92356 - DNA, 247 bp, Homo sapiens
  misc_feature: GYAE6OF02F6M0K.14.33.C11.1.454.CMB.1.raw
  modified_base (247)..(247): a, c, t, g, unknown or other
  misc_feature (247)..(247): n is a, c, g, or t
tcagcgtctagtaccacgaccggtgctcgatttagagtgagctcgttgggtttggggtgtggtggtctccactcccgccttgacgaggctgattattactgccactcatatagaagtagtactactcctgtggtttcggcggaggaccaagctgaccgtcctaggtcagcccaaggctcgccccctcggtcactctgttcccaccctcctcgtactagacgctgagcgggctggcaaggcgcatagn

SEQ ID NO: 92357 - DNA, 180 bp, Homo sapiens
  misc_feature: GYAE6OF02I6ESG.14.33.C11.1.454.CMB.1.raw
  modified_base (174)..(180): a, c, t, g, unknown or other
  misc_feature (174)..(180): n is a, c, g, or t
tcagcgtctagtaccacgaccggtgctcgatttagagtgagctcgttgggtttgggggaagaggaagactgacgggtcccccaggagttcaggtgctgggcacagcggccctgggctgcctggtcaaggactacttccgtactagacgctgagcgggctggcaaggcgcatagnnnnnnn

SEQ ID NO: 92358 - DNA, 173 bp, Homo sapiens; identical to SEQ ID NO: 92290
  misc_feature: GYAE6OF02GM3XK.14.33.C11.1.454.CMB.1.raw
  modified_base (173)..(173): a, c, t, g, unknown or other
  misc_feature (173)..(173): n is a, c, g, or t

SEQ ID NO: 92359 - DNA, 250 bp, Homo sapiens
  misc_feature: GYAE6OF02F3MWJ.14.33.C11.1.454.CMB.1.raw
  modified_base (250)..(250): a, c, t, g, unknown or other
  misc_feature (250)..(250): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccaccctcctcgtatctctcggctgagcgggctggcaaggcgcatagn

SEQ ID NO: 92360 - DNA, 250 bp, Homo sapiens
  misc_feature: GYAE6OF02GDJT8.14.33.C11.1.454.CMB.1.raw
  modified_base (249)..(250): a, c, t, g, unknown or other
  misc_feature (249)..(250): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccaccctcctcgtatctctcgctgagcgggctggcaaggcgcatagnn

SEQ ID NO: 92361 - DNA, 248 bp, Homo sapiens
  misc_feature: GYAE6OF02F9D7T.14.33.C11.1.454.CMB.1.raw
  modified_base (248)..(248): a, c, t, g, unknown or other
  misc_feature (248)..(248): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggtttcggcggagggaccaagctgaccgtcctaggtcagcccaaggctgccccctcggtcactctgttcccaccctcctcgtactagacgctgagcgggctggcaaggcgcatagn

SEQ ID NO: 92362 - DNA, 173 bp, Homo sapiens; identical to SEQ ID NO: 92290
  misc_feature: GYAE6OF02GHA7U.14.33.C11.1.454.CMB.1.raw
  modified_base (173)..(173): a, c, t, g, unknown or other
  misc_feature (173)..(173): n is a, c, g, or t

SEQ ID NO: 92363 - DNA, 174 bp, Homo sapiens
  misc_feature: GYAE6OF02G4EJG.14.33.C11.1.454.CMB.1.raw
  modified_base (173)..(174): a, c, t, g, unknown or other
  misc_feature (173)..(174): n is a, c, g, or t
tcagcgtctagtaccacgaccggtgctcgatttagagtgagctcgttgggtttgggggaagaggaagactgacggtcccccaggagttcaggtgctgggcacagcggccctgggctgcctggtcaaggactacttccgtactagacgctgagcgggctggcaaggcgcatagnn

SEQ ID NO: 92364 - DNA, 250 bp, Homo sapiens
  misc_feature: GYAE6OF02F5Z81.14.33.C11.1.454.CMB.1.raw
  modified_base (249)..(250): a, c, t, g, unknown or other
  misc_feature (249)..(250): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccgccctcctcgtactagacgctgagcgggctggcaaggcgcatagnn

SEQ ID NO: 92365 - DNA, 174 bp, Homo sapiens; identical to SEQ ID NO: 92363
  misc_feature: GYAE6OF02GDV6K.14.33.C11.1.454.CMB.1.raw
  modified_base (173)..(174): a, c, t, g, unknown or other
  misc_feature (173)..(174): n is a, c, g, or t

SEQ ID NO: 92366 - DNA, 248 bp, Homo sapiens
  misc_feature: GYAE6OF02HJ6IH.14.33.C11.1.454.CMB.1.raw
  modified_base (246)..(248): a, c, t, g, unknown or other
  misc_feature (246)..(248): n is a, c, g, or t
tcagcgtctagtaccacgaccggtgctcgatttagagtgagctcgttgggtttggggtgtggtggtctccactcccgccttgacgaggctgattattactgccactcatatagaagtagtactactcctgtggtttcggcggaggaccaagctgaccgtcctaggtcagcccaaggctgccccctcggtcactctgttcccgccctcctcgtatctctcgctgagcgggctggcaaggcgcatagnnn

SEQ ID NO: 92367 - DNA, 249 bp, Homo sapiens; identical to SEQ ID NO: 92287
  misc_feature: GYAE6OF02GSPNW.14.33.C11.1.454.CMB.1.raw
  modified_base (248)..(249): a, c, t, g, unknown or other
  misc_feature (248)..(249): n is a, c, g, or t

SEQ ID NO: 92368 - DNA, 173 bp, Homo sapiens; identical to SEQ ID NO: 92290
  misc_feature: GYAE6OF02G8KDX.14.33.C11.1.454.CMB.1.raw
  modified_base (173)..(173): a, c, t, g, unknown or other
  misc_feature (173)..(173): n is a, c, g, or t

SEQ ID NO: 92369 - DNA, 249 bp, Homo sapiens; identical to SEQ ID NO: 92286
  misc_feature: GYAE6OF02GEF9X.14.33.C11.1.454.CMB.1.raw
  modified_base (249)..(249): a, c, t, g, unknown or other
  misc_feature (249)..(249): n is a, c, g, or t

SEQ ID NO: 92370 - DNA, 174 bp, Homo sapiens; identical to SEQ ID NO: 92363
  misc_feature: GYAE6OF02F1BIX.14.33.C11.1.454.CMB.1.raw
  modified_base (173)..(174): a, c, t, g, unknown or other
  misc_feature (173)..(174): n is a, c, g, or t

SEQ ID NO: 92371 - DNA, 285 bp, Homo sapiens
  misc_feature: GYAE6OF02JBWNO.14.33.C11.1.454.CMB.1.raw
  modified_base (258)..(285): a, c, t, g, unknown or other
  misc_feature (258)..(285): n is a, c, g, or t
tcagcgtctagtaccacgaccggtgctcgatttagagtgagctcgttggggtttgggggtgtgggtggtctccacctcccgccgttgacgaggcctggattattactgccactccatatagaagtagtactactccgtgtggttttcggcggagggaccaaggctgaccgtcctaggtcagcccaaggctgccccctggtcactcctgttcccaccctcctcgtactagacgctgagcgggctggcaaggcgcatagnnnnnnnnnnnnnnnnnnnnnnnnnnnn

SEQ ID NO: 92372 - DNA, 253 bp, Homo sapiens
  misc_feature: GYAE6OF02FV4S9.14.33.C11.1.454.CMB.1.raw
  modified_base (249)..(253): a, c, t, g, unknown or other
  misc_feature (249)..(253): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggttttcggcggagggaccaagctgaccgtcctaggtcagcccaaggctaccccctcggtcactctgttcccaccctcctcgtactagacgctgagcgggctggcaaggcgcatagnnnnn

SEQ ID NO: 92373 - DNA, 251 bp, Homo sapiens; identical to SEQ ID NO: 92288
  misc_feature: GYAE6OF02JM47P.14.33.C11.1.454.CMB.1.raw
  modified_base (249)..(251): a, c, t, g, unknown or other
  misc_feature (249)..(251): n is a, c, g, or t

SEQ ID NO: 92374 - DNA, 249 bp, Homo sapiens; identical to SEQ ID NO: 92286
  misc_feature: GYAE6OF02G27DP.14.33.C11.1.454.CMB.1.raw
  modified_base (249)..(249): a, c, t, g, unknown or other
  misc_feature (249)..(249): n is a, c, g, or t

SEQ ID NO: 92375 - DNA, 173 bp, Homo sapiens
  misc_feature: GYAE6OF02I4R44.14.33.C11.1.454.CMB.1.raw
  modified_base (172)..(173): a, c, t, g, unknown or other
  misc_feature (172)..(173): n is a, c, g, or t
tcagcgtctagtaccacgaccggtgctcgatttagagtgagctcgttgggtttgggggaagaggaagactgacggtcccccaggagttcaggtgctgggcacagcggcctgggctgcctggtcaaggactacttccgtactagacgctgagcgggctggcaaggcgcatagnn

SEQ ID NO: 92376 - DNA, 251 bp, Homo sapiens
  misc_feature: GYAE6OF02GAG58.14.33.C11.1.454.CMB.1.raw
  modified_base (249)..(251): a, c, t, g, unknown or other
  misc_feature (249)..(251): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccaccctcctcgtatctctcgctgagcgggctggcaaggcgcatagnnn

SEQ ID NO: 92377 - DNA, 250 bp, Homo sapiens; identical to SEQ ID NO: 92360
  misc_feature: GYAE6OF02H7M5R.14.33.C11.1.454.CMB.1.raw
  modified_base (249)..(250): a, c, t, g, unknown or other
  misc_feature (249)..(250): n is a, c, g, or t

SEQ ID NO: 92378 - DNA, 173 bp, Homo sapiens; identical to SEQ ID NO: 92290
  misc_feature: GYAE6OF02H0V6X.14.33.C11.1.454.CMB.1.raw
  modified_base (173)..(173): a, c, t, g, unknown or other
  misc_feature (173)..(173): n is a, c, g, or t

SEQ ID NO: 92379 - DNA, 533 bp, Homo sapiens
  misc_feature: GYAE6OF02HWO8F.14.33.C11.1.454.CMB.1.raw
  modified_base (533)..(533): a, c, t, g, unknown or other
  misc_feature (533)..(533): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgagctgattattactgccactcatatagaagtagtactactctgtggttttcggcggagggaccaagctgaccgtccgtagtcagcccaaggctcgccccgtcggtccacgtcctcgttcccacccttcctcgtacctacgacgcctggacgccgggctcgggcaagggcgacagtgn

SEQ ID NO: 92380 - DNA, 521 bp, Homo sapiens
  misc_feature: GYAE6OF02I4AQ2.14.33.C11.1.454.CMB.1.raw
  modified_base (521)..(521): a, c, t, g, unknown or other
  misc_feature (521)..(521): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctcgcccctcggtcactctcgttcccaccctcctcgtactacgacgctgagcgggctggcaaggcgcatagn

SEQ ID NO: 92381 - DNA, 521 bp, Homo sapiens
  misc_feature: GYAE6OF02HRXAY.14.33.C11.1.454.CMB.1.raw
  modified_base (325)..(325): a, c, t, g, unknown or other
  misc_feature (325)..(325): n is a, c, g, or t
tcagcgtctagtaccacgaccggtgctcgatttagagtgagctcgttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctnaggggtatctaatcgcttctctggctccaagtctggcaacacggcctccctgaccgtctctggcctccagactgaggacgaggctgattattactgccactcatatactattagcagaactgttggttttcggcggagggacaaggtgaccgtcgtaggtcagcccaagctcgccccgtcggtcactctgttcccc

SEQ ID NO: 92382 - DNA, 251 bp, Homo sapiens; identical to SEQ ID NO: 92306
  misc_feature: GYAE6OF02HWC4E.14.33.C11.1.454.CMB.1.raw
  modified_base (249)..(251): a, c, t, g, unknown or other
  misc_feature (249)..(251): n is a, c, g, or t

SEQ ID NO: 92383 - DNA, 521 bp, Homo sapiens
  misc_feature: GYAE6OF02GPR7H.14.33.C11.1.454.CMB.1.raw
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgcccctcggtcactctcgttcccaccctcctcgtactagacgctgagcgggctcggcaaggcgcatagc

SEQ ID NO: 92384 - DNA, 250 bp, Homo sapiens; identical to SEQ ID NO: 92364
  misc_feature: GYAE6OF02F5XCU.14.33.C11.1.454.CMB.1.raw
  modified_base (249)..(250): a, c, t, g, unknown or other
  misc_feature (249)..(250): n is a, c, g, or t

SEQ ID NO: 92385 - DNA, 519 bp, Homo sapiens
  misc_feature: GYAE6OF02F86I2.14.33.C11.1.454.CMB.1.raw
  modified_base (307)..(307): a, c, t, g, unknown or other
  misc_feature (307)..(307): n is a, c, g, or t
tcagcgtctagtaccacgaccggtgctcgatttagagtgagctcgttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgccactggaaccaacattgacgttggtgattataactttgtctcctggtaccaacaacacccaggcaaagcccccaaactcatcatttangaagtctctaagcggccctcaggggtatctaatcgcttctctggctccaagtctggcaacacggcctccctgacccgtctcgtcggccctccagactgaggacgaggctgattattactgccactcatatagaagtagtactactcctgttggtttcggcggaggacaagctgaccgtcaggtcacgccaagctcgcccctggcactctccg

SEQ ID NO: 92386 - DNA, 174 bp, Homo sapiens
  misc_feature: GYAE6OF02FKYLX.14.33.C11.1.454.CMB.1.raw
  modified_base (169)..(174): a, c, t, g, unknown or other
  misc_feature (169)..(174): n is a, c, g, or t
tcagcgtctagtaccacgaccggtgctcgattagagtgagctcgttgggtttgggtaagaggaagactgacggtcccccaggagttcaggtgctgggcacagcggccctgggctgcctggtcaaggactactccgtactagacgctgagcggctggcaaggcgcatagnnnnnn

SEQ ID NO: 92387 - DNA, 522 bp, Homo sapiens
  misc_feature: GYAE6OF02GZD7S.14.33.C11.1.454.CMB.1.raw
  modified_base (479)..(479): a, c, t, g, unknown or other
  misc_feature (479)..(479): n is a, c, g, or t
  modified_base (518)..(518): a, c, t, g, unknown or other
  misc_feature (518)..(518): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaaactcatcatttatgaaagtctctaagcggccctcaggggtatctaatcgcttctctggctccaagtctggcaacacggcctccctgaccgtctctggcctccagactgaggacgaggctgattattactgcctactcaatatagaagtatactactcctgttggttttcggcggagggacaagctgaccgtcctaggtcagcccaaggcctcgcccctcggcactctcgttcccnccctcctcgtatctctcgctgacgcgggctggcaggcgnatcg

SEQ ID NO: 92388 - DNA, 174 bp, Homo sapiens; identical to SEQ ID NO: 92363
  misc_feature: GYAE6OF02FROZE.14.33.C11.1.454.CMB.1.raw
  modified_base (173)..(174): a, c, t, g, unknown or other
  misc_feature (173)..(174): n is a, c, g, or t

SEQ ID NO: 92389 - DNA, 676 bp, Homo sapiens
  misc_feature: GYAE6OF02HTRLU.14.33.C11.1.454.CMB.1.raw
  modified_base (292)..(292): a, c, t, g, unknown or other
  misc_feature (292)..(292): n is a, c, g, or t
tcagcgtctagtaccacgaccggtgctcgattttagagtgagctcgttgggggtttgggcgtctggctcgctcctcacccgtcctccactctagggctacagggtcctgggcccagtctgccctgactcagcctgcctcggtgtctgggtctcctggtactagtcgatcaacctatcctcctgcacgtgggaaccaacattggacggtttggtgtatttaagtaacgttttgtcttccgtggtaaccaaacaaccgtacccgaggacaaaacgcccccaaatcatcatttangagttcctctaacgcggcctcgacgggtactctaatcgcttcgtctcggctccaagtcgtagggcaacgcggcctcctcgtaccgtttcttcgtggcctacgagtactaggtacggacggaggtctagtacgtttacgttacggtcgacctactactattaatacgtaagtaacgttaacctacttaccttaggttacgggtttacggcggtacgggtactaacgtacgtcgacgtccgtaggtcacggcccgtaaggcctccgaccccgtcggtaccaccgttcgttccgttccccgtcctccgtaccgttagtacggtaccgtccggtaggacgggtaccgggtactacgggaccgacgggtacgacggacggtacggacgg

SEQ ID NO: 92390 - DNA, 542 bp, Homo sapiens
  misc_feature: GYAE6OF02J1DBZ.14.33.C11.1.454.CMB.1.raw
tcagcgtctagtaccacgaccggtgctcgatttagagtgagctcgttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacaccaggcaaacgcccccaaactcatcattatgaagtctctaagcggccctcgaggggtatactaatcgtcttctctggctccaagtctagcaacacggcctccctcgaccgtctcgtcggcctccagtactcggaggacgaggctgtatttattactcgacctacgtcatataagaagttacgtactacttcctgtttggtttccggcggacgggaccagctgaccgtctaggtcacgaccgaggctccggccctcggtcactctccg

SEQ ID NO: 92391 - DNA, 248 bp, Homo sapiens
  misc_feature: GYAE6OF02FKZ5S.14.33.C11.1.454.CMB.1.raw
tcagcgtctagtaccacgaccggtgctcgatttagagtgagctcgttgggtttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccgccctcctcgtactagacgctgagcgggctggcaaggcgcatag

SEQ ID NO: 92392 - DNA, 568 bp, Homo sapiens
  misc_feature: GYAE6OF02IHYU0.14.33.C11.1.454.CMB.1.raw
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (245)..(245): a, c, t, g, unknown or other
  misc_feature (245)..(245): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
  modified_base (424)..(424): a, c, t, g, unknown or other
  misc_feature (424)..(424): n is a, c, g, or t
  modified_base (479)..(479): a, c, t, g, unknown or other
  misc_feature (479)..(479): n is a, c, g, or t
tcagcgtctagtaccacgaccggtgctcgatttagagtgagctcgttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctcctgctacncggaaaccaanattgacgttggntattataactttgtctcctaggtaccaacaacaccaggacaaacgaccccaaactcatctattatagaatctactaagcgcctacgagggtatcgtaatcgtcttctcgtgctaccaagtctacggcaaacncggccctccngtacctctcgtcgctccaagctgaggacgagtcagtnttaattactcgctactctactagaataagtacgtactacctctgttgggtttcgnggaccggagacgtctacgtccggtcttaaccggtcaacggtaccgaacgtcgtaccgccccgttacggcccgttactccgtttccccgg

SEQ ID NO: 92393 - DNA, 140 bp, Homo sapiens
  misc_feature: GYAE6OF02IABT4.14.33.C11.1.454.CMB.1.raw
  modified_base (140)..(140): a, c, t, g, unknown or other
  misc_feature (140)..(140): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctcgtgtctggtcn

SEQ ID NO: 92394 - DNA, 251 bp, Homo sapiens
  misc_feature: GYAE6OF02FQWBB.14.33.C11.1.454.CMB.1.raw
  modified_base (250)..(251): a, c, t, g, unknown or other
  misc_feature (250)..(251): n is a, c, g, or t
tcagcgtctagtaccacgaccggtgctcgatttagagtgagctcgttgggtttggggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccaccctcctcgtactagacgctgagcgggctggcaaggcgcatagnn

SEQ ID NO: 92395 - DNA, 558 bp, Homo sapiens
  misc_feature: GYAE6OF02H80OS.14.33.C11.1.454.CMB.1.raw
tcagcgtctagtaccacgaccggtgctcgatttagagtgagctcgttgggtttgggggggggtctcaggaggcagcgctctcaggacatctccaccatggcctgggctctgctgctcctcaccctcctcactcagggcacagggtcctgggcccagtctcgccctgactcagcctgcctccgtgtctggtctcgtggacagtcgatcaccatctcctgcactggaaaccaacattgacgttggtgtattataacttgtctctgtacaacacaccagacaaacgccccaaactcactctattactagaacgtctacaagccgcctcgagggtactactaatcgtcttctcgtgctcaacgtctaggacaacgaccgccctacccgcgtaccgtctccgtcggtcctaccgtacgacgtggacggtacgacggtctggtaatttactacgtcgcctacctcataacgtagtaacgtactactactctgttcggtttcggaggacgacgagcgtcgacgtcacgtcacgccagcgtccgtcccgtcggtcaccgtctcccg

SEQ ID NO: 92396 - DNA, 566 bp, Homo sapiens
  misc_feature: GYAE6OF02FZXGG.14.33.C11.1.454.CMB.1.raw
tcagcgtctagtaccacgaccggtgctcgatttagagtgagctcgttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctctggtaccaacaacaccaggcaaacgcccccaaactcatcatttatgaagtctctaagcggccctcaggggtatactaatcgcttctctggctcaagtctggcaacacgcctccctgaccgtctctcggcctccagactgaggacgaggctgattattactcgcctactcaatataagtaagtagttactacttccgtgtttcgggttttcggcggacgggaccgtaagtcgtacggaccgttacgtacggtacacggtacccgaaggtccgtccggcccccgttcggtaccctccttccttccccg

SEQ ID NO: 92397 - DNA, 174 bp, Homo sapiens
  misc_feature: GYAE6OF02ID5E3.14.33.C11.1.454.CMB.1.raw
  modified_base (174)..(174): a, c, t, g, unknown or other
  misc_feature (174)..(174): n is a, c, g, or t
tcagcgtctagtaccacgaccggtgctcgatttagagtgagctcgttgggtttgggggaagaggaagactgacggtccccccaggagttcaggtgctgggcacagcggccctgggctgcctggtcaaggactacttccgtactagacgctgagcgggctggcaaggcgcatagn

SEQ ID NO: 92398 - DNA, 253 bp, Homo sapiens
  misc_feature: GYAE6OF02GS10G.14.33.C11.1.454.CMB.1.raw
  modified_base (251)..(253): a, c, t, g, unknown or other
  misc_feature (251)..(253): n is a, c, g, or t
tcagcgtctagtaccacgaccggtgctcgatttagagtgagctcgttgggtttggggggtgtggtggtctccactcccgccttgacgaggctgattattactgccactcatatagaagtagtactactcctgtggttttcggcggagggaccaagctgaccgtcctaggtcagcccaaggctcgccccctcggtcactctgttccccgccctcctcgtactagacgcgagcgggctggcaaggcgcatagnnn

SEQ ID NO: 92399 - DNA, 258 bp, Homo sapiens
  misc_feature: GYAE6OF02GEMIR.14.33.C11.1.454.CMB.1.raw
  modified_base (252)..(258): a, c, t, g, unknown or other
  misc_feature (252)..(258): n is a, c, g, or t
tcagcgtctagtaccacgaccggtgctcgatttagagtgagctcgttgggtttggggggtgtggtggtctccactcccgccttgacgaggctgattattactgccactcatatagaagtagtactactcctgtggttttcggcggagggaccaagctgaccgtcctaggtcagcccaaggctgcccccctcggtcactctgttcccgccctcctccgtatctctcgctgagcgggctggcaaggcgcatagnnnnnnn

SEQ ID NO: 92400 - DNA, 570 bp, Homo sapiens
  misc_feature: GYAE6OF02GPK57.14.33.C11.1.454.CMB.1.raw
  modified_base (508)..(508): a, c, t, g, unknown or other
  misc_feature (508)..(508): n is a, c, g, or t
tcagcgtctagtaccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacagcttacagacgcctccctacccaacacgcataacgcgtcgctgccgcagccttcggngcagttcggtttacgtccccgtttcacttccttcccgcctactcctgacgtacctagtaccg

SEQ ID NO: 92401 - DNA, 252 bp, Homo sapiens
  misc_feature: GYAE6OF02HWU40.14.33.C11.1.454.CMB.1.raw
  modified_base (251)..(252): a, c, t, g, unknown or other
  misc_feature (251)..(252): n is a, c, g, or t
tcagcgtctagtaccacgaccggtgctcgatttagagtgagctcgttgggtttggggggtgtggtggtctccactcccgccttgacgaggctgattattactgccactcatatagaagtagtactactcctgtggttttcggcggagggaccaagctgaccgtcctaggtcagcccaaggctgcccccctcggtcactctgttcccgccctcctcgtatctctcgctgagcgggctggcaaggcgcatagnn

SEQ ID NO: 92402 - DNA, 546 bp, Homo sapiens
  misc_feature: GYAE6OF02GF4LI.14.33.C11.1.454.CMB.1.raw
  modified_base (255)..(255): a, c, t, g, unknown or other
  misc_feature (255)..(255): n is a, c, g, or t
  modified_base (413)..(413): a, c, t, g, unknown or other
  misc_feature (413)..(413): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaatcatcatttangaagtctctaagcggccctcgaggggtatctaatcgcttctctggctccaagtctggcaacacggcctccctgagcatctctgggctccgaggctgaggacgaggctgatttatactgacagctcatatactattagcagaacttgttggtttcgggnggagggaccaagggtcgaccgtcgtaggtcacgacccgaaggctcggcccccgttcgtcctactcgtccgttcccgtcccttccgtccgtacgtacgaccgcgtgacggcgggtactggacgacggcgctacg

SEQ ID NO: 92403 - DNA, 607 bp, Homo sapiens
  misc_feature: GYAE6OF02G5ZPT.14.33.C11.1.454.CMB.1.raw
  modified_base (262)..(262): a, c, t, g, unknown or other
  misc_feature (262)..(262): n is a, c, g, or t
tcagcgtctagtaccacgaccggtgctcgatttagagtgagctcgttgggtttggggggggggtctcaggaggcagcgctctcaggacatctccaccatggcctgggctctgctgctcctcaccctcctcactcagggcacagggtcctgggcccagtctgccctgactcagcctgcctccgtgtcgtgggtctcctggacagtcgatcaccatctccgtgcactggaaccaacattcgacgttggtgtattaataactttntctctcggtaccaacaaccaccaggacaaacgacccccaaactcatcatttatgaagtctactaacgcgtccctacgagggtatctaactcgtcttctctggctaccagtctggacaacacgcctcctcgacctctcgtcgccctccagtacgtgagacggacgtctgtaattcgttactcgtcctactacactaagtagtaagttaagtaccttacgtcgttagggtttcggtttccgggacgggtaacggacgtacgtcgtacggtacccgttacggtacggtcaccggacccgtaggtacccgttcccggaccccgtttcggacctcgttaccttcccccgg

SEQ ID NO: 92404 - DNA, 265 bp, Homo sapiens
  misc_feature: GYAE6OF02IJVF7.14.33.C11.1.454.CMB.1.raw
  modified_base (254)..(265): a, c, t, g, unknown or other
  misc_feature (254)..(265): n is a, c, g, or t
tcagcgtctagtaccacgaccggtgctcgatttagagtgagctcgttgggtttgggggggtgtggtggtctccactcccgccttgacgaggctgattattactgccactcatatagaagtagtactactcctgtggttttcggcgggagggaccaagctgaccgtcctaggtcagcccaaggctcgccccctggtcactctcgttcccgccctcctcgtatctctcgctgaggcggctggcgaaggcgcatagnnnnnnnnnnnn

SEQ ID NO: 92405 - DNA, 547 bp, Homo sapiens
  misc_feature: GYAE6OF02FSK6S.14.33.C11.1.454.CMB.1.raw
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctctgtaccaacacaccagcaaacgccccaaatcatcatttatgaagtctctaagccggcctcgaggggtatctaatcgcttcnctggctcaagtctggcaacncggcctccgtgaccgtctctcggcctccagacctgacggacgaggctagattattactgaccactcatagtagaagtagtactactccgttgttcggttttcggacgggtaggaccaagtcgtcgaccgtctacggcacgccgaaggcctcgccccgtcgtcctactctcgttcccacccttcctcgtactacgacgctggacggtcggtcgtacggcgaacggcgactagtagcg

SEQ ID NO: 92406 - DNA, 254 bp, Homo sapiens
  misc_feature: GYAE6OF02FUQH7.14.33.C11.1.454.CMB.1.raw
  modified_base (251)..(254): a, c, t, g, unknown or other
  misc_feature (251)..(254): n is a, c, g, or t
tcagcgtctagtaccacgaccggtgctcgatttagagtgagctcgttgggtttggggggtgtggtggtctccactcccgccttgacgaggctgattattactgccactcatatagaagtagtactactcctgtggttttcggcggagggaccaagctgaccgtcctaggtcagcccaaggctgccccctcggtcactctgttccccgccctcctcgtactagacgctgagcgggctggcaaggcgcatagnnnn

SEQ ID NO: 92407 - DNA, 254 bp, Homo sapiens
  misc_feature: GYAE6OF02GMR1Z.14.33.C11.1.454.CMB.1.raw
  modified_base (248)..(254): a, c, t, g, unknown or other
  misc_feature (248)..(254): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccgcctcctcgtatctctcgctgagcgggctggcaaggcgcatagnnnnnnn

SEQ ID NO: 92408 - DNA, 552 bp, Homo sapiens
  misc_feature: GYAE6OF02FHEEK.14.33.C11.1.454.CMB.1.raw
  modified_base (258)..(258): a, c, t, g, unknown or other
  misc_feature (258)..(258): n is a, c, g, or t
tcagcgtctagtaccacgaccggtgctcgatttagagtgagctcgttgggtttgggcgtctgctgctcctcaccctcctcactcagggcacagggtcctgggcccagtcctgccctgactcagcctgcctccgtgtctgggtctcctggacagtcgatcaccatctcctgcactggaaccaacattgacgttggtgattataactttgtctcctggtaccaacaacacccaggcaaacgccccaaactcatcatttangaagtctctaagcggccctcgaggggtatctaatcgcttctctggctccaagtctggcaacgacggcctcctgaccgtctcctggccttccagactgaggacgaggtctgattattactgccacgtcatactagaagtagtactactctgttcgtttcggcggaggaccagctcgaccgtcgtagtcagcccgagcctcgcccctcggtcactctcgttccctacccgtcctcgtactcttcctcgtccgtacggacgccgggtcgtcggaccgaagggtcctacgtagtacgg

SEQ ID NO: 92409 - DNA, 749 bp, Homo sapiens
  misc_feature: GYAE6OF02FUXKT.14.33.C11.1.454.CMB.1.raw
  modified_base (318)..(318): a, c, t, g, unknown or other
  misc_feature (318)..(318): n is a, c, g, or t
tcagcgtctagtaccacgaccggtgctcgatttagagtgagctcgttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctcctgcacgtcggaaaccactattgacgttggtgaattattaacttgtctcctggtaccaacaacacccaggacaaacgcccccaaactcatcatttatagaagtntactaagcgccctcgagggtactctaatcgcttctcgtcggtctaccaagttcgtacggacctaaccgaccggtcccctaccccgttaggtaaccccgttctaccgtcgggtacccctccaacggtaccgttacgggaacgggtaccggaacgggtcgttcgtaaattttaacgtttaaccgtcggtaccctaccgttaacctaagttacctaaggttaaacggttacgtttaaccgttaaccgtttcccgtttgggttttaccggggtttttccgggaaccgggggttaacgggtaacccgtaacggtcccgttaacgggttaccccggttaaccgttaacgggtaacccgtaaccggtaaccccgtaacggtacccggtccgttacccccccgggttcggttacccgaccgtttacccgttcccccggg

SEQ ID NO: 92410 - DNA, 675 bp, Homo sapiens
  misc_feature: GYAE6OF02JL2XK.14.33.C11.1.454.CMB.1.raw
  modified_base (260)..(260): a, c, t, g, unknown or other
  misc_feature (260)..(260): n is a, c, g, or t
tcagcgtctagtaccacgaccggtgctcgatttagagtgagctcgttggggtttgggggggggtcgtcaggaggcagcgctctcaggacatctccaccatggcctgggctctgctgctcctcaccctcctcactcagggcacgagggtcctgggcccagtctgccctgactcacgcctgcctccgtgtcgtgggcttccgtggacagtccgaatcaccatcgtcctagcgaacctggaacctacgatttggacgttggtnaattttataactttgtctcctagtaccaacaacgaccaaggccaaacgccccaaactcaacttccgaatttactacgtaacgtgccttaacgtaacggaccggtcctacggtaaggttactactacgtctcgttctcgtcgtctacgacgtagtccgacaaccgcgtccctccgagtacctctcgcgtcctacgacgacgtaggacggtacggtacggtacgtagtattacttaccgtacgtacctactataacgttaagtaacggttaagttaacggttacttaccgttccgttacgggtttcgggtttacggacgggacggtaaccgacgtacgtaccggtacccgttggtaacggtaccgtaacggtccccgaacggtcccgtacgtcccccgttcggttacctacttcccg

SEQ ID NO: 92411 - DNA, 567 bp, Homo sapiens
  misc_feature: GYAE6OF02IIETM.14.33.C11.1.454.CMB.1.raw
  modified_base (261)..(261): a, c, t, g, unknown or other
  misc_feature (261)..(261): n is a, c, g, or t
  modified_base (323)..(323): a, c, t, g, unknown or other
  misc_feature (323)..(323): n is a, c, g, or t
  modified_base (355)..(355): a, c, t, g, unknown or other
  misc_feature (355)..(355): n is a, c, g, or t
  modified_base (381)..(381): a, c, t, g, unknown or other
  misc_feature (381)..(381): n is a, c, g, or t
  modified_base (438)..(438): a, c, t, g, unknown or other
  misc_feature (438)..(438): n is a, c, g, or t
  modified_base (485)..(485): a, c, t, g, unknown or other
  misc_feature (485)..(485): n is a, c, g, or t
  modified_base (490)..(490): a, c, t, g, unknown or other
  misc_feature (490)..(490): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccggtgtcgtgggtctcctggacagtcgatcaccatctcctgcactggaaccaaacattgacgttggtgatttataatttgtctcctggtaaccaacaacgacccaggcaaacgaccccaaatcatcatttangtaagtctactaagcggcctcgagggtatctaatcgcttctctggctacaagtctagcaacncgcctcctagccgtctctcggcctacatacgngaaggacgagcgtagtattattacgnccaacttgactatagaagtacgtactactctggttggtttcgacgggaggactaagngtacgacgtccgtagtcacgaccgaacggctccgacccctcggtacncgtcnccggttcccaccctcgttccgtatccgtcctcgtcgtagtcgcgggtaccgtgggaccgtaaggcccgtgtacgtag

SEQ ID NO: 92412 - DNA, 264 bp, Homo sapiens
  misc_feature: GYAE6OF02GJB3Y.14.33.C11.1.454.CMB.1.raw
  modified_base (253)..(264): a, c, t, g, unknown or other
  misc_feature (253)..(264): n is a, c, g, or t
tcagcgtctagtaccacgaccggtgctcgatttagagtgagctcgttgggtttgggggggtgtggtggtctccactcccgccttgacgaggctgattattactgccactcatatagaagtagtactactcctgtggttttcggcggagggaccaagctgaccgtcctaggtcagcccaaaggctgccccctcggtcactctgttccccgccctcctcgtactagacgctgagcgggctggcaaggcgcatagnnnnnnnnnnnn

SEQ ID NO: 92413 - DNA, 563 bp, Homo sapiens
  misc_feature: GYAE6OF02F8EJ2.14.33.C11.1.454.CMB.1.raw
  modified_base (251)..(251): a, c, t, g, unknown or other
  misc_feature (251)..(251): n is a, c, g, or t
  modified_base (322)..(322): a, c, t, g, unknown or other
  misc_feature (322)..(322): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataacttgtctctgtaccaacaacaccagacaaacgccccaaatcatcatttangaagtctactaagcggccctcgaggggtatcgtaatcgcttctctggctccaagtctgcacacggcctccngaccgtctctcggcctccgacgacgtgacggacggaggctgtattacttactcgaccactcatagtaagaagtagtaacctactccgttgttggtttcggacggtacggaccagctcggaccgtacgtacggtcacgacccgaaggccgtccgaccccgtcggtcctactctccgtccctaccctcctcgtacctcgacgcgtcggaggccgggctcgggacgtaacggctacgatgtacg

SEQ ID NO: 92414 - DNA, 606 bp, Homo sapiens
  misc_feature: GYAE6OF02IFW1N.14.33.C11.1.454.CMB.1.raw
  modified_base (364)..(364): a, c, t, g, unknown or other
  misc_feature (364)..(364): n is a, c, g, or t
  modified_base (460)..(460): a, c, t, g, unknown or other
  misc_feature (460)..(460): n is a, c, g, or t
tcagcgtctagtaccacgaccggtgctcgatttagagtgagctcgttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgtattaattaactttgtctccgtgtaccaacaacaccaggacaaacgccccaaactcactctaatttatgaacgttctactaacgccggtccctacggagggtactactaacgtctcttcncgtggctaccgaagtcgtagacctacgaccgtcctcccgtgacccgtctcgtcgcctccagtacgtagaggacgacgctagtattacttacgtacnctactactataagtacgaagtacgtactacgttcgttggttcgggtttacggacggaacgggaacctagtcgtcgtaccgtccggtacgtaccgacgacccgtaagcccgttaccgtcccccgtcggtacctacctcgttaccccg

SEQ ID NO: 92415 - DNA, 1103 bp, Homo sapiens
  misc_feature: GYAE6OF02JMMHY.14.33.C11.1.454.CMB.1.raw
  modified_base (235)..(235): a, c, t, g, unknown or other
  misc_feature (235)..(235): n is a, c, g, or t
tcagcgtctagtaccacgaccggtgctcgatttagagtgagctcgtttggggtttggggggggggtctcaggaggcagcgctctcagggcatctccaccatggcctgggctctgctgctcctccaccctcctcactcgaggcacgcgggtcctgggcccagtctcgccctgacctccgagtcctcgcctccggtggttcgtcgggttcctccgtggacgagtcgagtaccacctntccgtcctgcctacgtacgaaccaactagttcggtacgttcggtagtactttaacgttaactttcgttacccgttaccgtaccggttaaacccaaaaccgtaaaccccgtaaacccgtaaaccgggtaacccgaaaaccccggtaaaccccccctaaaaccgttaaccgtaacctttaacgttaaccgttttaacgttaaaccgggtttaaacgttacccggttaaccggtaaaacccgggtcccccgggtaacccccggttaaaccggggtaaccgggggtttaaaccttaacggtttaaaccgttacccgggttcccgttttaccgttcccggttaaccgggttaccttacccccggttaaacggtttaacccggttacccggtaaccggtaaaccccggtaaccccgggttaacccccgttcccccggttaaccccgggtaccccggtttacccgtccccgggtaacccccgttaacccggtaaaccgttaccccgggtaaacggggtaaacccgggttacccgggtaacccggggttaccgttaaacggtttaaccgttaaaccggtttaccggttaacccgggttaccccttaaccggttaccgtttaaaaccgttaaacggttaaacggtaaccgggtttaaaccttacccgtttaccggttcggttttaacccgggtttcgggtttaccggggacgggttaaacccgggtaaacgtaccggtaccgttacccggttaaccgttcccggggtaaacggtttaacccgggacccgttaacccggaaccggtcccgtttacccccggttacccggttacccgtccggtacccctttaccgggtttcccccgtttaacccccggg

SEQ ID NO: 92416 - DNA, 701 bp, Homo sapiens
  misc_feature: GYAE6OF02JGH3A.14.33.C11.1.454.CMB.1.raw
tcagcgtctagtaccacgaccggtgctcgatttagagtgagctcgttgggtttggggggggggtctcaggaggcagcgctctcaggacatctccaccatggcctgggctctgctgctcctcaccctcctcactcagggcacgagggtcctgggcccagtctgccctgactcagcctgcctccgtgtctgggtctcctggacagtcgatcaccatcctcctgcactcggaaccaacattgacgttggtgtattataactttgtcctcctaggtaccaacaaccaccagacaacgaccccaaactcaatctatttacagtaagtctactaacggcggccctagacgggtactactaactcgtcttctcgtcggtacctaccgaagtcgtcggacctaaccgaccggtccctcccgtgtacccgttctaccgtcggtccctacgaacgtaccgtggaacggacggaagtctacgtacttacttacgtcgacctacgtactaatagttaaggacgttaacgttactacccgtttaccgttcgggttttccgggtttaccggggtaccggtaaccgggtaacccgtaacgtccgggtaacccgtaccggttaacgggtacctaaccgggtaccccggtaaccggccgtttaccccggcccccgttaccgggttacctacccggttccgttccccggttaccccccg

SEQ ID NO: 92417 - DNA, 179 bp, Homo sapiens
  misc_feature: GYAE6OF02IYCEA.14.33.C11.1.454.CMB.1.raw
  modified_base (173)..(179): a, c, t, g, unknown or other
  misc_feature (173)..(179): n is a, c, g, or t
tcagcgtctagtaccacgaccggtgctcgatttagagtgagctcgttgggtttgggggaagaggaagactgacggtcccccaggagttcaggtgctgggcacagcggccctgggctgcctggtcaaggactacttccgtactagacgctgagcgggctggcaaggcgcatagnnnnnnn

SEQ ID NO: 92418 - DNA, 740 bp, Homo sapiens
  misc_feature: GYAE6OF02GCKTP.14.33.C11.1.454.CMB.1.raw
  modified_base (202)..(202): a, c, t, g, unknown or other
  misc_feature (202)..(202): n is a, c, g, or t
  modified_base (340)..(340): a, c, t, g, unknown or other
  misc_feature (340)..(340): n is a, c, g, or t
tcagcgtctagtaccacgaccggtgctcgatttagagtgagctcgttggggtttggggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacngtccgatcaccatctcctgcctactcggaaaccaactattggacgtttgggtatatttattaactttgtcctccgttacggtaaccaaccaaccaccccaggaccaaaccgccccccaaaactcaactctaattttanacgtaacgttctacgtaacggccggtaccctacggtacggggtatacctaagtccgtctttctcgttacggtcccttacgtaacggtttccgtacggtaaccaaccgtaccggtcccttacccgtacggtacccgttctccgtcggtccctaccgagaccgtggacgggtacgtagtcgtagtactttacttaccgcgtacccacgttacaactttagtaaacgtaacgttacgtaccgtttacgttccgttggtttacggggtttaccgggacgggtaacgggtaccgaacgccgttaccggtaaccccgttcggtaaccggtaccggtaaccggtcccggaacggtccccgtacccggtcccccggttcgttaccctaccggtttccgttacccccgg

SEQ ID NO: 92419 - DNA, 646 bp, Homo sapiens
  misc_feature: GYAE6OF02JRIFH.14.33.C11.1.454.CMB.1.raw
  modified_base (495)..(495): a, c, t, g, unknown or other
  misc_feature (495)..(495): n is a, c, g, or t
tcagcgtctagtaccacgaccggtgctcgatttagagtgagctcgttgggtttgggggggggtctcaggaggcagcgctctcaggacatctccaccatggcctgggctctgctgctcctcaccctcctcactcagggcacaggtcctgggcccagtctgccctgactcagcctgcctccgtgtctgggtcctccgtggacagtcgatccaccgtatcctcctgcctacgtacgggaacccaggcctaggtggtaacggtttggttaggttaataagttatgtcctccgtacggtaccaaaccgaaccacccgaggaccgaaaccgaccccctaaaactccagtagtaatttacaggtagtacgtagtaactccggaccctggttacgggttactatccgtcttctcgtcgtctaccaagtctcgacaacccgtcgtccctccacgactctctacgtcgcctcgagctaggagcgtacgtgtacgtattattagtncgtaatctactatcgtcgcgtaacctggactacgactagtaccttagttgggttacgggttccggggacgggtaacggtaaccgggtacgtacccggttacggttaccggtacgacgacccgtacggtaccctcccggtcccccgttacgg

SEQ ID NO: 92420 - DNA, 831 bp, Homo sapiens
  misc_feature: GYAE6OF02JVTES.14.33.C11.1.454.CMB.1.raw
tcagcgtctagtaccacgaccggtgctcgatttagagtgagctcgttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtccgatccaccatctcctgcacgtggaaaccactattgacgttggtgatttattaactttgtctctggtaccaacaccaccaggcaaacgccccaaactcactacattatagaagttctacttaagccggtcctacgtacggggtttacctaagtccgtactttcctcgtcggtactaccgtaaacgttccgttaggaccgtaaacggtaaccggtccccgtaccccgttaccggtaaaccctaaccgttaccgttcccggtacggggtacccctttcccggtaaccgggtaccgtttacggggaaacccgggttaacggtaaccggtttcccgttaaggttaacgttttaaacgtttttacggtttaccggtaccgtaaccgggtaaccgtttacctaagggttttaacgtaccggttccccgtttaaacccggtacgggtaccggtaacgtaccgttaaaaccggtaccttaagggtttacgggttttccggggttttaccgggggaccggggggttaaccggtaaaccgggttccgggtaaccggttaaccccgggttacgggacttaacccggggaccccgtaacgggttcccgtcccgggtttacccccgtcccggttaacccgg

SEQ ID NO: 92421 - DNA, 255 bp, Homo sapiens
  misc_feature: GYAE6OF02G9M8R.14.33.C11.1.454.CMB.1.raw
  modified_base (249)..(255): a, c, t, g, unknown or other
  misc_feature (249)..(255): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccaccctcctcgtactagacgctgagcgggctggcaaggcgcatagnnnnnnn

SEQ ID NO: 92422 - DNA, 763 bp, Homo sapiens
  misc_feature: GYAE6OF02JSLOQ.14.33.C11.1.454.CMB.1.raw
tcagcgtctagtaccacgaccggtgctcgatttagagtgagctcgttgggtttgggggggggtctcaggaggcagcgctctcaggacatctccaccatggcctgggctctgctgctcctcaccctcctcactcagggcacagggtcctgggcccagtctcgccctgactcagcctcgcctccgtgtctgggtctcctggacagtcgatccaccatctcctgcctactcggaaccaactattcggacgttggtgattattaactttcgtactccgtcggtacctaacaaccaccgacggactaaccgaccccaaactacattccagtttatacgtactctacgtaacgccgtcctcgtaggtactacgtatcgtcttcctcgttacggtcctaccgagttacgtacgtacaaccgaccgtcccttcccgttaccgtacccgttcttcccgtcgtacccgtacctaacgtccgtaggaacgggtaccggacggttacgtcgttaagtttaccttaaccgtccgtaccctaaccgttactagtaaacggttaacgtaaacggttaacgttaaccccttacgttacccggtttaacgggtttccgggttttaccgggacccggggtaaacgggaaccctaaggttccgtaacggtccccggttaacggttacggttacccggtaaccggtacccgaaccggtttcccgttcccccggtccccgggttaaccggttcccttaccccggttttacccgtccccccgggg

SEQ ID NO: 92423 - DNA, 674 bp, Homo sapiens
  misc_feature: GYAE6OF02IY5LU.14.33.C11.1.454.CMB.1.raw
  modified_base (272)..(272): a, c, t, g, unknown or other
  misc_feature (272)..(272): n is a, c, g, or t
  modified_base (672)..(672): a, c, t, g, unknown or other
  misc_feature (672)..(672): n is a, c, g, or t
tcagcgtctagtaccacgaccggtgctcgatttagagtgagctcgttgggttttgggctctgctgctcctcaccctcctcactcagggcacagggtcctgggcccagtctgccctgactcagcctgcctccgtgtctgggtctcctggacagtcgatcaccatctcctgcactggaaaccaacattgacgttggtgattataactttgtctctgtacaacaacaccagcaaacgccccaaatcatcattatgaagtctactaagcggccctnagggtatcgtaatcgtcttctctggctaccaaggtctggaccaacgaccggccctcctacgaccgttcttccgtcggcctaccagtaactaggacggacgaggtctaggtaatttaacttacgtcgaccctaacttcctaaattaagtaaacggtaaacgttaacgttaaactaacccgttcgttacggtttcgggttttcgggacggggtaaacgggtaacccaaaggtccgttaaccggtaccggttacccgtagggtacccaccggtacccgtaaacgggccccttaccggccccctttcgggtcctaacttcccgttcgttacccgcccttccgtaccgttaactacggacgtccgtaggtacggcgggaccgtcgggacgacggcaccgtagtancg

SEQ ID NO: 92424 - DNA, 253 bp, Homo sapiens
  misc_feature: GYAE6OF02I5LBZ.14.33.C11.1.454.CMB.1.raw
  modified_base (244)..(253): a, c, t, g, unknown or other
  misc_feature (244)..(253): n is a, c, g, or t
tcagcgtctagtaccacgaccggtgctcgatttagagtgagctcgttgggtttgggggtggtggtggtctccactcccgccttgacgaggctgattattactgccactcatatagaagtagtactactcctgtggtttcgcggaggacaagctgaccgtctaggtcagcccaaggctcgccccctcggtcactctgtcccgcctcctcgtactagacgctgacgcggctggcaaggcgcatagnnnnnnnnnn

SEQ ID NO: 92425 - DNA, 651 bp, Homo sapiens
  misc_feature: GYAE6OF02IT85I.14.33.C11.1.454.CMB.1.raw
  modified_base (136)..(136): a, c, t, g, unknown or other
  misc_feature (136)..(136): n is a, c, g, or t
  modified_base (191)..(191): a, c, t, g, unknown or other
  misc_feature (191)..(191): n is a, c, g, or t
  modified_base (430)..(430): a, c, t, g, unknown or other
  misc_feature (430)..(430): n is a, c, g, or t
  modified_base (649)..(649): a, c, t, g, unknown or other
  misc_feature (649)..(649): n is a, c, g, or t
tcagcgtctagtaccacgaccggtgctcgatttagagtgagctcgttgggtttgggctctgctgctcctcaccctcctcactcagggcacagggtcctgggcccagtctgccctgacctcagcctgcctccgtgtntgggtctctggacagtcgatcacatctcctgcactgaaccatatgtacgttggtnatttactaactttgtcctccgtcgtaaccaacaacctacccgaggaccaaaccgaccccaactacatactattagtagaacgtactactaacggcggccccgtacgaagggttactacgttaatccgcttcgtctacggcctaccaagtcgtcgaaccaccgtccggccctccgtcgtaccgtcttccgcggtcctacgagtcgaggtacggacgagtcctagttaattctatcgaccncttacgtatagagttaatacgtactacgttcggtggttcggttcggacgggtacgtaccgtacgactccggtaccgtacgtgtaccgaccggtaccaggccctcccggtcccctacggtaccgtaccttcggtacccttacccgtaccctccgtaccgttacgtaccggtcgtacgtcgggtacgtcggtacggtccggacggacggaccgatacgtanac

SEQ ID NO: 92426 - DNA, 637 bp, Homo sapiens
  misc_feature: GYAE6OF02I08F1.14.33.C11.1.454.CMB.1.raw
  modified_base (185)..(185): a, c, t, g, unknown or other
  misc_feature (185)..(185): n is a, c, g, or t
  modified_base (203)..(203): a, c, t, g, unknown or other
  misc_feature (203)..(203): n is a, c, g, or t
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
tcagcgtctagtaccacgaccggtgctcgatttagagtgagctcgttggggtttggggggggggtctcagggaggcagcgctctcaggacatctccaccatggcctgggctctgctgctcctcaccctcctcactcagggcacagggtcctgggcccagtctgccctgactcagcctgcctcgtntcgtgggtctcctggacngtcgatcacatctctgcactggaaccaactattgtacggttggtanatttataatttnttctccttggtaccaacaaccaccagacaaacgcccccaaactcactctatttagtagaacgttctactaggaccggtccctcgaggggtactactaacgtctcttctactcgtcctccaacgtcgtaggacaacgaccggccctcctacgtccgttctctcggcctaccgagtcgtaggcggacgtacggtactagtacttaattacgtcgaccttacgtactactaagttaagtaacgttaactactttaccttccgttcggtttgggttttacggcgggtacgaaccgttacgccgtacgacccggtacttcggtacgacgttacccgaacggtccgtaccgtccccgtacggtcctacccggttcttacccg

SEQ ID NO: 92427 - DNA, 693 bp, Homo sapiens
  misc_feature: GYAE6OF02FKUSP.14.33.C11.1.454.CMB.1.raw
  modified_base (560)..(560): a, c, t, g, unknown or other
  misc_feature (560)..(560): n is a, c, g, or t
tcagcgtctagtaccacgaccggtgctcgatttagagtgagctcgttggggtttggggggggggtctcaggaggcagcgctctcaggacatctccaccatggcctgggctctgctgctcctcaccctcctcactcagggcacagggtcctgggcccagtctgccctgactcagcctgccctccgtgtctgggtctccgtggacagtcgactcaccagtcctctgcacgtacggaaaccaatagttggacggtttgggtataattaacttaactttcgtcctccgttacggtaaccaacaaaccacccaacggtaccaaaccgaccccccaaactctactactacttaagtagtaacgtctacgtaacgcccggtacccgtcgacgggtactactaacgtccgtcttccgtctacggtcctaccgtaacgtcgtacgaccgaacctaccggtccctacccgtacgtacccgtcgtccgtccggtcctacccgtacgtaccgtcggaacgggacgacggtacgtcgtattaaccttactaccgtacctacctactaactaanaacgtaaaggtaacgttactaaccgttcgttgggttcggttcggacgggacgaccgacgtccgtacgtccgtacgtacgacgtaccgtacccgacggtccgtcccgtacccgtccggacctccgtactccccg

SEQ ID NO: 92428 - DNA, 809 bp, Homo sapiens
  misc_feature: GYAE6OF02HW4I2.14.33.C11.1.454.CMB.1.raw
  modified_base (807)..(807): a, c, t, g, unknown or other
  misc_feature (807)..(807): n is a, c, g, or t
tcagcgtctagtaccacgaccggtgctcgattttagagtgagctcgttgggtttgggctctgctgctcctcaccctcctcactcgagggcacagggtcctgggcccagtctgccctgactcagcctgcctcgtgtcgtgggtctccgtggacagtcgatcaccactctcctgctactaggaacccaactattgtacgttggtagtatttaacttaactttcgtccgttccgtacggtaacccaaacaaccacccgaaggaccaaaccgacccccaaactcatctaatttagtcgaacgttctacgtaacgcccggcccgtacggtacgggtacttactaacttcgtccttcgttacgttcggaccttaccgtaacggttccgttacggaacctaaaccggtcccggtccccttacccccgtacgtacccggttcctccggtccgtccccttaccgacgttacgtacgggacggtaccggtacggacttacggtaactttaacgttacgtccgtacccgttactactaagttaagtaacgtaacgtttaaccgtttaaccgttaccttccggtttagggttttccgggtttacgggaacgggtaacggtacccgtaacggacgttaccgtacccggttaccgttacggtaccaccggtacctaacccgggttccctaccccggttcccccgtaccggttcccgtaccgtttcccgtttcccggttccccgttacccgttcccgttaccgttaccgacggtccgtacgtacggcggtcggacgtacggaccgtacggaccgtacagtcncg

SEQ ID NO: 92429 - DNA, 257 bp, Homo sapiens
  misc_feature: GYAE6OF02JB9FW.14.33.C11.1.454.CMB.1.raw
  modified_base (247)..(257): a, c, t, g, unknown or other
  misc_feature (247)..(257): n is a, c, g, or t
tcagcgtctagtaccacgaccggtgctcgatttagagtgagctcgttgggtttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccgcctcctcgtatctctcgctgacgcggctggcaggcgcatagnnnnnnnnnnn

SEQ ID NO: 92430 - DNA, 575 bp, Homo sapiens
  misc_feature: GYAE6OF02IJXCV.14.33.C11.1.454.CMB.1.raw
  modified_base (506)..(506): a, c, t, g, unknown or other
  misc_feature (506)..(506): n is a, c, g, or t
tcagcgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaactattgacgttggtgattataactttgtctcctgtaccaacaacaccaggcaaacgccccaaactcatctatttatgaagtctcgtaagcgcctcagggtactactaatcgcttctctgctcagtctggcaacgcgcctccgtgaccgtctcgtcgcctcagctgacgacgaggctgattactactgccgtactacataagtagaacgtactactactccgtggttcggtttcgggacgtacgggacaagtcgtacgaccgttaccgtagtcgaccgtacccgagtacctcccggccccttcgcctaccgttactcccgttacccncccttacgtcctacgttcctcgtccgagttcggacgtccgggctacggtaaccgaggtcgacctaggtc

SEQ ID NO: 92431 - DNA, 563 bp, Homo sapiens
  misc_feature: GYAE6OF01AOTUS.45.19.B08.1.454.CMB.1.raw
  modified_base (419)..(419): a, c, t, g, unknown or other
  misc_feature (419)..(419): n is a, c, g, or t
  modified_base (501)..(501): a, c, t, g, unknown or other
  misc_feature (501)..(501): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccgaggggagagagtccaccctctcctgcacggccagtcaaagtgttcgcaccggatacttagcctggtaccagcagacgacctggccagccctcccaggcctcctcatctatggtgcactccctccgagggtccctcgtcgggtcgtcccccgcgtaggttcaggtcggcagggtcgggtctggggacaggtacgttccactctcaccatcagcagcctgcagtctagaagtntttgacgttattttattattgtctgtctattataatgctggtccctgggtaccgttcggacccgagggtaccgtagggttanaaactcgaaacggtacgtggtggctacggaccacctagttcctagttccttctacgttcccg

SEQ ID NO: 92432 - DNA, 619 bp, Homo sapiens
  misc_feature: GYAE6OF01ETBR4.45.19.B08.1.454.CMB.1.raw
  modified_base (308)..(308): a, c, t, g, unknown or other
  misc_feature (308)..(308): n is a, c, g, or t
  modified_base (445)..(445): a, c, t, g, unknown or other
  misc_feature (445)..(445): n is a, c, g, or t
  modified_base (595)..(595): a, c, t, g, unknown or other
  misc_feature (595)..(595): n is a, c, g, or t
  modified_base (611)..(611): a, c, t, g, unknown or other
  misc_feature (611)..(611): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccgaggggagagagtccaccctctcctgcacggccagtcaaagtgtcgcaccggatacttagcctggtaccagcagacgacctggccacgccctccgaggtcctccctcattctagtgggtcncctactccctccgacgggtccctcgtcggtccgtcccccgcgtacgggttcaggtcggctagggttcggggtcgtagggactaggtacgttccactcctaccacctatcgacgcacgtcctgctagtctagaagttntttggacttattttattattgtctgtacttaattataagtagtcgttccggtcccgttagggtaccggtttccggacccgaacggggtacccgtagggggttaacaaacgttaaccgaaacggtacgtggtacggctacgactaaccgtnttcttagttccttacnccttcccg

SEQ ID NO: 92433 - DNA, 505 bp, Homo sapiens
  misc_feature: GYAE6OF01A2WC8.45.19.B08.1.454.CMB.1.raw
tcagacgcgatcgacacgaccggtgctcgatttagtgagtcagtaagggggcatcacacaacaaccagattcctcctccaaagaagcccctgggagcacagctcatcaccatggactggacctggaggttcctctttgtggtggcagcaggtgcaggtgtccagtcccaggcccagctggggcaatctggggctgaggtgaagaagcctgggtcctcggtgaaggtctcctgcaaggcttctggaggcaccttcagcaactatggagtcagctgggtgcgccaggcccctggacaagggccagagtggttggggaggatcatccctctctatgggataccaaattacgcacagcaatttcagggcagagtcaccatttccgcggacaaatccacgggcacagcctatttggactcagcaacctgagatatgagacacagccgtatattactgtgcgagagatggcgtgcctgaacgcaagtcaacgacctacttacccgaggtac

SEQ ID NO: 92434 - DNA, 624 bp, Homo sapiens
  misc_feature: GYAE6OF01CVPOB.45.19.B08.1.454.CMB.1.raw
  modified_base (193)..(193): a, c, t, g, unknown or other
  misc_feature (193)..(193): n is a, c, g, or t
  modified_base (307)..(307): a, c, t, g, unknown or other
  misc_feature (307)..(307): n is a, c, g, or t
  modified_base (433)..(433): a, c, t, g, unknown or other
  misc_feature (433)..(433): n is a, c, g, or t
tcagacgcgatcgacacgaccggtgctcgatttagtgagtcagtaagggggaggaactgctcagttaggacccagacggaaccatggaagcccagcgcagcttctcttcctcctgctactctggctcccagataccactggagaaatagtggtgacgcagtctccaggcacctgtctgtgtctccgagggganagagtccaccctctcctgcacggccagtcaagtgtcgcaccggatactagcctggtaccagcagacgacctggaccacgccctcccgaggtccctcctcattccgtagtggtcnctactccctccgacgggtccctcgtcggtccgtcccccgtcgtacggttcaggtcggcgtaggtcggggtctggggactaggtcgttcacgtctcaccatcagcacgcctagctagtcagtaattntttgacttatttattattgtctgtacttaattaagtaattcgcgttcggtcccgtaggtaccggttccggaaccgtagggtaccgttaagggttaccgaaaacgttaccggtaaacggtacgttgggttacggaccttacgaacccgttaccgtagtttccgttagttaccctttccgtcgtttacccccg

SEQ ID NO: 92435 - DNA, 510 bp, Homo sapiens
  misc_feature: GYAE6OF01A5X4Q.45.19.B08.1.454.CMB.1.raw
  modified_base (355)..(355): a, c, t, g, unknown or other
  misc_feature (355)..(355): n is a, c, g, or t
  modified_base (464)..(464): a, c, t, g, unknown or other
  misc_feature (464)..(464): n is a, c, g, or t
  modified_base (503)..(503): a, c, t, g, unknown or other
  misc_feature (503)..(503): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccaggggagagagtcaccctctcctgcacggccagtcaaagtgttcgcaccggatacttagcctggtaccagcagagacctggccagcctccaggctcctcatctatggtgcatcctcagggcctctggtcgtccccgctaggttcagtggcaggtgggtctgggacagngttcactctcacatcagcagcctgcagtctagaagtattttgacgtattttattattgtctgctattatatgctggccctggaccgttcgccgagggacctagggttanaaagtcgaaacgtactgtggctgcacgtatctagtcttncttcccg

SEQ ID NO: 92436 - DNA, 594 bp, Homo sapiens
  misc_feature: GYAE6OF01AS4B2.45.19.B08.1.454.CMB.1.raw
  modified_base (366)..(366): a, c, t, g, unknown or other
  misc_feature (366)..(366): n is a, c, g, or t
  modified_base (386)..(386): a, c, t, g, unknown or other
  misc_feature (386)..(386): n is a, c, g, or t
  modified_base (417)..(417): a, c, t, g, unknown or other
  misc_feature (417)..(417): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccgaggggagagagtccaccctctcctgcacggccagtcaaagtgttcgcaccggatacttagcctggtaccagcagacgacctggccagccctcccaggctcctcatctagtggtgcactcctccgacgggtcctcgtcggtcgtcccccgctaggttcaggtcggctaggttgggtcgngggacaggtacgttcactcncaccatcagcacgcctgcagtctagtaagtntttgacgttattttattattgtcttgtactatttataattcgcgttcggcccgttgggtaccgttccggacccggtacgggtaccgtaggggttacaaaacgttacgaaaacggtacgttgggtacggccgttagacccgtaaccttcttacgttacgttcttccgtacgttccccg

SEQ ID NO: 92437 - DNA, 565 bp, Homo sapiens
  misc_feature: GYAE6OF01DFC67.45.19.B08.1.454.CMB.1.raw
  modified_base (241)..(241): a, c, t, g, unknown or other
  misc_feature (241)..(241): n is a, c, g, or t
tcagacgcgatcgacacgaccggtgctcgatttagtgagtcagtaagggggcatcacacaacaaccagattcctcctccaaagaagcccctgggagcacagctcatcaccatggactggacctggaggttcctctttgtggtggcagcaggtgcaggtgtccagtcccaggcccagctggggcaatcgtgggctgaggtgaagagcctgggtcctcggtgaaggtctcctgcaggcttcgnggaggcaccttcagcaactatggagtcagcgtgggtgcgcaggcccctggacaaggccagagtggtgggagatcatccctctcgtagtgggactaaccaaagttacgcacagctaaatttcgagggtcagtacgtcaactacgttccgacggtaacaaagtcccgaacgggcacgacgtacctagtttacggaacctcgagaccaacgtgaagtatagtagaacggacacgagtaccgtaatattactgtagacgagagtagtcgggtcgtgaccgttaggaaccgactacgttacaaacggtacttacgttaaccgaggtacg

SEQ ID NO: 92438 - DNA, 547 bp, Homo sapiens
  misc_feature: GYAE6OF01C1HDN.45.19.B08.1.454.CMB.1.raw
  modified_base (461)..(461): a, c, t, g, unknown or other
  misc_feature (461)..(461): n is a, c, g, or t
  modified_base (541)..(541): a, c, t, g, unknown or other
  misc_feature (541)..(541): n is a, c, g, or t
tcagacgcgatcgacacgaccggtgctcgatttagtgagtcagtaagggggcatcacacaacaaccagattcctcctccaaagaagcccctgggagcacagctcatcaccatggactggacctggaggttcctctttgtggtggcagcaggtgcaggtgtccagtcccaggcccagctggggcaatctggggctgaggtgaagagcctgggtcctcggtgaaggtctcctgcaaggcttcgtggaggcaccttcagcaactagtggagtcagctgggtgcgccacggcccctggaccgaagggccaaggaggtgggttggggaggatcgactcccctctcgtagtgggaactaaccgaaattacgacacagactaagttcgagggcagacgtccacctactttccgacggtaacaaactccgacgggcacgagccttagttcggaactcacgcaacctganatatgacgacacgacgtacgtatattactgtcgcgagagagtggcgtgcctggacgacatacaacgtactaacttaccgnggtacg

SEQ ID NO: 92439 - DNA, 572 bp, Homo sapiens
  misc_feature: GYAE6OF01BY94W.45.19.B08.1.454.CMB.1.raw
tcagacgcgatcgacacgaccggtgctcgatttagtgagtcagtaagggggcatcacacaacaaccagattcctcctccaaagaagcccctgggagcacagctcatcaccatggactggacctggaggttcctctttgtggtggcagcaggtgcaggtgtccagtcccaggcccagctggggcaatctggggctgaggtgaagaagcctgggtcctcggtgaaggtctcctgcaaggcttctggaggcaccttcagcaactatggagtcagctgggtgcgccaggcccctggacagggccagaggtggttggggaggatcactccctctcgtagtgggaactaccaaattacgcacgagctaagtttcagggcaggatccacctatttccgacggacaaactccgacgggcacgacgccttagttacggaactcgacgaccaaccgtgaacgtatagtagaacgacaacgacgtaccgtattacgttacgtagtcgacggagtagaagtcgggtccgtggacccgtgaaccgactaacgtacaaccgtacttaacgttaacccgaggtaccg

SEQ ID NO: 92440 - DNA, 599 bp, Homo sapiens
  misc_feature: GYAE6OF01AD1MC.45.19.B08.1.454.CMB.1.raw
  modified_base (296)..(296): a, c, t, g, unknown or other
  misc_feature (296)..(296): n is a, c, g, or t
  modified_base (410)..(410): a, c, t, g, unknown or other
  misc_feature (410)..(410): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccaggggagagagtcaccctctcctgcacggccagtcaaagtgttcgcaccggatacttagcctggtaccagcagagacctggccagcctccaggctcctcatctatggtncatccctccgagggcctcgtggtcgtcccccgcgaggtttcaggtggcaggtgggtctgggacaggcgttcaacgtctcaaccgatcgagcagcctgcaagtctaggtaacgtnttttgacgttatttaactttattcgtactagctaattaactaagtacgtcgttcggacccttgggaaccgtttccgggaccgtaggggtaaccctaggggttacgtaaaacgtaccaaaaccggtacgttagggttacggcttaccggactaacccgtattccgttgttacctttcgaacgtttccccg

SEQ ID NO: 92441 - DNA, 726 bp, Homo sapiens
  misc_feature: GYAE6OF01CZLXU.45.19.B08.1.454.CMB.1.raw
  modified_base (196)..(196): a, c, t, g, unknown or other
  misc_feature (196)..(196): n is a, c, g, or t
  modified_base (212)..(212): a, c, t, g, unknown or other
  misc_feature (212)..(212): n is a, c, g, or t
tcagacgcgatcgacacgaccggtgctcgatttagtgagtcagtaagggggaggaactgactcagttaggacccagacggaaccatggaacgcccagcgcagcttctcttcctcctgctactctggctcccagataccactggagaaataggtggtgacgcagtctccaggcacctgtctgtgtctccgagggganagagtcaccctctccngcacggccagtcaaagtgtcgcaccggatacttagcctggtaccagcagtacgacctggaccagtccctaccaaacgtcctcactcctcgtgggtctaactcctaccgagggcctacgtggtcgtacccaggactacggttacgaagggtctaggttcgggtactaggggaactaggttacgtacccgtaacttccgtaccgaaccctagtccggaacggtccggtcctacgacgttaacggtctaagtaaacgtttagttttacggtaactttttaactaccgttggttacaaggtacgtaaagttacttaactcgtaacgttcgggtacccgtaacgtttacggtttaccgggggacccggggtaactaaggttcgttaagggtacgtaacggtaaccgtaaaacgtaacggttcggtacgggtccgttacggaaccgtaaacccgtccgtttaacggtacccgtttacctttaccgtaacctttccccggtttaccccgtaccgttaacgg

SEQ ID NO: 92442 - DNA, 847 bp, Homo sapiens
  misc_feature: GYAE6OF01AUIGB.45.19.B08.1.454.CMB.1.raw
tcagacgcgatcgacacgaccggtgctcgatttagtgagtcagtaagggggcatcacacaacaaccagattccctcctccaaagaagcccctgggagcacagctcatcaccatggactggacctggagttctctttgtggtggcagcaggtgcaggtgtccagtcccaggcccagcgtggggcaatcgtgggctggaggtgaagaagcctgggtccgtggtagaacggtctccgtgaccgaaggtcttccgtaggacggacctaccgttacgaggtacctaaacgtagtcggaacgttccgaggtcggttcggggtcgacccggacccggtaacggtcccccgtaagggaccgtaaacgggtcccgaaggtacgggttaggggttaggggaacggtacgtccgtaaccgttccccgttacttaacgttacggtacgggtaaacctaaaccggttaaaacgttacccgggtactaacgtaacgttaccgtaagtttaccggaagggtactacggtaacggttaccctaaccgttaccggtttacccggaacggtaaccgtaaacgttccccggaaccgggtacctaaaccggtacgtacccgtttaagtaaccgggtaacccttacggaacgaccgtaacccgttaggaacgttaactagggtacgaacggtaaccgtaacgtaaccgggtaaccgtttaacgttaaagtttacccgtaggtacggtaacggtaacggtaaacgggtacgttacgggtccggttaccctacggtaaaccgggaaccgtacgttaaccggtaaaccgttaacccggtaaagtttaaccttaaccgggtggtaaacccgg

SEQ ID NO: 92443 - DNA, 569 bp, Homo sapiens
  misc_feature: GYAE6OF01A441J.45.19.B08.1.454.CMB.1.raw
  modified_base (195)..(195): a, c, t, g, unknown or other
  misc_feature (195)..(195): n is a, c, g, or t
  modified_base (347)..(347): a, c, t, g, unknown or other
  misc_feature (347)..(347): n is a, c, g, or t
  modified_base (401)..(401): a, c, t, g, unknown or other
  misc_feature (401)..(401): n is a, c, g, or t
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
  modified_base (477)..(477): a, c, t, g, unknown or other
  misc_feature (477)..(477): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccgagggganacagcccaccctctcctgcagggccaggtaggagtgtacaagtaagtacttaggctaggtaaccaacgagaaacctggccaggcctcccgaggcctcctcactccatgatgcatccaacgcgggtccctggcctcccagactcgggttccgnggcaggtcgggtctgggacagtacgttcactctcgaccgtcagcagcctggacncctgatgtatttgcttagtttcttctgtcagtcgacgtccgtccgcncgccnctcgtacgttcgggcggggtacgngggtgagagtggacgacggtacgtggtcggcgtcgaccgtaccgtacgttccgttcgttccttaccgtacctttcccgttccccgccttacg

SEQ ID NO: 92444 - DNA, 779 bp, Homo sapiens
  misc_feature: GYAE6OF01CNPWO.45.19.B08.1.454.CMB.1.raw
  modified_base (252)..(252): a, c, t, g, unknown or other
  misc_feature (252)..(252): n is a, c, g, or t
tcagacgcgatcgacacgaccggtgctcgatttagtgagtcagtaagggggcatcacacaacaaccagattcctcctccaaagaagcccctgggagcacagctcatcaccatggactggacctggagttctctttggtggtggcagcaggtgcgaggtgtccagtcccaggcccagcgtggggcaagtcgtggggctggaggtgaagaagtccgtgggtcctggtgaaggtctccgtgactaaggctttcgnggagctaccttgacgctaactagtaggagtcgagcgtgggtcgccgccgacggccccgtaggaacgaacgggtccagggtaggtgggttggggaggtactctacgttccctacgtcgtaggtagggtaactaaaccgtaaagttaccgacgtaacgtacgtaccttaaacgtttcgaacgggtactaagggtaacgttaccgtaacctaacgtttacccggaaccgggtaaactaaaccgttccggaaccggtaccaaccggtaacgtaccgtttaacgttacgggaacttaccgaacgtaccgtaaaccgttagtaacggtaactaagttaacggtaacggaaccgtaccggtaaaccgggtaccgttttaaacgttaacgtttaccggttagacgggttaacggaacggtaagggttaacgttcggggtaccgttaacggttaccgtaaccggaacgggtacctaacggttaacccgtaaaaccggttaccgttaaaccggttacccggtaagggtttaacccgg

SEQ ID NO: 92445 - DNA, 608 bp, Homo sapiens
  misc_feature: GYAE6OF01D5N0Z.45.19.B08.1.454.CMB.1.raw
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccgaggggagagagtcaccctctcctgcacggccagtcaaagtgttcgcaccggatacttagcctggtaccagcagagacctggccagcctccaggctcctcatctatggtgcactccctccgagggtccctcgtcggtccgtccccgaccgtacggttcaggtcggcgtaggttggggtcgtgggactaggtagttcacgtctcaaccgtatccagcacgcctgacgtagtctagtaagtatttcgacgttatttatttagttgtctgtactaattactaatacgtcgttcggtcccgtaggtaccggttccggtacccgacgggtaccgtaagggttaacgaaaacgtaaccgaaaacgtaacggttaggtacggtctacgtaccaactacgtcgttacgtttacttccgtacgttccccg

SEQ ID NO: 92446 - DNA, 615 bp, Homo sapiens
  misc_feature: GYAE6OF01ETJP9.45.19.B08.1.454.CMB.1.raw
  modified_base (305)..(305): a, c, t, g, unknown or other
  misc_feature (305)..(305): n is a, c, g, or t
  modified_base (337)..(337): a, c, t, g, unknown or other
  misc_feature (337)..(337): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccaggggagagagtcaccctctcctgcacggccagtcaaagtgttcgcaccggatacttagcctggtaccagcagagacctggccagcctccaggctcctcatccatgatgcatccaacncgggtccctggccgtcccagaccaggttccgnggcaggttcgggtctaggggacaggtagttccactcctcaccggtcagcagccgtggacgcctgattgtatttgctagtttacttcgtgtctagtctacggtccgttccgccgtaccgcccgtcctccgtaccggttttccggggaccgggggtaccggtacggggttacgggaacggtacgtacgggaacggtaaccgggtaaacgttgggtacgggtccgtacggacccgtaaccgtaacgttccgttacgttcctttcgtaccgtttacccccgg

SEQ ID NO: 92447 - DNA, 811 bp, Homo sapiens
  misc_feature: GYAE6OF01DYIQA.45.19.B08.1.454.CMB.1.raw
  modified_base (198)..(198): a, c, t, g, unknown or other
  misc_feature (198)..(198): n is a, c, g, or t
  modified_base (795)..(795): a, c, t, g, unknown or other
  misc_feature (795)..(795): n is a, c, g, or t
tcagacgcgatcgacacgaccggtgctcgatttagtgagtcagtaagggggaggaactgctcagttaggacccagacggaaccatggaagccccagctcagcttctcttcctcctgctactctggcctcccagataccaaccggaaaaattgtgttgacacagtctccaggccaccctgtctctgtctccgagggganacacgcccaccctctccgtggcgacgggccaggtaggagtgtacaaggtaacgtacgttaggcgttacggtaccaaacaacggtaaacccgtggacccgacggccctacccgaaggccttcctacacttcccattcgatcgactacctaccgaaacggtcggggtccctgggcccgtaccgacggaaccgttacgggtttcccggaggtacgtagggttcgggtcgtacggggaccaagggtactttaccgaccttccgtacctaaccggtcacggacctaccggtccgtgggacgtccgtagtacgtttacgtacgtttttcgaaccgttttacgttttacctttcgtacgttaccacggtccgtaccggtcccggtttaccccgacccggtcccgcccggttacccgtttacccgggtaacggggtttacccgggggggacccgggggtaacccgggtaggggtttaccgggaacgttaggtaccgggtaaggtaaccgggttacgttcggggtaccgtaccgttccgggtacccttaaggttaacccttcggttccggtttacccttaacgtcccctttacccggtacccccgnttacgttcggtaccgg

SEQ ID NO: 92448 - DNA, 585 bp, Homo sapiens
  misc_feature: GYAE6OF01EDKFE.45.19.B08.1.454.CMB.1.raw
  modified_base (427)..(427): a, c, t, g, unknown or other
  misc_feature (427)..(427): n is a, c, g, or t
  modified_base (518)..(518): a, c, t, g, unknown or other
  misc_feature (518)..(518): n is a, c, g, or t
  modified_base (559)..(559): a, c, t, g, unknown or other
  misc_feature (559)..(559): n is a, c, g, or t
  modified_base (575)..(575): a, c, t, g, unknown or other
  misc_feature (575)..(575): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccgaggggagagagtcaccctctcctgcacggccagtcaaagtgttcgcaccggatacttagcctggtaccagcagagacctggccagccctccaggcctcctcattctatggtgctactccctccgagggtccctcgtcggtcgtcccccgcgtaggtttcaggtggctaggtgggtcgtaggggacaggtacgttcactcctaccgaccatccagccagcctggactagtctagtaagtntttgacgttattttattattgtctgtactatttaataatgaccttggcccgtgggtacccgttccggacccgtagggtaccgtagggttanaaacgtaccaaacggtacgttggacggctacgacaaccgtnttccgtagttccttcncgtttccccg

SEQ ID NO: 92449 - DNA, 579 bp, Homo sapiens
  misc_feature: GYAE6OF01DS4CZ.45.19.B08.1.454.CMB.1.raw
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccaggggagagagtcaccctctcctgcacggccagtcaaagtgttcgcaccggatacttagcctggtaccagcagagacctggccagcctccaggcctctcatctatggtgctatccaacgcgggtccctggccgtcccagacgacggttccgtggcaggtgggtctgggacagtacgttcactctcaccgtcagcacgcgtggacgtcctgatgtatttgactagtttctctgtcagtcagtccgtccgcctcggcccgcttacgtacgtttccggggcggggggacccgtagggggtcggtacggattagggacgaacggtaacgtggtagggccttgaccgtacccgtagtttcccgttacgtttccttaacctcgttcccgttacccccg

SEQ ID NO: 92450 - DNA, 740 bp, Homo sapiens
  misc_feature: GYAE6OF01BC697.45.19.B08.1.454.CMB.1.raw
  modified_base (195)..(195): a, c, t, g, unknown or other
  misc_feature (195)..(195): n is a, c, g, or t
  modified_base (295)..(295): a, c, t, g, unknown or other
  misc_feature (295)..(295): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccgagggganagagtcaccctctcctgcacggccaagtcaaagtgttcgcaccggatacttagcctcggtaccagcagacgacctggccagccctaccgagtcctccctnactctatggtcgctacttcccgtcgacggtcctcgttcgggtccgtccccgccgtaggttcgtacggtcggacgtagggtcgggtcgtacggggacaggtacgtttaccaccgttcctaccgaacctacgttaccgaagccgtaacgtcccgtacggacgtacgttacggttaagtaacggtttacgtttttcgggaaccttttaagtttttaacgttttagttttccgtttacttacggttaacttaaagtttttaacgttaaacgttaccggttacggttaccgggttaccccggttagggggtttaccccggttaccggacccgggtaacgggtaacccggttagggtaacgtaaacgtaaaccgtaaaccggtaacggttacggtacggtctacggtacctacgtacgttacgttacggttaccttccgtacgttaccccg

SEQ ID NO: 92451 - DNA, 544 bp, Homo sapiens
  misc_feature: GYAE6OF01EZ4H8.45.19.B08.1.454.CMB.1.raw
  modified_base (538)..(538): a, c, t, g, unknown or other
  misc_feature (538)..(538): n is a, c, g, or t
tcagacgcgatcgacacgaccggtgctcgatttagtgagtcagtaaggggggaggaactgctcagttaggaccccagacggaaccatggaagccccagcgcagcttctcttcctcctgctactctggctcccagataccactggagaaatagtggtgacgcagtctccaggcaccctgtctgtgtctccaggggagagagtcaccctctcctgcacggccagtcaaagtgttcgcaccggatacttagcctggtaccagcagagacctggccagcctccaggctcctcatctatggtgcatcctccagggccctcgtggtcgtccccgctaggttcagtggcgtagtgggtctgggacagagttcactctcaccatcagcacgcctgcagtctagaagtatttgacgtattttattattgtctgtctattaataatagctcggccctggtaccgttcgggacccaggggacctaggggttacgaaatacgaaaacgtaacgtggtcggcgtacgacaccgtattcttagttccttctnttcccg

SEQ ID NO: 92452 - DNA, 636 bp, Homo sapiens
  misc_feature: GYAE6OF01CIL02.45.19.B08.1.454.CMB.1.raw
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
  modified_base (449)..(449): a, c, t, g, unknown or other
  misc_feature (449)..(449): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctcgaggggagagagtccaccctctcctgcaccggcagtcaaagtgttcgcaccggatacttagcctggtaccagcagagaccgtggccacgccctccgaggcctcctcatctagtcggtncactcccncgacgggtcctcgtcggtccgtccccgcgtaggttcgaggtcggacgtagggtcgggtcgtaggggactaggtacgttccaccttctccaactatccgacgccacggtccctggacctagtcgttaagtaaggtttntttaggactttaattttagtttagttcgtctgtacttaattaattaagtcgtcgttcggtaccccgttgggtacccggtttccggacccggtacggggaccgttaggggttacaaaaccgtaccgaaaacggttcgtaggtacggtctcgaacctaccgtattacgttgtttccttacgtcttcccg

SEQ ID NO: 92453 - DNA, 641 bp, Homo sapiens
  misc_feature: GYAE6OF01EED4I.45.19.B08.1.454.CMB.1.raw
  modified_base (107)..(107): a, c, t, g, unknown or other
  misc_feature (107)..(107): n is a, c, g, or t
  modified_base (264)..(264): a, c, t, g, unknown or other
  misc_feature (264)..(264): n is a, c, g, or t
  modified_base (305)..(305): a, c, t, g, unknown or other
  misc_feature (305)..(305): n is a, c, g, or t
  modified_base (411)..(411): a, c, t, g, unknown or other
  misc_feature (411)..(411): n is a, c, g, or t
tcagacgcgatcgacacgaccggtgctcgatttagtgagtcagtaagggggagggaactgctcagttaggacccagacggaaccatggaagccccagcgcagcttcncttcctcctgctactctggctcccagataccactggagaaatagtggtcgacgcagtctccaggcaccgtgtcctgtgtctccgagggagagagtcgaccctctccgtgcacggccgagtccaaagtggttcgcaccggatactacgcctggtaccnggctacgacgtaccgcggcctacgcctaccaggtcctaccncatctagtcggtgtccactcccgtccgacgggccctcgtggtaccgtccccggtccgtaggtcgtaggtcgggctaggtcggtcgtaggactgtacgtctacgtcnccaacctgtacgacgtaccgagtcctagcgacgtcctaggtaatagtttcgactagtttattatcgtactacgattacgttaagaatcgtacggtaccgtcccggttacggaccgtttccggaccgtacgggtaaccgttagggtacccgttaaagtaaccgtaaacggtaccgtagggtcgtacccgtcgacccgactccgttacgtcggttccttccgacgttccccg

SEQ ID NO: 92454 - DNA, 732 bp, Homo sapiens
  misc_feature: GYAE6OF01D4HML.45.19.B08.1.454.CMB.1.raw
  modified_base (201)..(201): a, c, t, g, unknown or other
  misc_feature (201)..(201): n is a, c, g, or t
  modified_base (373)..(373): a, c, t, g, unknown or other
  misc_feature (373)..(373): n is a, c, g, or t
  modified_base (457)..(457): a, c, t, g, unknown or other
  misc_feature (457)..(457): n is a, c, g, or t
tcagacgcgatcgacacgaccggtgctcgatttagtgagtcagtaaggggggaggaactgctcagttaggacccagacggaaccatggaagccccagcgcagcttctcttcctcctgctactctggctcccagataccactggagaaatgtgatgacgcagtctccacgcccacctgtctgtcgtcctacggaaggggaancgtcctaccctctcctgcgacggccacgccgagtacgtgacacgcagcgtaacttcgccgtacggtaccacgacaacggaaccgtcggaccgacggtccctacccgaggtcctccctactacgttctaggtcggtacttcccttaccgtccggaggcctacgttcggtaccncccgacgtcggttaggttcgaacgggtcggaccgtagggggttccggtacgggtacggtaccgtacgggtttacccttttaccncctaacccgaaccttacgtaccgaaaccgtcccgtacctaccgtacgtacttacggtaaacttttgtttacgtactttaacgtttaacttacgttccgtaacctacgttaagtaaacttaacgtaacggttccgacccggttcggtacggtaccggtaccggaacggtaacgggacgtaagggaacgtaacaaccggtaaacgtcgtgggtaccgtacgtaccacacttacgttcttacgttaccttacctacctttccccgtccgtccttacgg

SEQ ID NO: 92455 - DNA, 699 bp, Homo sapiens
  misc_feature: GYAE6OF01CTH5W.45.19.B08.1.454.CMB.1.raw
  modified_base (324)..(324): a, c, t, g, unknown or other
  misc_feature (324)..(324): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggaagaaatagtggtgacgcagtctccaggcaccctgtctgtcgtctccgaggggagagacgtccaccctctcctgaccgaccggcagtacaaagtcgtcgcaaccggatactacgcctaggtaccagcaagacgaccgtcggccacgccctcccgaggtcctcctacacttcctagtggtacncctactcccgtacgacggtcctcggtacggtcccgtccccgacgtacggttcgacggttcggacgttagggtcgggttcgtacggggactacggtacttcgaacttcctacgaacctaatcgaacgctacggtccctagaccgtaagtacgtaagtaagttacgttttggactttaagttttagttattcggttcagtacttaatttaagtaacgtcggtacgttcccggtacccggttaagggtcccggttaccggacccggtaaggggtacccgtaaaggggtaacgtaaaccgtaaccgtaaaaaccgggtacttgggtacggtcggtaccaccgtactaccgttcttacgttaccctacgtcgttaccccg

SEQ ID NO: 92456 - DNA, 925 bp, Homo sapiens
  misc_feature: GYAE6OF01EZDUJ.45.19.B08.1.454.CMB.1.raw
tcagacgcgatcgacacgaccggtgctcgatttagtgagtcagtaaagggaaaggggtgatcaggactcctcagttcaccttctcacaatgaggctccctgctcagctccgtgggctgctaatgctcgtggtcccaggatccagtgggatgttgtgatgactcagtcctccactcctcctcgcccgtcacccttggacacgccgcctccatcgtcctgcaggtctagtacaaacgcctactatacgaggagtaggaaactctcaacgttagaattggtttaccaaacgaggaacggccctaaggacctaacgttaccaaccgaaacgggttaccgtaaccttaaaagtttttaaacggttaaaccgggtttttaaccgaaacccgggtaacctttaccgggtttaccgggggtaccccaaggaacccgtaagtaacgtttaccgaaggggtaccgggtacggtaaacgggtcggggttaccgaagggtacccgtaaacggttacggtaacggttttaacccaaacgttaaaccggttaaacggttaaaaaaggttttaacgggttaagggggttaacgggaacggtacggttacgggtaaagggtaaggtttacggttttagggtttaaacggtttttactttaccggttacgtagtaaacgttacggttaaacggtaaacgggttaactaaccggtaccggttaacgggttaaccccggtttaaccgttaacggtttttaccgggaaccgggtaaccgggggtaaacccgtaaaacggtaacggttaaaacccgggtaaaaacgttaaaccggtaaaaacccgggttaaaccggtagggttaccggtaaaccggtttacccgaacccgtaaaccgttaacgttacgttaaaccgtttccgttaaccgttaccgtttaacccccg

SEQ ID NO: 92457 - DNA, 799 bp, Homo sapiens
  misc_feature: GYAE6OF01COF1D.45.19.B08.1.454.CMB.1.raw
  modified_base (755)..(755): a, c, t, g, unknown or other
  misc_feature (755)..(755): n is a, c, g, or t
tcagacgcgatcgacacgaccggtgctcgatttagtgagtcagtaagggggcatcacacaacaaccagattcctcctccaaagaagcccctgggagcacagctcatcaccatggactggacctggaggttcctctttgtggtggcagcaggtgcaggtgtccacgtccaggcccagcgtgggcaatcgtgggctgaggtgaagagccgtggtcctcgggtgaaggtctccgtgcaaggtcttcgtggacggcctaccttcgagactaactagtcggagtcgagtcgtgggtacgccggccgacggccccgtagggaaccgaacgggcccagggtaggtggggttacgggggaaggtactacgtaaccttccccgttcgtaccgttaaggtaggggtaacctaaaccgtaaaagtttaaccggctaactaacggtaaccttaaagttttaccggaagggggacgtaagtaacgttaacctaacccgttacgtttacccggaaccggaaactaaaaccggtaccccgaaccggggactaaacccggtacgttaacccgttaacggttttacgggaaaccctttaccgaacggtaaaccctaaacccggttaggaaacgtaacgtttaacggtacggaaacggttaacccgaaacggtaaccggttacccgttaagtttaaacgtttacccggttagggtaacgaccgggtaaagacgtagggtaccgggtactacgggtacccgtaggaacccgtanacgttaaaccaacggttaaccttacgtaaaccgtcggttaaccg

SEQ ID NO: 92458 - DNA, 659 bp, Homo sapiens
  misc_feature: GYAE6OF01A4PX4.45.19.B08.1.454.CMB.1.raw
  modified_base (195)..(195): a, c, t, g, unknown or other
  misc_feature (195)..(195): n is a, c, g, or t
  modified_base (332)..(332): a, c, t, g, unknown or other
  misc_feature (332)..(332): n is a, c, g, or t
  modified_base (553)..(553): a, c, t, g, unknown or other
  misc_feature (553)..(553): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggccaccctgtctgtgtctcgagggganagagtccaccctctcctgcgagggccagtacggagtgtacaagttaagtacgttaggcttaggtaaccaagagtaaaccgtggaccaggcctccaggtcctctacatccatgatcgacactccgaacgcgggttccnggaccgtccgagtaccgtacggttccgtggacgtaggttcgggtcgtagggactaggtacgttccaacgttccacgtaccgtacgacgcgacgtccgtaggacgtccttagacttgtattttcgactttacgtttacttagtctagtctacgtccgttccgccgtaccgcgtccttccggttaccggttcgggggaccggggtaccgtaggggttaccggngtaacggtaggtaaccgtaaggtaccggttgtacgggccgtaggaccccttagtccttacgtttcgttaccgttttaccgtcccgttacccggctttcgtcgtacg

SEQ ID NO: 92459 - DNA, 676 bp, Homo sapiens
  misc_feature: GYAE6OF01AL8XL.45.19.B08.1.454.CMB.1.raw
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
  modified_base (635)..(635): a, c, t, g, unknown or other
  misc_feature (635)..(635): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatgtggtgacgcagtctccgaggcaccctgtctgtntctcgaggggacngagtccacctctcctgccacggccagtaccaagttcgtcgaccgtaaccggattaccgttacgccgtagggtacccagacgagacgtacctggaccacgccctaccgaggtccctaccgcgtactccttaggtcggtacgcctacgtcccgtaccggcgggttcctcggtcggtaccgtcccccgtacggtagtccgaggtcggacttcgggtcgggtcgtagggtactaacggttcgttacctaccgtcctacccgtacctagtaacgcgtaccacggtccacgtcggtaacgtctaaggtaagttcttacggtactttagtttaattcgttagtacgtacttagaacttttaaggaacttcgtaccggttccgaccgttcggtaccggtaccgaccggacggtaacgtacgggtataaacgtaacgacgtagtacggngtccgactcgaacttccggtatgttaccttcgacttccccg

SEQ ID NO: 92460 - DNA, 772 bp, Homo sapiens
  misc_feature: GYAE6OF01EPIWW.45.19.B08.1.454.CMB.1.raw
  modified_base (259)..(259): a, c, t, g, unknown or other
  misc_feature (259)..(259): n is a, c, g, or t
  modified_base (288)..(288): a, c, t, g, unknown or other
  misc_feature (288)..(288): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccgaggggagagagtccaccctctcctgcagggccaggtaggagtgtcagtaagtacttaggctggtaaccaanagaaacctggccaggctcccaggctcctnatccatgatcgcattccgaacgacgggtcccctggccgtacccaggactacgggttccgtggacacgggttggggtacgttgggggaaccagggtacggttttaccaaaccgtttccgtacccgtaaccccgggtttaccgaacggtccccgtaaacgggtcccccggtttaagggggaacccgttaccccgttaagggttaaccgtttggggttaacgttttttttcgggaacccttttaagggttttttaaccctttcggtttaccggttacgtaacgggtccttaccgggtacccggtttcccccggaacccgtaacccggccccggttctaccgttacccgggttttcggggggaccgggggggtacccgtaggggggttcgggaaggtacgttcgggaaggtaccgtaacggttgggtcggtcgtacgcctaccgtacttcgtaccggttctttacctagtcccctttcccggcttacg

SEQ ID NO: 92461 - DNA, 680 bp, Homo sapiens
  misc_feature: GYAE6OF01AMOV9.45.19.B08.1.454.CMB.1.raw
  modified_base (604)..(604): a, c, t, g, unknown or other
  misc_feature (604)..(604): n is a, c, g, or t
tcagacgcgatcgacacgaccggtgctcgatttagtgagtcagtaagggggcatcacacaacaaccagattcctcctccaaagaagcccctgggagcacagctcatcaccatggactggacctggaggttcctctttgtggtggcagcaggtgcaggtgtccagtcccaggcccagcgtggggcatcgtggggctgaggtgaagagccgtgggtcctcggtgagtctccgtgcaaggcttcgtgggacggctaccttcgagacaacgtagtggagtcgagtcgtgggtcgcgtcccgacggcccctaggaacgaacgggccaggtagggtggggttagggggacgtagttaccgacgttccccgtcgttaccgtagtaggggtaacctaaaccgtaaacgttaccgacgtaaccgacggtaacgttaactttacggaacggggtacgtaacggacgtaccgtacccgttacgtttacccgggaacgtaaacccgtaaacgtcccgaacgggaccctaagacggttccttaagttcggtaactacgacgacctaacgtgaacgtatacgtagaacggacacgtagtacccgttatagttacgtancggtacgaggtaggtagtacggtcgtacgtaccgcgtaacgctaactaccggaacgtactacgttacgcggtaacg

SEQ ID NO: 92462 - DNA, 658 bp, Homo sapiens
  misc_feature: GYAE6OF01EK6V0.45.19.B08.1.454.CMB.1.raw
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctcaggcaccctgtctgtgtctccgaggggagagagtcaccctctcctgcacggccagtcaagtgttcgcaccggatactagcctgtaccagcagagacctggccacgcctccgaggcctcctcacgttctagtggtcgccactcccgtccgacgggtccctcgtcgggtcccgtccccgccgtacggttcaggtcgaccgtagggtcgggtcgtcgggacaggtacgttccacttccgaccaccgatacgacgcacgtcctcgacgtagttcctagtaagttattttcgactttagtttttctttcgtcgttcgacgtaccgttagttaactacgtaattaacggtcggtcttagttaccgtttaggtttaccggaccgggtaaccgggtaaccgtaagggtacccgtaagggtaaacgtaaaccggaaacgttacggtcggtacggttctacgggtaccctaacccttattccgttaacgtttccttaaccccg

SEQ ID NO: 92463 - DNA, 841 bp, Homo sapiens
  misc_feature: GYAE6OF01CNNGD.45.19.B08.1.454.CMB.1.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
tcagacgcgatcgacacgaccggtgctcgatttagtgagtcagtaagggggaggaactgctcagttaggacccagagggaaccatggaagccccagctcagcttctcttcctcctggcactctggcctccagataccaccggagaaattgtgttgacacagtcctccagcctacctgttctttgttccgaaggggaaanacgccctaccctctcctgcgagggccagtcgtagggtnttaacngctacgttacgcctaggtaaccaaactaaaaccgtggacctaggacctcccgaggtcctacatactattcgtatcgaccgctagtaccgaacgcgggacctagtcggactacctcccgaggtcccgtaggttacgaggtcggcgtaggggttcgggtcgtacggggacctaaggttacccttacgtacccgtacccttaccgaaacccttataccgaacggtcccgtaaccggtcccgttaacccggggtaacccttaggggtaaacggtttttcttttaccggtaacccttttaaccgtttttacccgtaaccgtttcggtaacccgtaacggggtccgtaacggggtccgggttaaccgggacccggaaccccgggtaacgtccccggtacccgttaccgtttaccggggtttacccggggaaccgggggtaacgggtaacccgggtaacggggtagggaaaccgttaccggtaaaccaaaaccgggttacggttgggtccgtaccgtaccgggtaacccgttactacggtttcccttacggtttacccttccgtaacccgtttccccggttaccccgacttagttcccgttaacg

SEQ ID NO: 92464 - DNA, 824 bp, Homo sapiens
  misc_feature: GYAE6OF01A04VV.45.19.B08.1.454.CMB.1.raw
tcagacgcgatcgacacgaccggtgctcgatttagtgagtcagtaagggggcatcacacaacaaccagattcctcctccaaagaagcccctgggagcacagctcatcaccatggactggacctggaggttcctctttgtggtggcagcaggtgcaggtgtccagtcccaggcccagctggggcaatcgtggggctgaggtgaagagcctgggtcctggtgaggtctcctgcaaggcttcgtggaggctaccttcagcaactagtggagtcagtcgtggggtcgccgcccgacggcccccgtagggaaccgaacggggccgaaggtacgggttggggtttacgggggagggaacttccgtaaccgttcccccgttcgttaccgttaacggttacggggtaaccttaaacccgtaaaacgtttacccggaccgtaaaccgtaacgtaccttaaaacgttttccggaacgggggtacgtaacggtaacggttacccgtaaccccgttaacgttttaccccggaacgtaaacgtaaacccgtaaaaccgtaccccgggaaaccggggtacccaaccgtaaccgttacccgtttaaacgtttaccgggaaaccttaccgaaacgtacccgtaaacccgttaggaacgttaacgttaacgtacggaaaccggaaccgtaaccggtaacggtaacccgtttaaagttaccgtttaaccgttggttacgaaccggtaaggtaacggtacgtacgggtcgtaccggtaccgttaacggaacccgttacgtaacgtacccgaaaaccggttaccttaaacgtaccgtaaccggg

SEQ ID NO: 92465 - DNA, 700 bp, Homo sapiens
  misc_feature: GYAE6OF01ELL9V.45.19.B08.1.454.CMB.1.raw
  modified_base (155)..(155): a, c, t, g, unknown or other
  misc_feature (155)..(155): n is a, c, g, or t
tcagacgcgatcgacacgaccggtgctcgatttagtgagtcagtaaggggggaggaactgctcagttaggacccagacggaaccatggaagccccagcgcagcttctcttcctcctgctactctggctccagataccactggagaaatagtggtnacgcagtctccaggccaccctgtctgtgtctcgaggggagagcgtcaccctctcctgcgaccgcagtacaaaggtcgtacgacgaccggtattaccgttagccgttacggtaccagactacggacgaccgtcggccacggtccctaccgacggccttccctcaagttccttaggtcgggtctcctacgtcccgtcccggtagggtccctcgttgggtccctccccgtagtggttcgaggtcggacgtagggtcggtcgtacgggacgtaggtacgttcctacgtactaccacctagtccaggtccgacgtccgtacgacgtagtacgtaggtaacttacgtttagggacttttagttttaactcggttttactcgtacgttacttaatttacgttaagcggttcccgtaccgggtccgttacgggtaccgggtttccgggaaccggttagggtaaccgggttaacggtacgtaaacgtaaccgtaacgtacggtatagggccttaccgctaactcggttccttaagttccttctccgttaccccg

SEQ ID NO: 92466 - DNA, 616 bp, Homo sapiens
  misc_feature: GYAE6OF01AQFC7.45.19.B08.1.454.CMB.1.raw
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccgaggggagagagtccaccctctcctgccacggccagtcaaagtgttcgcaccggatacttagcctggtaccagcagagacctggccagccctccaggctcctcactctatggtgcatccctccgagggccctcgtcggtcgtcccccggccagggtttcaggtcggcgtaggttcgggtctggggaacaggtacgttcaaccttcgtcctaaccgatccgaagcctacgcctcgacgtagtctaggtaagttacgttttacgacgttaacttttatttaagttcgtcttgtactaattattaagtcgtacgtcggtacccttgggtaccgttcgggacccggtaggggtaccgtaagggttagaaaacgtacgaaaccggtacgttggtacggtcttgacctacctattcttacgtcttcgtcttcccg

SEQ ID NO: 92467 - DNA, 830 bp, Homo sapiens
  misc_feature: GYAE6OF01AN390.45.19.B08.1.454.CMB.1.raw
  modified_base (402)..(402): a, c, t, g, unknown or other
  misc_feature (402)..(402): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtcctcaggccaccctgtctgtgtctccgaggggagagagtccaccctctccgtgcgacggccagtcaagtcgttcgcaccgatacttacgccgtagtaccagcagacgtacctggccagccctcccgaggtccctcctctactctagttcggtcgcacgttccctccgtacgggtccttccgtcggtcccggtccccgtccgtaggtttccgacggttcggcgtagggttcgggttacggngggtaacgaggttaacgttccgtacccttcctaccaaccctacgttccgaacgtaccgaccgtcccgtcgtaccgtagttaccgttaaggtaaaggttttacgtttttacggtaacgtttttaacgtttttaagtttttaacgttttcgttacgtttacgtttaactttaaagttttaactttaaacgttaccgggtttaccgttacccggggtttaccccgggttacggggttaccccgggttttaccccggggaacccgggttaaccggggttaacccgggttaaacggggtttaaacgtaaaacccggttaaaccgtaaaaacccggggttacgttacggggtccggtaccggttaaccggtaccctaaacggtttccgtttacggtttacgtttacccttttacccggtaccgttttccccccg

SEQ ID NO: 92468 - DNA, 720 bp, Homo sapiens
  misc_feature: GYAE6OF01EMC4L.45.19.B08.1.454.CMB.1.raw
  modified_base (196)..(196): a, c, t, g, unknown or other
  misc_feature (196)..(196): n is a, c, g, or t
  modified_base (683)..(683): a, c, t, g, unknown or other
  misc_feature (683)..(683): n is a, c, g, or t
  modified_base (711)..(711): a, c, t, g, unknown or other
  misc_feature (711)..(711): n is a, c, g, or t
tcagacgcgatcgacacgaccggtgctcgatttagtgagtcagtaagggggcatcacacgacaaccagattcctcctccaaagaagcccctgggagcacagctcatcaccatggactggacctggaggttcctctttggtggtggcagcaggtgcaggtgtccacgtcccgacggcccgagcgtggggcaagtcgnggggctggaggtagaagaacggccgtagggtccgttcggtagaacggtcctccgtgacgtaaggtccttgtacgggacggcctaccgttcgacgtaccaacgttagtggtacgtacgacggtcggtcggggtgacccggacccgcccgggtccccgtaggggaaccgaaacggggccgaagggacggggttgggggttacgggggaacgtactcgaccttccgtctacgtagtacgggtactaactaaagtacgacacgaactacgtaacttcggaggtacgtacggaacgtccgtaaccgttacgttacccgaacgtaaccgtaacccgtaacccgacggacccgaactccgtaacgttacggtaacgacctacgaacgtaccgtacgtaggaacgttacgtagtacggaacggaacctaaggtacgtactagtttaactggtactgaaccgtagcgtacgtacggtccgtagaccgtaggaaccncaaacgtacctacgtaacgtccgtaagnggtaaccgg

SEQ ID NO: 92469 - DNA, 614 bp, Homo sapiens
  misc_feature: GYAE6OF01BHZ9U.45.19.B08.1.454.CMB.1.raw
  modified_base (195)..(195): a, c, t, g, unknown or other
  misc_feature (195)..(195): n is a, c, g, or t
  modified_base (481)..(481): a, c, t, g, unknown or other
  misc_feature (481)..(481): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccgagggganagagtcaccctctctcgcacggccaggtacaaagtgttcgcaccggatacttagcctggtaccagcaagacgacctggccagcctcccaggcctcctcattcgtacgtgtcgctattccctaccgagggtccctcgtcgggtcgtcccccgacgtaggttcaggtcggccgtaggtcgggttcgacgggtaccagacgtttccaacgttcctaccaccgtatcgacgtacacgtcctggactgtacgtagtaacttgtttcgacgttatttaagttattcgttctntacgtaattaataacgtagtactcggccgtacgggtaccgttcggacccgtacggaccgtagggtagtaaactacgaaacgtacgtagtggtcgacgtacgacgtaactcgttacggtcttccgtagttcccg

SEQ ID NO: 92470 - DNA, 842 bp, Homo sapiens
  misc_feature: GYAE6OF01C2Q1D.45.19.B08.1.454.CMB.1.raw
tcagacgcgatcgacacgaccggtgctcgatttagtgagtcagtaagggggaggaactgctcagttaggacccagacggaaccatggaacgccccagcgcagcttctcttcctcctgctactatcggcctcccagactaccacgtaggaagtaaaattggtgggtacgaccgctacggtcctcgaacggtccctacccgttgtcttggttcgttcccgaccgggaaggggagtacggaaccgtccctaccccgttcgttcccgcgaccgaccggtacctaacgttaaccgtaaacggttcggttacccgaacccggtaccgtaatttaccggttaacgcccggttacgtaaccgacgaacgtacgaaccgtccgtaccggacccaccgtcccctaccgcggtcccttaccgataccgtcgttaggtccgcaccgtaccttcccgacgtaccggtcctccggtccgtcccgtaccccgtcggtaacgtcgtacggtcggtcgtacggttgggtaccggacggtactacggtcgtaccctacgtcctaccgaccgtagtaccgagacccgtacgtccgtacggtacccgttaagtaccgttaagttaacggtttacgtttacgttaacgttttagttttaacgtttcgtttaacgtaccgtttagtaactttaaagttacgtaaggttccctacggttacccggtacggttacgttcccggaccggaacccgggtaggttaaacggaacggtttaacgaacgtaacccggtaaacgttcgtacgggttccgaacgtcccgtaacttaccggttactttcgtacttaaccgcccttaccggtccc

SEQ ID NO: 92471 - DNA, 900 bp, Homo sapiens
  misc_feature: GYAE6OF01BY2XI.45.19.B08.1.454.CMB.1.raw
tcagacgcgatcgacacgaccggtgctcgatttagtgagtcagtaaggggcatcacacaacaaccagattcctcctccaaagaagcccctgggagcacagctcatcaccatggactggacctggaggttcctctttggtggtggcagcaggtgcaggtgtccagtcccaggcccagcgtggggcaagtcgtgggctgaggtgaagacgccgtgggtcctggtgtaacggtcctccgtggactaacggtcttcgtgggacggtacctacccttcgaacggacctaaaccttaaggttcggacgttccgaacggtcgttacggggtcggacccgtaccccgacggcccccgtagggaaccgggaacgggcccgaaggtcggggttcggggttagggggacggtactaccgtaccttcccgtcgtcgtaggtacggtacgtaaaccgtaaacgtaccgaccgtaacgacgtaaccgtaagttaccggacgggtactacggtaaccgttacccgtaccggtttaccgttaccccgggaaccgggtaaaccgtaaacccggtccgggtaaaccgggaccctaaaccggtaaccggttacccgtttaacgggtttaaccgtaacccgttaacccggtaaccgtaacccgtaaccgtaacgtaaccgggttaaagtaccggtaacggggtaaaccggaacccgtaacggaacccgggttttaaccgttaaacgttaaacggtttacgtacgggttaacggaacgggttaaccgggtacggtacgggtttaccgggtaccggttaccgggtaacccggtacgggtaaacccgtaccgttaaaccgttaaacccggttaaccgttaaacccgttaaaccggttaccccgggttaaggttaaaccccggg

SEQ ID NO: 92472 - DNA, 576 bp, Homo sapiens
  misc_feature: GYAE6OF01CQDZ7.45.19.B08.1.454.CMB.1.raw
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
tcagacgcgatcgacacgaccggtgctcgatttagtgagtcagtaagggggcatcacacaacaaccagattcctcctccaaagaagcccctgggagcacagctcatcaccatggactggacctggaggttcctctttgtggtggcagcaggtgcaggtgtccagtcccaggcccagctggggcaatctggggctgaggtgaagaagccgtgggtcctcggtgaaggtctcctgcaaggcttcgtggaggcaccttcagcaaactatggagtcagcgtggtgcgccgaggcccctgggacaagggccaggaggtcgggtggggagagtcgactccctcgtctagtgggactacaaattacgcgacacgactaatttcgaggcagagtcacctagtttcccgacggaacaaacgtcccgacgggcccacgacgtacccgttacttacggaaccttcacgaccaacctggaanactagnggaacgacacgagtaccgtatacttagtgtcgacgtagagagtgggtccgtggaccgttacgaaacgtcacgtacaaacgtccttaacgacgtacgtacg

SEQ ID NO: 92473 - DNA, 983 bp, Homo sapiens
  misc_feature: GYAE6OF01AGI2E.45.19.B08.1.454.CMB.1.raw
  modified_base (157)..(157): a, c, t, g, unknown or other
  misc_feature (157)..(157): n is a, c, g, or t
tcagacgcgatcgacacgaccggtgctcgatttagtgagtcagtaagggggaggaactgctcagttaggacccagacggaaccatggaagccccagcgcagcttctcttcctcctgcctactctgctcccagactaccactggagtaaatagtggtnaccacagtctaccaggcaccctgtacctctgtctccgaggggacacgacgcccaccctctccgtgccggtggcccagtcgagtgtacgttaccgacctaaccgtacgtttacgcccgtttaggacccgacgacgtaaccgaaacccgttcggggacccacgggtaccctacccgaacggaccctttacccctcgttaacgttttaccgttccggggtttacctttacccggtaacccggtcggggtcccggtccggtacggtttaaccgttccccgtaacggtccccgttaacgggtttaccgcgttccgggtaccgttaacgggttccgggggttaacggtaccggggtaaccttaacgggtaccggtttacccgaaaccccggtttccttacccgaaaccccgttagtaacccgaacgggtcccgtaaacggtaccccgtaccgtacgttacccgggttaaccgttaacgggttaacgttttaccggtttttaccgaaccggtttttaacgttttttaccgtttaccgttacgggttaaccctaacgggtttaccttaaacgggttaccctttaaaccggtttaacgttaaccggttacccggggtttccgtttaaacgggtttaacccggtttcgggggtttttaaaccgggacccccgggtttaggggtaaaacccgttaacggtacgggttttaaaccgggaaactttaacccgggtaaaacggttaacggttcgggttaaacccgacggtcctaaccccggttaaacgttcgttacccgtttacgttacccggttaacttcccgtttcccgttaccccgg

SEQ ID NO: 92474 - DNA, 713 bp, Homo sapiens
  misc_feature: GYAE6OF01CKW2F.45.19.B08.1.454.CMB.1.raw
  modified_base (350)..(350): a, c, t, g, unknown or other
  misc_feature (350)..(350): n is a, c, g, or t
  modified_base (468)..(468): a, c, t, g, unknown or other
  misc_feature (468)..(468): n is a, c, g, or t
tcagacgcgatcgacacgaccggtgctcgatttagtgagtcagtaagggggaggaactgctcagttaggacccagacggaaccatggaagcccagcgcagcttctcttcctcctgctactctggcctcccagataccacgtagggaagaaataggtggtgacgcagtcctccgacggccaccctgtctgtcgtctccggaaggggagagcgtccaccctctccgtgccgacggacagtacgaaagtcgttccgacgacggtatacgttacgccgtaggtaccagacgagacgccgtcggaccgaccgtcccctaccgacggtcctccctacgtacttcgtaggtcggtcncctacctcccgacggacgtcctcgtcggtcccgtcccgtacgtacggttcgaggtcgagtacgggtcgggttacggacggtacgtacggtaccggttacacgttacccaacgtaaccncgtacgaacgtcccgaacgtccgtagaccgtaagttccgtaaaggttacgtttaacgttcggtaagtttattttacggttattcgtacgtataacgttaattaacggtaacttcggtccggttccgtaaccgggttcggtaccgggtacccgtacggtacggtaacgttaagtacgtaaactacgaaccggtggttcgacgtcaggacccttagtccttcgtacctttcgtccgttcggttcccc

SEQ ID NO: 92475 - DNA, 726 bp, Homo sapiens
  misc_feature: GYAE6OF01BGN72.45.19.B08.1.454.CMB.1.raw
  modified_base (262)..(262): a, c, t, g, unknown or other
  misc_feature (262)..(262): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgctagtctccaggctaccctgtctgtcgtctccgaggggtagagcgtccaccctctcctgccacggccagtcaagtgtcgcgaccgattactcgccgtcggtacngcaggacgtaccgtggaccctacggtccctaccgaggtccctcctactacttcgtagtcgggtctactacctccgtaccggtacggtcctcgttcgggtccctcccccggtacgttacggttccgtaggtcggtcgtagggttcggtacggtacgggaactaggtaccttcaccgtcctaccgaccataccggagcctacgtccgtcgaccgtagttacgtaacgtaaagtttcgtttacgtaccgttttaagtttactttaggtttacgttacgttaaccgtatttaagtttacttaacggtcgttaccggtcccggttaccggttacggttccggttacccgggacccggttacgggtaaccgtagggttaaacgaaccgtaaacggtaaccgtacggttgggtaccgtccgtacgtaccctaactccgttacgtccgtttaccttacgtcccgttaccccg

SEQ ID NO: 92476 - DNA, 789 bp, Homo sapiens
  misc_feature: GYAE6OF01DQ0O4.45.19.B08.1.454.CMB.1.raw
  modified_base (174)..(174): a, c, t, g, unknown or other
  misc_feature (174)..(174): n is a, c, g, or t
  modified_base (555)..(555): a, c, t, g, unknown or other
  misc_feature (555)..(555): n is a, c, g, or t
  modified_base (648)..(648): a, c, t, g, unknown or other
  misc_feature (648)..(648): n is a, c, g, or t
  modified_base (722)..(722): a, c, t, g, unknown or other
  misc_feature (722)..(722): n is a, c, g, or t
  modified_base (784)..(784): a, c, t, g, unknown or other
  misc_feature (784)..(784): n is a, c, g, or t
tcagacgcgatcgacacgaccggtgctcgatttagtgagtcagtaagggggaggaactgctcagttaggacccagacggaaccatggaacgccccagcgcagtcttctccttcctcctgctactctcggctcccagactacccacggagtaattgtgtcacacagtactcgacnccaccgttcgtttctttcgtttacggtaagggaacgaacgcctacccttcctcctcggcgacggccgacgttaccggtagggtacgttaacgacgtaccttacgttaaccgtaccgtaaccggttaaacccaaaaaccgtaaaaccggtaccgggaccgtaccggtacccgtcccgtaacggccttcctactacctacgttaccttaacgtcgtaacccgaacgtacgtaccggaacggaccgggtaccgtacgtacggccttaaccgacccgaccggtcggttacgttacggtacggacggtaccggtacgggggttcggtcggtacggtaacggtacgtaccgtttcctaccttaccgtaccacctataccgacgtacnccggtccgtaccggacggttagttacggtttacttcgttaactttaccttacttcgttcgacgtcggacgaggtcgggtccgacgggtaccgngtcccgttaccgtcgttaccggggtccggaagggtaccggacggggtaggtcgaagtaacctcggtaacctggngtcggcacggttcaccgttgttcctcgtttacctaccgttccgtccttaccccttcacgttntccgg

SEQ ID NO: 92477 - DNA, 630 bp, Homo sapiens
  misc_feature: GYAE6OF01BOA9X.45.19.B08.1.454.CMB.1.raw
  modified_base (341)..(341): a, c, t, g, unknown or other
  misc_feature (341)..(341): n is a, c, g, or t
  modified_base (429)..(429): a, c, t, g, unknown or other
  misc_feature (429)..(429): n is a, c, g, or t
  modified_base (451)..(451): a, c, t, g, unknown or other
  misc_feature (451)..(451): n is a, c, g, or t
  modified_base (593)..(593): a, c, t, g, unknown or other
  misc_feature (593)..(593): n is a, c, g, or t
tcagacgcgatcgacacgaccggtgctcgatttagtgagtcagtaaggggaggaactgctcagttaggacccagacggaaccatggaagccccagcgcagcttctcttcctcctgctactctgctcccagataccactggagaaatagtggtgacgcagtctacaggccaccctgtctgtgtctccgaggggagagagtccacccttcgtcctgccgacggcctagtactaaacgtgttcgaccacccggtaattaccgttacgccgtggtaccagtcagacgtaccgtcggaccacggcccctaccgacggtcctaccctaccgacttactagtggtacnctaacgttccctacgacggccttcgtacggtcctccccggctaggttcgaggtcggacgtggtcggtcgtacgggacaggtcgttacnctacgtaccacgtcgtctacgntacgtctcgctagttcgaggagtagtgttacgactaatttacgtactacgaactaacgtttaccgttacggtgttcctagttccgtacggttcggacggtacggtacgtaggtgtacgtacgtacgaacgtcgtgtcggacncgtaccagtactcgttacgtctactcgttccgtcccg

SEQ ID NO: 92478 - DNA, 744 bp, Homo sapiens
  misc_feature: GYAE6OF01EJGT9.45.19.B08.1.454.CMB.1.raw
  modified_base (310)..(310): a, c, t, g, unknown or other
  misc_feature (310)..(310): n is a, c, g, or t
  modified_base (321)..(321): a, c, t, g, unknown or other
  misc_feature (321)..(321): n is a, c, g, or t
  modified_base (714)..(714): a, c, t, g, unknown or other
  misc_feature (714)..(714): n is a, c, g, or t
  modified_base (722)..(722): a, c, t, g, unknown or other
  misc_feature (722)..(722): n is a, c, g, or t
tcagacgcgatcgacacgaccggtgctcgatttagtgagtcagtaagggggaggaactgctcagttaggacccagacggaaccatggaagccccagcgcagctttctccttcctcctgcctactcgtggcctcccagatacccacgtggaagtaaattgtggtcgacgcagtcctacgacggcctaccctgttctaggtcgtcgtacggaggggagagtactccaccctctcgcgcgacgcatactaaggtctaccgcaccggtatactacgcctcggacagacagacgaccgtcgaccacgtccaccgngtacctccgtntacgttcgtagtggaccgtccttactcccgtaccggtccggtccgttaccggttcggtccccgtacccgtaccgttcggttacgagggtcggcggtagggttacgggtgtaacgggacgacgttacccggtactacgttaccctacgtaaccctatacccgtagaccggtaccgtccgtaccgtactaggttacgttaaacggtttacgttaacggttttacgtaacgtttttactttacgtttttacgttagtttcctaagttaacttttaacggtaacgttaacgttccgtcgggttcgttacccggttccggggttaccgtaccccgggtagaccgggttaacggtacgtaaacgtaaacgtaacgtacggtacttgggtactcgtacgntacccgtntacgtcttacttcgtcctcccg

SEQ ID NO: 92479 - DNA, 668 bp, Homo sapiens
  misc_feature: GYAE6OF01ATXZ9.45.19.B08.1.454.CMB.1.raw
  modified_base (263)..(263): a, c, t, g, unknown or other
  misc_feature (263)..(263): n is a, c, g, or t
tcagacgcgatcgacacgaccggtgctcgatttagtgagtcagtaagggggcatcacacaacaaccagattcctcctccaaagaagcccctgggagcacagctcatcaccatggactggacctggacggttcctcgtttggtggtggcagcgaggtgcgaggtcgtccgacgtccccgacggcccagcgtggggacaagtcgtggggctggaggtagaagacgcgtgggtccgtcggtgtacggtctcgtgcgagtcgttcgnggacgcctcgttcagcaagtgtaggagtcgagcgtgggcgccgccgcggtcccgaggacgacggcgaggtggtgggtagggagacgtccacgttcccgtcgtacgtaggtacggtaactaacgtaacgtacgacacgacgtacgtacgttacggagggacacggtacgtacctaccgttacgttaccggaaccgtaacctaaaccggtccgacggaccacgtacttaccgttagtaccggaactcgaacgtacctaagcgtaagacgtacgagaccgaacacgtacgtaacgttaatacgttacgtggtaccgagaacggtagtacggtcggtaccgtacgtccgtaaccgtaccgcgtaaaccgtaacccgtaacgggtacttaacccggtagtccggtaacgg

SEQ ID NO: 92480 - DNA, 917 bp, Homo sapiens
  misc_feature: GYAE6OF01ESBFH.45.19.B08.1.454.CMB.1.raw
  modified_base (197)..(197): a, c, t, g, unknown or other
  misc_feature (197)..(197): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctccagataccactggaagaaatagtggtgacgcagtctccaggcacctgtctgtgtctccgaaggggaaanacgcccacctctcctgccgacgggccagtactaggggttacttaacgagcttaacgttacgacccgttagggtaaacccaaaacgaaaaaaccgtcggacctaccggccttacccgaggtacctaccagttccaattactaacgtacggacctaccgtaagtaccgaaaccgtacggggtaccctacggttaccgggacctaccgtaccccgacgggtaccaacgggtttaccaagggtttccgggacgtaacggggtttcgggtaccggttaacgggggaaccctaaacgggttacctttaccgtaacccgttaaccgttacccaacccgttaaagttacccgaaaacggcccttaacggggtacccgttaccggggttaaccccgtttacgggtacggttttaaccggtttttccgggtaaacccctttaacgttttaaccgttaacggtttcggttacccgtaaaccggtcgtaaccggtccggggtttaccgggaccggttaacccgaaggtcccggttacgttaccccgttaccgggtttacggggggaccggtaaaccggggttaaccgggtaaggggtacggaaaccggttaagttaaaaccggtaaaacccgtaagggttacgggtaccgttacgttacggtaccctaaacccgttcgttaaacccgtttgttaccccggtttatttaacccgtttccccggttcccgaacc

SEQ ID NO: 92481 - DNA, 792 bp, Homo sapiens
  misc_feature: GYAE6OF01DXN77.45.19.B08.1.454.CMB.1.raw
  modified_base (186)..(186): a, c, t, g, unknown or other
  misc_feature (186)..(186): n is a, c, g, or t
  modified_base (198)..(198): a, c, t, g, unknown or other
  misc_feature (198)..(198): n is a, c, g, or t
  modified_base (775)..(775): a, c, t, g, unknown or other
  misc_feature (775)..(775): n is a, c, g, or t
tcagacgcgatcgacacgaccggtgctcgatttagtgagtcagtaagggggagggaactgctcagttaggacccacgacggaaccaatggaagccccacgcgcagcttctcttcctcctgctactctggctccacgataccactggagaaatagtggtgacgcagtctcaggccaccgtgtctgtntctccgaggganaggacgtcaccctcctcctcgcgaccggaccgacgtacgtaaaggtcgttaccgaccgtaaccgggtacttaccgttacggcccgttagggtacccaggtaccaacggtacgacccgtacggcccgaccgtaccccgtcccgaacggtccctccctacctacttacgttacgttcgggtcgacctaccgtccccgtacccggtacgggtacccttcgggttccggtccccggttacccccggtacgttacgggtttccaaggggtccggtacgttcggggttacgggttcggtacggggaacgtacggttacgttccgtaacctcgtaccctaaccgtacttaccgacgtacccgtacgtcccgtacggacctacggttccgttaaggtaaccgtttagttttccggtaacgttttaagtttttaccttttaggtcgtttacgtttacttaacttaatttacgttaagccgtacgttcgggtaaccgtacggttacccggttccgacccggtagggtacctttagggaaactaacgtacgaaacgtcggtggtacgtctacgaccaacttgtcgttntacctgtccgttacccg

SEQ ID NO: 92482 - DNA, 825 bp, Homo sapiens
  misc_feature: GYAE6OF01C2ZJ6.45.19.B08.1.454.CMB.1.raw
  modified_base (145)..(145): a, c, t, g, unknown or other
  misc_feature (145)..(145): n is a, c, g, or t
tcagacgcgatcgacacgaccggtgctcgatttagtgagtcagtaagggggaggaactgctcagttaggacccagacggaaccatggaacgccccagcgcagcttctccttcctcctgctactcgtcgctcccagactaccacgngaataaagtagtggtagaaccgctaagtcctaccgacggaccaccctgtcgtgtacgtctaccggaaggggagacggacgttccaccctctcctcgacgacgacgtatacaaaggtgttcgaccgtacgacttaacgttacgccgtaggtaccgacgacgtacggtacgtacccggaggaccctaacgcccggtaccgacggtccctacccgtactaacttaccggttaagccggtactaccgtacctacccggtaccgaccggtccgtaccggttacgtcccggtaccccgtacgtacggtcacggtccggacgacggtacgggtacgtacggacgaagtccgttacacgtttacctaccgtacaacgtacgaacgggacctacggtcccgtaagtacgtaccggttaagtaacggttaacgttttacggttacgttaaccggtttaaagttttaattttacgtacgggtttacctaattacggttaatttaaagttaaccgggtacgtaccgttacggggtacccgttaaggttaccccgggttaacgggtaccccggtaaaccggggtaccggtttaaagggaacgtaaaagttaaacccgaaaaccgggtagttaccgttacgacgtaccggtaacaccgttacgtaccttagttaccctttaccgctttacccgg

SEQ ID NO: 92483 - DNA, 512 bp, Homo sapiens
  misc_feature: GYAE6OF02IV29U.45.19.B08.1.454.CMB.1.raw
  modified_base (350)..(350): a, c, t, g, unknown or other
  misc_feature (350)..(350): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccagtcaccctgtctgtgtctccaggggagacggccaccctctcctgcagggccagtcagtatgttagcaccaacttagcctggtaccaacagagacctgcccaggcctcccaggctcctcatccatgatgcatccaacagggtccctggcgtcccagacaggttccgtggcagtggtctgggacngagttcactctcaccgtcagcagcctggagcctgatgtattttgctagtttacttctgtcagcagtcgttccgccacgccgctcacgtttccgggcgggggaccaggggtggagagtgagacgaacgtggtggctgcacagtctgtcttcattcctcccgtc

SEQ ID NO: 92484 - DNA, 498 bp, Homo sapiens
  misc_feature: GYAE6OF02GVOOE.45.19.B08.1.454.CMB.1.raw
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccaggggagagagtcaccctctcctgcacggccagtcaaagtgttcgcaccggatacttagcctggtaccagcagagacctggccagcctcccaggctcctcatctatggtgcatcctccagggcctctggtcgtccccgcaggttcagtggcaggtgggtctgggacagagttcactctcaccatcagcagcctgcagtctgaagtatttgcgtatttattattgtctgctatttataatagctggcctggacgttcgccgaggaccgaggtgaatcaaacgaactgtggctgcacatctgtcttcattccg

SEQ ID NO: 92485 - DNA, 500 bp, Homo sapiens
  misc_feature: GYAE6OF02IQDJ1.45.19.B08.1.454.CMB.1.raw
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccaggggagagagtcaccctctcctgcacggccagtcaaagtgttcgcaccggatacttagcctggtaccagcagagacctggccagcctcccaggctcctcatctatggtgcatcctccagggcctctggtcgtccccgcaggttcagtggcagtgggtctgggacagagttcactctcaccatcagcagccctgcagtctgaagtatttgcgtatttattattgtctgctattataatagctggccctggaccgttcggcccagggaccagggttgaatcaaacgactgtggctgcacatctgtcttcatccg

SEQ ID NO: 92486 - DNA, 502 bp, Homo sapiens
  misc_feature: GYAE6OF02FHE29.45.19.B08.1.454.CMB.1.raw
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccaggggagagagtcaccctctcctgcacggccagtcaaagtgttcgcaccggatacttagcctggtaccagcagagacctggccagcctcccaggctcctcatctatggtgcatcctccagggcctctggtgtccccgcaggttcagtggcagtgggtctggggacagagttcactctcaccatcagcagcctgcagtctgaagtattttgcgtattttattattgtctgcattataatagctggccctggacgttcggcccagggaccagggttgaatcaaacgaactgtggctgcaccatctgtcttcattccc

SEQ ID NO: 92487 - DNA, 499 bp, Homo sapiens
  misc_feature: GYAE6OF02HGYGT.45.19.B08.1.454.CMB.1.raw
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccaggggagagagtcaccctctcctgcacggccagtcaaagtgttcgcaccggatacttagcctggtaccagcagagacctggccagcctcccaggctcctcatctatggtgcatcctccagggcctctggtcgtccccgcaggttcagtggcagtgggtctgggacagagttcactctcacatcagcagcctgcagtctgaagtatttgcgtatttattattgtctgctattataatagctggcctggtacgttcgcccgaggaccgagggttagaatcgaaacgactgtggctgacacatctgtcttcatcc

SEQ ID NO: 92488 - DNA, 549 bp, Homo sapiens
  misc_feature: GYAE6OF02IVGME.45.19.B08.1.454.CMB.1.raw
tcagacgcgatcgacacgaccggtgctcgatttagtgagtcagtaaggggagggaactgctcagttaggacccagacggaaccatggaagccccagcgcacgcttctcttcctcctcgcctactctggctcccagataccactgggagaaatagtggtgacgcagtctccaggcaccctgtctgtgtctccaggggagagagtcaccctctcctgcacggccagtcaaagtgttcgcaccggatacttagcctggtaccagcagagacctggccagcctcccaggctcctcatctatggtgcatcctccagggcctctggtcgtccccgcaggttcagtggcagtgggtctgggacagagttcactctcaccatccagcagcctgcagtctgaagtatttgcgtatttattattgtctgctattaataatagtctggccctggtaccgttcgggcccagggtacctagggtttacgaaattacgaaaacggtactaggtacgggtccttacggacctaacctagttccgttgttcctttcgattccccg

SEQ ID NO: 92489 - DNA, 535 bp, Homo sapiens
  misc_feature: GYAE6OF02HN8QZ.45.19.B08.1.454.CMB.1.raw
tcagacgcgatcgacacgaccggtgctcgatttagtgagtcagtaagggggaggaactgctcagttaggacccagacggaaccatggaagccccagcgcagcttctcttcctcctgctactcctggctcccagataccactggacgaaactagtggtcgacgcagtctccaggcaccctgtctgtgtctccagggagagagtcaccctctcctgcacggccagtcaaagtgtcgcaccggatacttagcctggtaccagcagagacctggccagcctcccaggcctcctcatctatggtgcatcctccagggcctctggtcgtccccgccaggttcagtggcagtgggtctgggacagagttcactctcaccatcagcagcctgcagtctgaagtatttgcgtatttattatttgtcttgctattataatagctggcctggtacgttcggcccgtagggaccgagggttgaacgttacgaaaacggtaactcggtaggtcctcgacaccgactccgttgtccgttctattccccg

SEQ ID NO: 92490 - DNA, 557 bp, Homo sapiens
  misc_feature: GYAE6OF02HY7U4.45.19.B08.1.454.CMB.1.raw
  modified_base (194)..(194): a, c, t, g, unknown or other
  misc_feature (194)..(194): n is a, c, g, or t
  modified_base (206)..(206): a, c, t, g, unknown or other
  misc_feature (206)..(206): n is a, c, g, or t
  modified_base (254)..(254): a, c, t, g, unknown or other
  misc_feature (254)..(254): n is a, c, g, or t
  modified_base (292)..(292): a, c, t, g, unknown or other
  misc_feature (292)..(292): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccagggganacagccaccctntcctgcagggccagtcagtatgttagcaccaattagcctggtaccaanagagacctgcccaggctcccaaactcctcatctctgtntatctaccagggccactggtctcccagacaggttcaagggcagtgggtctgggacagagttcactctacacatcagcggctgcagtctgtaagtattttggactttatactgtcagtctagtataactcacgtcgccgttactaccggttttcgggacccggggtacaacggtcgttagggacgaagtaaccgaaacgtaacgttggtacggcgtcgacctacctattccgtgttaccttctacttcccttcccgtcctagtccg

SEQ ID NO: 92491 - DNA, 621 bp, Homo sapiens
  misc_feature: GYAE6OF02IAPQJ.45.19.B08.1.454.CMB.1.raw
  modified_base (350)..(350): a, c, t, g, unknown or other
  misc_feature (350)..(350): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccaggggagagagtcaccctctcctgcacggccagtcaaagtgttcgcaccggatacttagcctggtaccagcagagacctggccagcctcccaggcctcctcatctatggtgcatcctccagggcctctggtcgtccccgcaggttcaggtggcaggtgggtcngggacaggagttcactctcaccatcagcagcctgcagtctagaagtatttgcgttatttattatttgtctgtactatttaataattacgcgttcggtccccgttgggtaccggtttccgggaccccgtaggggacccgtaagggggtttaacgaaacgttaaccggtaaaaccggtaaccgttagggttacgggtacccgtttacggtacccgtaacccgtaacgtttacccgtttacggtttacccttttacccgtaacgttttcccccg

SEQ ID NO: 92492 - DNA, 700 bp, Homo sapiens
  misc_feature: GYAE6OF02IRFS0.45.19.B08.1.454.CMB.1.raw
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccaggggagagagtcaccctctcctgcacggccagtcaaagtgttcgcaccggatacttagcctggtaccagcagagacctggccagcctcccaggctcctcattctatggtgcactccctccgacggggtccctcgtcgggtccgtccccccggcctacggggtttccaagggttcggcgtagggttcgggggttcgtgggggaacaggtacggtttccaacttcctccgaaccctagtccgaaggccaacgtccccttaggaccaggttctaggaaagttattttggaccttaatttttattatttcggtcttgtaccttaatttaataaacttggtaccgttcgggtcccgttagggtaccggtttcccgggaccccgtaacggggtaacccgtaagggggtttaacgaaacgttaccggtaaaaacggtaaccgttagggttacgggtacccttacggacctaacccgtagtttcccgttacggtttacccttttacgaccgtttcccccg

SEQ ID NO: 92493 - DNA, 562 bp, Homo sapiens
  misc_feature: GYAE6OF02JGO4W.45.19.B08.1.454.CMB.1.raw
  modified_base (399)..(399): a, c, t, g, unknown or other
  misc_feature (399)..(399): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccaggggagagagtcaccctcgggtcctgcacggccagtcaaagtgttcgcaccggatacttagcctggtaccagcagagacctggccagcctcccaggctcctcatctatggtgcatccctccagggcctctggtcgtccccgcaggttcagtggcaggtgggtctgggacagacgttcactctcaccatcagcagcctgcagtctagaagtntttgactagtttattactgtacactagtataatagtcggcctcggtaggtaccgttcggaccgtaagggacctaagggtacgaaactacgaaacgtacgttggtacgtacgtacgacctaacctacgttccgttcgttacctttactacgttcccgttacccg

SEQ ID NO: 92494 - DNA, 588 bp, Homo sapiens
  misc_feature: GYAE6OF02HHSZX.45.19.B08.1.454.CMB.1.raw
  modified_base (443)..(443): a, c, t, g, unknown or other
  misc_feature (443)..(443): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccaggggagagagtcaccctctcctgcacggccagtcaaagtgttcgcaccggatacttagcctggtaccagcagagaccgtggccagcctccgaggcctcctcatctatggtcgcactcctccgagggtcccttcgtcggtccgtcccccgccgtacggttccgaggttcggcgtagggttcgggtcgtggggactaggtacggttccacgttcctaccaccgtatcgacgtcagtcctagctagtctaggaagttntttgacttattttattagtttgtctgactaattataagtgctggtcccgtggtaccgttcggacccggtaggaccgtaggttacaagtacgaaacggtaactggtcggtactcgacctaccagttcctgttcttacgtattcccg

SEQ ID NO: 92495 - DNA, 608 bp, Homo sapiens
  misc_feature: GYAE6OF02JH4B2.45.19.B08.1.454.CMB.1.raw
tcagacgcgatcgacacgaccggtgctcgatttagtgagtcagtaagggggcatcacacaacaaccagattcctcctccaaagaagcccctgggagcacagctcatcaccatggactggacctggaggttcctctttgtggtggcagcaggtgcaggtgtccagtcccaggcccagctggggcaatctggggctgaggtgaagaagcctggggtcctcggtgaaggtctcctgccaaggcttctggagggcaccttcagcaactatggagtcagctgggtgcgccgaggcccctggacgaagggccaggagtgggttggggaggagtcgagtcctctctatgggataccaattacgcacagcaatttcgagggcagacgtccgacctagtttccggacggtaacaaacgttcccgaacgggcaaccgaggacccttaagtttacggaacctacgacgtaccaaacccgttgacgtaatagttacgaaggacaaccgaggtacccggttaattaactttaacgtgtacgacggtacgaggtagtcgggtcggtacggtccgtacggaacgtaccgagtacgaaccgtaacgtacttaccgacggtaccg

SEQ ID NO: 92496 - DNA, 679 bp, Homo sapiens
  misc_feature: GYAE6OF02JGYRB.45.19.B08.1.454.CMB.1.raw
tcagacgcgatcgacacgaccggtgctcgatttagtgagtcagtaagggggcatcacacaacaaccagattcctcctccaaagaagcccctgggagcacagctcatcaccatggactggacctggaggttcctctttgtggtggcagcaggtgcaggtgtccagtcccaggcccagctggggcaatctggggctgaggtgaagaagcctgggtcctcggtgaaggtctcctgcaaggcttctggaggcaccttcagcaactatggagtcagctgggtgcgccacggcccctggaacgaacgggccaggacggtgggttgggggagactcgactccctctcgtagtcgggataaccgaaattcgacacagactaagtttcgaggggtcaggacgtcctacctatttccggacgaaactaaacgtacccgacgggtaccaacgtacgtaccttaagtttacggaaacttaccgaacggtacccaaacccgttcggaaagtaacttaacggtaaggaacgggaaccaaccggtacgtaacccgttaaatttaacgttaaccggtaggtaccgtacgggtaagacggtaaggtcgggtacggttaccggaccggttaacggaaccggtcctaacggtaacccgtaaaccggttaaaccttacgttaaccgtacgggtaacccg

SEQ ID NO: 92497 - DNA, 555 bp, Homo sapiens
  misc_feature: GYAE6OF02IWF2Q.45.19.B08.1.454.CMB.1.raw
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccaggggagagagtcaccctctcctgcacggcagtcaaagtgttcgcaccggatacttagcctggtaccagcagagacctggccagcctccaggctcctcatctatggtcgcactcctccagggtcctcgtcggtcgtcccccgctagggttaagtggcaggtgggtctgggacaggtagttcactctcacctatcagcagcctgctagtcgtgtaagtatttgacgtattttattattgtcttgctattataagtacgtctcggtacctggtacgttcggaccgtacgggtaccgtagggttacgaaacgtacgaaacgtacgtcggtggactcgacgtacctactcgtcgtacttctactcctacccg

SEQ ID NO: 92498 - DNA, 702 bp, Homo sapiens
  misc_feature: GYAE6OF02IIUW0.45.19.B08.1.454.CMB.1.raw
  modified_base (510)..(510): a, c, t, g, unknown or other
  misc_feature (510)..(510): n is a, c, g, or t
tcagacgcgatcgacacgaccggtgctcgatttagtgagtcagtaagggggaggaactgctcagttaggaccagacggaaccatggaagcccagcgcagcttctcttcctcctgctactctggctcccagataccactggagaaatagtggtgacgcagtctccaggcaccctgtctgtgtctccaggggagagagtcaccctctcctgcacggccagtcaaagtgttcgcaccggatacttagctcggtaccagcagacgacctggccagccctacccgaggcctcctcgtaactcttacgtggtcgctactccctccgacgggtcctcgttcgggtccgtccccgtccgtaacggtttcacggtcggaccgtagggttcgggtccgtaggggaccaggttacgttcacgttcctccgaactacgtcgaacgccgtaacggtccctacgacgtacgtaccgttaggtaaacgttcgttttacgacggttaactttttattaacgttttntaccgttgtaacttagtttaagttaacgttacgacgtttccggacccgtttgggtaaccgtttccggacccggtagggtaccgggttacgggttagaaaccgttaacgtaaacggtaaccgttagggtcggttacgtacgtaccgtacctaccgttaacttccgggtttactttaccgacgtttacccccgg

SEQ ID NO: 92499 - DNA, 757 bp, Homo sapiens
  misc_feature: GYAE6OF02IRMMR.45.19.B08.1.454.CMB.1.raw
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
  modified_base (342)..(342): a, c, t, g, unknown or other
  misc_feature (342)..(342): n is a, c, g, or t
  modified_base (389)..(389): a, c, t, g, unknown or other
  misc_feature (389)..(389): n is a, c, g, or t
tcagacgcgatcgacacgaccggtgctcgatttagtgagtcagtaaggggagggaactgctccagttaggacccagacggaaccagtggaagccccagcgcagcttctcttcctcctgctactctggcctccagattaccgatggagaaatgtggtgacgctagtctccaggcaccctgtctgtgtactccgaggggagagaggtcacccttctcctgcacgggctagcaaagtgtcgcaccgatacttagcctggtaccaggccaagtagaacctggccagcctcccgaggcctccgtnactcctaagttcggngcaactcctccggaagggtcccgttgngggtccttccccgcctaaggtttccaggttcggcaggtcgggttacnggggtactagaggttccaacgttcgtcaaccgaggttaccagtaccaacgtccgttacgtacgaaacggttccgtaagtaaacggttaccttttaggggaacccttaaaggttttaaatttaagtttcgggttttacccaggttaccctaaaagttttacgaaaacgtttaacggtcccttcggggtaaccctcggggtaaaccgttttccgggaaccccttaacgggaaacccgttacgggtttacgggaaaaacgttccgggtaaaaaacccgaaacggtttcggttaacgggtacccgtttaacggtacctaaacccgtacgttaaccgttccgggtttaaccttaccggtaaccgtttccccgg

SEQ ID NO: 92500 - DNA, 621 bp, Homo sapiens
  misc_feature: GYAE6OF02FIN0P.45.19.B08.1.454.CMB.1.raw
  modified_base (194)..(194): a, c, t, g, unknown or other
  misc_feature (194)..(194): n is a, c, g, or t
  modified_base (299)..(299): a, c, t, g, unknown or other
  misc_feature (299)..(299): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccagggganagagtcaccctctcctgcacggccagtcaagtgttcgcaccggatacttagcctggtaccagcagagacctggccagccctccccaggcctcctcatctatggtncatcctccgagggtccctcgtcggtccgtcccccgcctacgggtttcagggttcggctaggttggggtcctggggacaggtacgtttccaccgttcctccaacccactccgagtccacgccctgcgacgttctagaagtagttttacgacgttaattttattattgtctagctattaataatacgcttcggcccttagggtaccgttccggacccgtaacgggtaccgtaggggttacgaacgtaccgaaaccggtaacgtcggttacggaccgttcgacctacccgtacgttccgttcgttacctttactaccgttccccg

SEQ ID NO: 92501 - DNA, 584 bp, Homo sapiens
  misc_feature: GYAE6OF02JEBYO.45.19.B08.1.454.CMB.1.raw
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
tcagacgcgatcgacacgaccggtgctcgatttagtgagtcagtaagggggaggaactgctcagttaggacccagacggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctcccaggctcctcatcccatgatgcatccaacagggtccctggcctcccagacaggttccgtggcaggtggtctggggaccagagttcactctcaccgtnagcacgcctggacncctgatgtatttgctagtttacttcgtgtcagctacgtcgttccgcctaccgccgtcctccgtaccggttccggggaccgggggtaccgaggggtcggacgtacgtcggaacggtaccgtaacgttggtacggcgtcggaccgtacctagttccgtgttcccttcgtacttccccgttacccgccttaccttcgtacg

SEQ ID NO: 92502 - DNA, 500 bp, Homo sapiens
  misc_feature: GYAE6OF02I67EI.45.19.B08.1.454.CMB.1.raw
tcagacgcgatcgacacgaccggtgctcgatttagtgagtcagtaagggggcatcacacaacaaccagattcctcctccaaagaagcccctgggagcacagctcatcaccatggactggacctggaggttcctctttgtggtggcagcaggtgcaggtgtccagtcccaggcccagctggggcaatctggggctgaggtgaagaagcctgggtcctcggtgaaggtctcctgcaaggcttctggaggcaccttcagcaactatggagtcagctgggtgcgccaggcccctggacaagggccagagtggttggggaggatcatccctctctatgggataccaaattacgcacagcaatttcaggcagagtcacatttccgcgacaaagtccacggcacagcctattggaactcagcaactgagatatgagacacgagccgtatattacgtgtgcgtagagatggcgtgcctgaacgcagtcacgactattacccagtaccg

SEQ ID NO: 92503 - DNA, 526 bp, Homo sapiens
  misc_feature: GYAE6OF02G1JZC.45.19.B08.1.454.CMB.1.raw
  modified_base (194)..(194): a, c, t, g, unknown or other
  misc_feature (194)..(194): n is a, c, g, or t
tcagacgcgatcgacacgaccggtgctcgatttagtgagtcagtaagggggaggaactgctcagttaggacccagacggaaccatggaggccccagcgcggcttctcttcctcctgctactctggctcccagataccactggagaaatagtgatgacgcagtctccagtcaccctgtctgtgtctccagggganacggccaccctctcctgcagggccagtcagtatgttagcaccaacttagcctggtaccaacagagacctgcccaggctccccaaactcctcatctctgtgtatctaccagggccactggtcgtcccagacaggttcaagggcagtgggtctgggacaggagttcactctcaccatcagcggcctgcagtctgaagtattttggtactttattactgtcagtcagttatatcactgccgtacgtacgttttgggccggggtaccaagctaggagatacaaacgacgtgtgctgcacactctgttcgtctacttccttcccgtcctattctacg

SEQ ID NO: 92504 - DNA, 620 bp, Homo sapiens
  misc_feature: GYAE6OF02GBDQV.45.19.B08.1.454.CMB.1.raw
  modified_base (567)..(567): a, c, t, g, unknown or other
  misc_feature (567)..(567): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccgaggggagagagtccaccctctcctgcacggccagtcaaagtgttcgcaccggatacttagcctggtaccagcagagacctggccacgccctcccgaggcctcctcatcttagtggtcgcacttccctccgacggggtcccttcgtcgggttccgtccccccgtcgtacgggtttccagggttcggccgtagggttcggggtcgtggggaacctaggtacgttccacttcctacaacctatcgacgcacgccctgctacgtctaggaagttgtttcgacgttattttacttagttcgttctagtacttaagtttaactaaagtcgtcgttcggtcccgttgggtaccgtttccgggacccgtaagggacctaggggttanaacgtacgaaacgtgtggtcggctgacctactgttctcgtcttacacgttccc

SEQ ID NO: 92505 - DNA, 627 bp, Homo sapiens
  misc_feature: GYAE6OF02IHGXI.45.19.B08.1.454.CMB.1.raw
  modified_base (430)..(430): a, c, t, g, unknown or other
  misc_feature (430)..(430): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccaggggagagagtcaccctctcctgcacggccagtacaaagtgttcgcaccggatacttagcctggtaccagcagagacctggccagcctccaggctcctcatctagtggtgcactcctccgacggcctcgtcggtcgtccccgcgtaggttcaggtcggctaggtgggtcgtgggacaggtacgttcactcctaccgaacctactacgacgacacgtctcggctaacgttctagtaaacgttnttttacggacgtttaattttaattagtttacgtcttagtaactaatttaaactaagtaacgtcgttacggcccgttagggtaccgtttccggaccggaaggtaccgttagggtacgtaaactaccgtaaacggtaacgtcggtagggtacctacgtacctaacctacgttaccgttgttaccttctaaccttcccgg

SEQ ID NO: 92506 - DNA, 620 bp, Homo sapiens
  misc_feature: GYAE6OF02G99DH.45.19.B08.1.454.CMB.1.raw
  modified_base (310)..(310): a, c, t, g, unknown or other
  misc_feature (310)..(310): n is a, c, g, or t
  modified_base (470)..(470): a, c, t, g, unknown or other
  misc_feature (470)..(470): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatgtggtgacgcagtctccaggcaccctgtctgtgtcctccgaggggagagagtccaccctctcctgcacggccagtcaaagtgtcgacaccggatacgttagcctggtaccagcagacgacctggaccacgccctcccgaggcctcctcactctagtcggtcncctacttcctccgagggtccctcgtcgggtccgtccccgctacggttcaggtcggctaggtcgggtcgtgggactaggtacgttcacgtctaccacctatccgagccacgcctagctacgtcgtaggtaaacgttgtttacgacgtttaattttacgttntttacgttcgtagtacttaattaacttaagtcggtcctcgggtaccctgggtaccgttccgaccggtacggtaccggtaagggttacaacgtacgtaaacgcgttggtacgcctacgtacaccgtgttccgtgttaccttcgacttcccg

SEQ ID NO: 92507 - DNA, 751 bp, Homo sapiens
  misc_feature: GYAE6OF02G5ELN.45.19.B08.1.454.CMB.1.raw
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccaggggagagagtcaccctctcctgcacggcagtcaaagtgttcgcaccggatacttacgcctggtaccagcagacgacctggccagccctcccgaggcctcctcatctagtggtgctatccctccgacgggtccttcgtgggtccgtccccgccgtaagggtttcaggtcggctagggtcgggtcgtaggggactaggtacggtttccacgtccgttaccaaccgtattccgaacggtccgtaacggtccctggaccgtacggtccgtaacgggtaaacggttagtttttcggacgtttaagtttttaacgtttaacgttttcgggttacttaggtaccttaattttaaacgttaacgttaacgtccgttacgggtccccgtttaggggtacccggttttcccgggaccccgggtaaggggtaacccgttaagggggtttaccgtaaacgttaacccgtaaaaccgggttaaccgttaggggtaaccgggtaccgttaaccgggaccctaacccgttacgtttaccgttaccggttttaccgttaccttacgtttaccccccgg

SEQ ID NO: 92508 - DNA, 740 bp, Homo sapiens
  misc_feature: GYAE6OF02H5ELR.45.19.B08.1.454.CMB.1.raw
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccaggggagagagtcaccctctcctgcacggccagtcaaagtgttcgcaccggatactagcctggtaccagcagacgacctggcccagcctcccgaggcctcctcacttctagttggtgctactcccgtccgacgggccctcggttcggtccggtcccccgacgtaggttccaggtcggcgtagggtcgggtcgtcggggaactaggtacgttccacgttcctaccgacctaatccgaggtccacggtccctggacctacggttcctaaggtaaacgttacggtttttcgaccggtttaatttttaacgttttagtttcgtaccgttagtacttaattttaaacgtaacgttacggtacccgtttacggggttaccccgttacggggttaacccggtttcccgggaaccccggtagggggtaaacccgttaaggggggtttaaacaaaccgttacccggtaaaaacgggtccgtttagggtacggttaccgttacgacccttaaccggtaaccgttccgtttacggtttaccctttaccgtacctttacccccgg

SEQ ID NO: 92509 - DNA, 609 bp, Homo sapiens
  misc_feature: GYAE6OF02IWLWO.45.19.B08.1.454.CMB.1.raw
  modified_base (485)..(485): a, c, t, g, unknown or other
  misc_feature (485)..(485): n is a, c, g, or t
tcagacgcgatcgacacgaccggtgctcgatttagtgagtcagtaagggggcatcacacaacaaccagattcctcctccaaagaagcccctgggagcacagctcatcaccatggactggacctggaggttcctctttgtggtggcagcaggtgcaggtgtccagtcccaggcccagctggggcaatctggggctgaggtgaagaagcctgggtcctcgggtcgaaggtctcatgcaaggcttctgggaggccaccttcagcaactatggagtcagcgtgggtgcgcaggcccctggacaggccgaggagtgggttggggaggatcactcctctctagtgggataaccaaattacgcaacagactaatttcgacgggcaagacgtccaacctacgtttccggaccggtaacaaacgtcccgaacggggcaacgtacggaaccttacgttacgggaaccttcgaacgactaacctagaacaacttanaggaaggacaacgagtaccgtattaacttaacgttagtacgacggtagagtacggtcgggtacggtacgccgtaggaaccgactaagttaaccgaaaccggtacttaacgttacccgtaacggg

SEQ ID NO: 92510 - DNA, 642 bp, Homo sapiens
  misc_feature: GYAE6OF02G5VFS.45.19.B08.1.454.CMB.1.raw
  modified_base (600)..(600): a, c, t, g, unknown or other
  misc_feature (600)..(600): n is a, c, g, or t
tcagacgcgatcgacacgaccggtgctcgatttagtgagtcagtaaggggggaggaactgctcagttaggacccagacggaaccatggaagccccagcgcagcttctcttcctcctgctactctggctcccagataccactggagaaatagtggtgacgcagtctccaggccaccctgtctgtgtctccgaggggagagagtcaccctctcctgcacggcagtcaagtgtcgcaccgatactagcctggtaccagcagacgaccgtggccacgccctcccgaggcctcctcatctagtcggtgcactcccgtccgacgggtccttacgtcggtcccgtccccgacgtacgggttcaggtcggcgtagggtcgggtcgtacgggacaggtacgttccacttcctacccgaacctatccgacgccacgtccgtcgacggtacggctaggaaagtagtggtacggtcttaaggttttacgtgtccgttgtacgtacgtacgttaaatttaagtttactttacgtaccctttccgttaccgtttaccggtttcccggaccgttaacgggtactaacggttggtaacttacgaacgtaaacggtntcggttacgacgtacgacctacgttactcgttacgtacttcc

SEQ ID NO: 92511 - DNA, 565 bp, Homo sapiens
  misc_feature: GYAE6OF02GSIAH.45.19.B08.1.454.CMB.1.raw
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (362)..(362): a, c, t, g, unknown or other
  misc_feature (362)..(362): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccaccggaaaaattgtgttgacacagtctccagccattctgtctctctctccaggggagacagccaccctctcatgcagggccagtcagagtattagaacatacttggcctggtatcaatacaagcctggccagggtccccgntcctnatctatgatgcttccagcagggccatggcatcccagccaggttcagtggcggtggtttcggcacgagtacttcacttcncaacaatccagtcagcctcaactgaagtatttgactagtctaattacttgtacaacagcgtacacgtacttcggaccgctccgacgtttccggacggtacgggtacccgtaagggtcggaacgacgttacgaaacggtaaccgttaggtacggactagtaccaaccgtacgttaccttaggttacctttacgactttaccccg

SEQ ID NO: 92512 - DNA, 622 bp, Homo sapiens
  misc_feature: GYAE6OF02J2J3V.45.19.B08.1.454.CMB.1.raw
  modified_base (316)..(316): a, c, t, g, unknown or other
  misc_feature (316)..(316): n is a, c, g, or t
  modified_base (566)..(566): a, c, t, g, unknown or other
  misc_feature (566)..(566): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtcctccgaggggagagacgtccacccgtctccgtcgcacggccagtcgaaagttcgtcgcgaccggatacttagcctcggtaccagcagacgacctcggccagcccctccgaggcctcgtcatcgtagtggtcnctactcctccgacgggtcctcgtcggtccgtccccgcgtacggtcacggtgcgagtcgggtcgtggactagtacgtcactctaccacctctacgcgccacgtccgtcgaccgttaggtaccttaggtaacgttttaggttacgtacgtttattttacgtttaacttcggttcttcgtaactgtttaaatacgttcggtacgttcggtacccgtgggtaccgttaccggccggtacggaccgttagggtanactacgtaacgtcgtggtcgcgtacgtacgtctagtcgttctccgtattcctcccg

SEQ ID NO: 92513 - DNA, 619 bp, Homo sapiens
  misc_feature: GYAE6OF02FTOXK.45.19.B08.1.454.CMB.1.raw
  modified_base (434)..(434): a, c, t, g, unknown or other
  misc_feature (434)..(434): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctccaggctcctcatccatgatgcatccaacgacgggtccctggccgtcccaagtaccgtaggttccgtggctaggtgggtcgtgggacaggacgttcacttctcaccgtcagccagccgtaggactccgtgagtgtatttgacttagtttacttcgtgtacngcgtgtccgttccgccgtaccgcccgtctccgtaccggtttccggggaccgggggtaccgtaggggtaggacggtagtcggaacggtacggacgttggtcggtaccgtcggacctaccggtacttaccggttcgtttccgttaccgtaccgtttccccgttcccgtaccttacgtccgttaacgg

SEQ ID NO: 92514 - DNA, 754 bp, Homo sapiens
  misc_feature: GYAE6OF02HBAAI.45.19.B08.1.454.CMB.1.raw
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccgaggggagagagtcaccctctcctgcacggccagtcaaagtgttcgcacggatacttagcctggtaccagcagacgacctgggccagccctccgaggcctccctcactctagtggtcgccactccgtaccgcgggtccctcgttcggtccgtcccccgcgtaggttcgacggtcggacgtgggtagggtccgtaggggaactacggtacgtttaccgaccttcgacctaacctacttaccgaacgaccgtacggtcctacgtaccgtaggtaagtacgtaagttagtttacggtacgttaatttttagttaacgtttgttaccttagtaccgttaaattttaagttaacgttacgggttccgttaccggggtacccgttaggggttaacccgggtttccccgggtaacccgggtaaaccggggttaacccgggttaacgggggtttaacgtaaaaccgttaccgggtaaaaaccgttcgggtaccggttacgggtacccgttacgggaaccgtaacccttaccggtttaacctttccggtttaccttaccgttaccgttaccccccg

SEQ ID NO: 92515 - DNA, 720 bp, Homo sapiens
  misc_feature: GYAE6OF02I6BJT.45.19.B08.1.454.CMB.1.raw
  modified_base (262)..(262): a, c, t, g, unknown or other
  misc_feature (262)..(262): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccaggggagagagtccaccctctcctcgcacggccagtacaaagtgttcgcaccggatacttagcctaggtaccaanagacgacctgcccgaggcctacccaactcctacatctctggtctactctaccgacgggcctacgtggtcgtaccccagacgtacgggttcaggttcgggtacgggttggggtttacggccgtaacgacggtacctttccgaaccttccgtacactaacttccgaacgtcaccggtcccttaacccaacgttacgaacggttacgttttacggactaacgtttccttaacgtttaaccgttacgtacctaaaccggtacgtaccgttaacgtagtacgtttcggacccgttcttaccgttaccggttccgggacgggtaacgggtaaccggtaagggttacggaacggtaaccgtaaccgtaaacggtacgttacgggtacggaccgttacgacctaccgtacgtttacccgttcgttaccttaccgtactttaccccggttaccccggacttaaccgg

SEQ ID NO: 92516 - DNA, 726 bp, Homo sapiens
  misc_feature: GYAE6OF02IAW4E.45.19.B08.1.454.CMB.1.raw
  modified_base (313)..(313): a, c, t, g, unknown or other
  misc_feature (313)..(313): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccgaggggagagagtcaccctctcctgcacggccagtcaaagtgttcgcaccggatacttagcctggtacagcagacgacctggccagcctaccgaggacctccgtcattctagtggtgctactcccnccgacgggcccttcgtcggtccgtcccccggaccgtacggttccgaggtcggtacgtagggttgggtaccgtcggggaactaacggttacgttccgtaacttcccgtacgaaccctacgtccgtacgcctaacgccctagaccgtacggtctagtaacgttacgtttacgcgtttaattttacgttaacgttttgtacgttcgttaacttaaacggttttaacttaaaggttaccgttaccgggtaccgggtaccccggtttaacggggttacccgggtttacccggggaaccccggaggggttaaacccgggttaagggttaacgtaaccgtaacgtaaacggtaacgttacgggtcgacgttacgcccgtaacgttacttccgttacgttaccttactaccgtttaccccg

SEQ ID NO: 92517 - DNA, 581 bp, Homo sapiens
  misc_feature: GYAE6OF02FMHB6.45.19.B08.1.454.CMB.1.raw
  modified_base (194)..(194): a, c, t, g, unknown or other
  misc_feature (194)..(194): n is a, c, g, or t
  modified_base (319)..(319): a, c, t, g, unknown or other
  misc_feature (319)..(319): n is a, c, g, or t
  modified_base (446)..(446): a, c, t, g, unknown or other
  misc_feature (446)..(446): n is a, c, g, or t
tcagacgcgatcgacacgaccggtgctcgatttagtgagtcagtaagggggaggaactgctcagttaggacccagagggaaccatggaagccccagctcagcttctcttcctcctgctactctggctcccagagacctccggagaaattgtcttgacacagtctccagccattctgtctctctctccagggganacagcccaccctctcatgcgagggccagtcagagtatagaacatactgctggtatcaatacagcctggccgacggtccccgctccgctactctagtgatcgtctccagcgacggccacgtgcacncccagcctaggtcgaggtcgggtcggggttgggttcgcacgtaggtaccttactaccttcacaacaactcagtccacgccctacaacctagaagttctttagctagttactacttagtcttacgaanacgtctaagagtcgttacggccctacttccgtacggtttccggggacggtaaacggaccgtaagggtacgggaatacgtaacggaaacgtacgttcgggtagcctcgaccacgtacgtcgtacttcgtcctaccg

SEQ ID NO: 92518 - DNA, 684 bp, Homo sapiens
  misc_feature: GYAE6OF02JRUHU.45.19.B08.1.454.CMB.1.raw
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
  modified_base (285)..(285): a, c, t, g, unknown or other
  misc_feature (285)..(285): n is a, c, g, or t
  modified_base (315)..(315): a, c, t, g, unknown or other
  misc_feature (315)..(315): n is a, c, g, or t
tcagacgcgatcgacacgaccggtgctcgatttagtgagtcagtaagggggcgatcacacaacaaccagattcctcctccaaagaagcccctgggagcacagctcatcaccatggactggacctggaggttcctctttgtggtggcagcaggtgcaggtgtccagtcccaggcccagctggggcagtctggggctgaggtgaagaagcctgggtcctcggtgaaggtctcctgcaggcttcgnggaggcaccttnacgtcaactagtggagtcaggcgtgggtcnccgccgacggccccgtggacagggccaggnggtgggttgggaggtactcgacgtcccgtctcgtagtacgggactaaccgtaaagttaccgcgaactaggtaccctaagttttccggaacggggtcaagtacgggttacccaaccgtacgttttacccggaccggtaaacctaaaccgttccccggaacggggtaccctaaccggtacgtacccgttaagtttaccggaacttaccgacgtacctaaaccgtcgaacgtactacggtacgacggtacaacgtaccggtaacgttagtaccgttactaggtacgacggttaagacgtacggtggtaccgtagaccgttaggaaccgtcgaacttaccgtaaccgtacgttaaccgttaccgaggttaccg

SEQ ID NO: 92519 - DNA, 568 bp, Homo sapiens
  misc_feature: GYAE6OF02FILMB.45.19.B08.1.454.CMB.1.raw
  modified_base (310)..(310): a, c, t, g, unknown or other
  misc_feature (310)..(310): n is a, c, g, or t
  modified_base (397)..(397): a, c, t, g, unknown or other
  misc_feature (397)..(397): n is a, c, g, or t
tcagacgcgatcgacacgaccggtgctcgatttagtgagtcagtaagggggagggaactgctcagttaggacccagacggaaccatggaagccccagcgcagcttctcttcctcctgctactctggctcccagataccaccggaaaaaattgtgttgacacagtctccaggcacccctgtctctgtctccagggggagacagcccaccctctcctgcagggcccagtagggagtgtcagtaagtacttaggctggtaccaacagaaacctggccaggctcccaggctcctcatccatgatgcatccaaanagggtcccctggccgtcccagacagggtttcccgtggccgagtgggtctggggacagagttcactctcaccgtcagcagcctggacncctgatgattttgctagtttacttctgtcagcagtcgtccgtccaccgccgcctcacgtttcgggccgggggtaccgaggggtggaggatgaaggcgaactggtgcgtcgcgaccaacgttcttcggtccctttctaaccgttccttaccccggtccctagttccctacgg

SEQ ID NO: 92520 - DNA, 799 bp, Homo sapiens
  misc_feature: GYAE6OF02GVYPJ.45.19.B08.1.454.CMB.1.raw
  modified_base (194)..(194): a, c, t, g, unknown or other
  misc_feature (194)..(194): n is a, c, g, or t
  modified_base (332)..(332): a, c, t, g, unknown or other
  misc_feature (332)..(332): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctccgaggggngagagtccacccgtctaccgtgcaccggtccagtcaaagtcgttcgacgaccggatacgttagccgtacggtaccagcagacgaccgtggaccacgccctcccgaggtcctccgtactacgttccttaagtgggtacnccgtaaccgttcccgtacggacgggcccttcggttcggtcccgtccccgacgtacggttccaggttcggactagggtcgggtcgtagggacgtaacggtacgtttaccaccgttcccgacctaaccgtacttccgaacgccgaccgtcccgtcggtaccgtacgttaccgtaaggtaacgtttacgtttacggtaacgtttacgttttaagtttacgtttacggtttacgttacggtaactttaagtttaaattaacgttacggtaccggtttaccggttcccggtttaccggggttacccgggttacccgggtaacccgggtacggggttaaaccgttaaggggttaaaccgttaacggtaaccggttaaaacggtccggttaagggtaccggtacgtaaccggtaccgtaaccgttaccgtttaccggtttcgttacccgtttaccgttacccgtttacccccgg

SEQ ID NO: 92521 - DNA, 760 bp, Homo sapiens
  misc_feature: GYAE6OF02IUCM4.45.19.B08.1.454.CMB.1.raw
  modified_base (354)..(354): a, c, t, g, unknown or other
  misc_feature (354)..(354): n is a, c, g, or t
  modified_base (485)..(485): a, c, t, g, unknown or other
  misc_feature (485)..(485): n is a, c, g, or t
  modified_base (497)..(497): a, c, t, g, unknown or other
  misc_feature (497)..(497): n is a, c, g, or t
tcagacgcgatcgacacgaccggtgctcgatttagtgagtcagtaagggggaggaacgtgctcagttaggacccagacggaaccatggaagcccagcgcagcttctcttcctcctgctactctggctccagataccaacggaaaattgtgttgacacagtctccaggcaccgtgtctctgtctccgaggggacgacacgcctacccgtctctgaccgacggccaggtacggacgttgtacaacggtaagtacttacggcttacggtaacaacgaagaaaccgtggaccaggtcctcccgaggcctaccacaacgttccatcgagtacgtccattaccgaaaccgtcgggttccngggtaccgtaccaacggtaaccgtcgggttttaccggcggtaaccgttacggggtttcgggacccgttaagggggaacctagggtaacgtttccaacgttccgtaccgtactaccggcgaacgcggtaccncggacttaccgngtaccgttagtttacgtacgttcgttaaacgttttgttaccgtagtaccggttagtccgtaaccgtttcgaccgtaaccggccgttccgtaacgtccggttccgggtaaccggggccgggtacccgggtagggtaccggtaacggtacggttacggaaacgtaacgggttacgtaccggttgggtaccgttggaaccccgtcggtaacgttcccgttaggttcctaaccggttcttcccggtttacacctttacgcgttaacg

SEQ ID NO: 92522 - DNA, 711 bp, Homo sapiens
  misc_feature: GYAE6OF02GZZQX.45.19.B08.1.454.CMB.1.raw
tcagacgcgatcgacacgaccggtgctcgatttagtgagtcagtaaggggcatcacacaacaaccagattcctcctccaaagaagcccctgggagcacagctcatcaccatggactggacctggagttcctctttgtggtggcagcaggtgcaggtcgtccagtcccaggcccagccgtgggcaatcgtgggctggaggtagaagagccgtggtccgtggagaaggtctccgtgcaacggtcttctgggacgctaccttcgagactacgtagtggagtcagtcgtggtcgccgcgacgcccgtaggacgacggcgacgtaggtcgggtagggaggtacgtacgacctccgtacgtctacggtacggtaacgtaaccgtaacgtacgacgtaccgacgtactaacgttacgacggtacgtagtacgtacgtaccgtaaacgttccggaacgtaaccgtaacgtacccggaacgtaccgaaccgtacgtaacccgttacggttaccgtacgtaccgaaccgtaacctaaccggtagtaacgtacggtacgtacggtaacgtaccgaacgtacgtaccgttaacgttaacgttaccggtacgttacggtacgtaggtacggtacggtacggtacggtccggttaccggtaccgtaaccggtcgtaacggtacccgtaaaccgttaacggtaaccgttacggtaccgttaaccgg

SEQ ID NO: 92523 - DNA, 811 bp, Homo sapiens
  misc_feature: GYAE6OF02F0KF1.45.19.B08.1.454.CMB.1.raw
  modified_base (196)..(196): a, c, t, g, unknown or other
  misc_feature (196)..(196): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtcgtctccgagggganagtacgtccaccctctcctgccacggccagtcaaagttcgttcgcaaccggattaacttagcctggtacccagccaggacaccgtcggccagccctcccgaggcctcctcgatcctagttcgggtctacctacgtcccgtccgaaccggggtcccttacgttcgggttccgtccccggtaccgtaggttccgaacgggttccggacgtacgggttacggggttcctagggggaactacgggtaacggtttacccgaacttcccgtaaccgtaccttactacccgaacgtccgaaccgtacccggtacggtactaacggttccgtaaacggtaaacggtaacggttaggttaccgggtaacgtttaacggtttttaacggttacggtccgtttaacgtaccggtaagttaaccgttaaaacttttagtttaaccgttttaattcccgttttaacccgttacccgtttaacccgggttttcccggtacccgttaacgggaaacccgttaagggttaccggtaaacgttaacggtaaacccgaaaccggtttaaacccgtagtacccggtaacgtacgacccgttaacttaaccggtacgttacggttacccttaccg

SEQ ID NO: 92524 - DNA, 645 bp, Homo sapiens
  misc_feature: GYAE6OF02GY9DM.45.19.B08.1.454.CMB.1.raw
  modified_base (290)..(290): a, c, t, g, unknown or other
  misc_feature (290)..(290): n is a, c, g, or t
tcagacgcgatcgacacgaccggtgctcgatttagtgagtcagtaaggggaggaactgctcagttaggacccagacggaaccatggaagccccagcgcagcttctcttcctcctgctactctggctcccagataccactggagaaatagtggtgacgcagtctccaggcacctgtctgtgtctccgaggggagagacgtccaccctctcctcgcacggccagtcaaagtgtcgcacggatacttagcctggtaccagcagacgacctggccacgcctcccgaggcctccnctactactagtggtcgctactcctaccgacggtcctcgtcggtcgtccccgcgtggttcaggtggcgtaggtggtcgtaggactagtcgttctactcacaccactcgacgcgacgccgtaggcctagttctaagtaacgttcgtttacgactttaattttacgttatttcggtcttaggacttaaattagtaacttggacccgtttacgggtacccgttaggggtaccgttcccggggaccgtacgggtaaccgttaggggttaacaacgtaccgtaaacggttcggtacgggtacgtaccgtacgtaccgtaccttacggtcctttccgttaccttaccggttaccttaccccg

SEQ ID NO: 92525 - DNA, 599 bp, Homo sapiens
  misc_feature: GYAE6OF02F40EL.45.19.B08.1.454.CMB.1.raw
  modified_base (194)..(194): a, c, t, g, unknown or other
  misc_feature (194)..(194): n is a, c, g, or t
  modified_base (383)..(383): a, c, t, g, unknown or other
  misc_feature (383)..(383): n is a, c, g, or t
  modified_base (397)..(397): a, c, t, g, unknown or other
  misc_feature (397)..(397): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccactggagaaatagtggtgacgcagtctccaggcaccctgtctgtgtctcgagggganagagtccacctctcctgcagggccagccagagtgtcagcagcgacttagcctaggtaccagcaagaacctggaccaggtcctaccccgaggtcctcctcgattctagtggtctccttcctcgacgggcctacgtggtaacctcccgagtcccgtaggttcaggtcggacgtgggtcgggtcgagggacncggttcgtttaacnctacacctatcaacgcgtcctacgtctcgtaagtaagttacttgacgttattagttatgttctgtactattatactatcgtggacctcggtacgttccgaccgaggaccgtagggttacaaacgtacgaaacgtcgtacggtggtactacgtaacccacctaggttcttacggttccttacctcgttaccccgttcctaccg

SEQ ID NO: 92526 - DNA, 644 bp, Homo sapiens
  misc_feature: GYAE6OF02HHSHW.45.19.B08.1.454.CMB.1.raw
  modified_base (236)..(236): a, c, t, g, unknown or other
  misc_feature (236)..(236): n is a, c, g, or t
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
  modified_base (637)..(637): a, c, t, g, unknown or other
  misc_feature (637)..(637): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggcctcccagataccactggagaaatgtggtgacgcagtctccaggccaccctgtcctgtgtctccgaggggagagtagtcccaccctctcctggcgacgggcctaggtaggngtgtacagtaagtcttaggctacggaccaacgagaacctcggaccgagccctccgagccctccncactcagtgtactcnctactaccgaacgcggtcctcggcgtccagacgtcggtcgcgaggtagggtcggtacggtagggacgtagtacggttacctacgttcctaccggaccgttaacgccgtccgaacggtccgtagggtaccgccgtagtacgttaggttcctttagtacgtttacgtttctcgtagcctagcgtaccgtcgtcccgacgcccgcctaccgtcggttcggtaccggggcggtaaccggtgggcggtagtacggacggtaacgaccgtaggacggtagcccgtacgacgtactccgttacttcgttacctgtaccctccggttacnccttaag

SEQ ID NO: 92527 - DNA, 875 bp, Homo sapiens
  misc_feature: GYAE6OF02FZPVX.45.19.B08.1.454.CMB.1.raw
tcagacgcgatcgacacgaccggtgctcgatttagtgagtcagtaagggggcatcacacaacaaccagattcctcctccaaagaagcccctgggagcacagctcatcaccatggactggacctggaggttcctctttgtggtggcagcaggtgcaggtgtccagtcccaggccagctgggcaatcgtgggctgaggtgagaacgctgggtcctcggtgaggtctctgcaaggtcttcgtggaggctaccttgacgcgaactagtcggagtctagcgtgggtcgtacgccgaccggtccctggacgaacggccgagtacggtgggtacggggaggtactaccgtacgttaccccgtcgtacgttaagtcgggtaagtaaacccgtaaagttaccgaccgtactacgtaccgttaaatttccggaacgggacgtaacggtaaaccgttcccgaaccgtaaccgtttccgggaaccggtaaacctaaaaccggtacccccgaacgggggaccctaacccggtaaccgttacccgtttaaacgggtttaccggtaaaccgtaccgttaaacgaacccgttaacccggtaaaggtacccgtaagtttaaccggtaacgggaaccgggaaacctaacccgggttacggggttaaacccttaaccgtttaaaccgggttttaacgtacgggttttaaacggacccgggtaaacggttagggtaaccggttttaaccgggggcgggtttaacccgggtaaacccccggttttaacggggaaaacccgttacccggtttaaaaacccgtttacccgggtaaaaccccgggttaaacgttttaacccccgttaaaaccccgggttaaccggggtttaaaccccgg

SEQ ID NO: 92528 - DNA, 875 bp, Homo sapiens
  misc_feature: GYAE6OF02HKBW5.45.19.B08.1.454.CMB.1.raw
tcagacgcgatcgacacgaccggtgctcgatttagtgagtcagtaagggggagggaactgctcagttaggacccagacggaaccatggaagccccagcgcagcttctcttcctcctgctactctggctcccagataccactggagaaatgtggtgacgcagtctccaggcaccctgtctgtgtcctacgaggggagtagacgtccaccctctccaggtccacgggtccaagttacgaaaacggttcgttaccgacgaacccggtaataaccgtttaggacccgttacgggtaaccaacgcgtaacggtaacggaacccgttcggacccgtaacggtcccctacccccggtaaggtaccccttacccgtacgtaacttaccgtaacgttcggggtaccaaccgtaccgttacccttacccggacgggtccctacggtccggtaccgtacccccgtcgtaacggttcaaggttcgaccgtaggggttacgtcgtaggggaactacggtaacgttccaacttcctaacgacccgtaagtaccgtactaccgtcggtaacctcgaccgttaacggtacgttaacggtaaccgtttattttaccggacgtttaagtttacgttaacgtttcgttacgttaggtacttaaacgtttaacgtaaacgttcgtaccgtacgggttacccgttagggttacccggttaacccgggacccggtaaacgggttaaccggtaacgggttaaccgaaacgttaacccggtaaaacccggttaacggtccgggttaaccggccgtttaaccgggaaacccttaccggtttaaccttccccgggtttaacggttttaacccccttacgttaaccccggtttaacccccgg

SEQ ID NO: 92529 - DNA, 750 bp, Homo sapiens
  misc_feature: GYAE6OF02GSI2Q.45.19.B08.1.454.CMB.1.raw
  modified_base (91)..(91): a, c, t, g, unknown or other
  misc_feature (91)..(91): n is a, c, g, or t
  modified_base (142)..(142): a, c, t, g, unknown or other
  misc_feature (142)..(142): n is a, c, g, or t
  modified_base (204)..(204): a, c, t, g, unknown or other
  misc_feature (204)..(204): n is a, c, g, or t
tcagacgcgatcgacacgaccggtgctcgatttagtgagtcagtaagggggaggaactgctcagttaggacccagacggaaccatggaacncccagcgcagcttctctcctctgctactctggctccagataccactggaanaaagtgtggagacgcagttctccgaggccacccttgtcttagtcgtcctaccggtaggggtnaagcgtccgaccctacgtcctagccgtaccggctacgtaacgtaacgtccgttacgacctaacggtcttaccgtaacgtcccgtacggtaacctcggactaacggacgtaaccgttccgggactaacccgttccccgtaccccggaacggtcccgttacccgtaactaggtttaccctaagggttcggtccgtaccgtaacccttccggtaacgtccgtccgtacggtccgtacccggtcccgtcggtaccgtacgtagggtcgtacggtggtaccggtcggtaggctacgttaactccgaccgttatacccgattacccgtacgtacgaccgccgtacggtccgtaaccgtacgtacgtagttaacgttattacggtacttgttaacggtttcgtacgttacgtacgttaaccttagttccgtaaggtttaccgtcgttaccgtcgtacgtaccgacgtaccgggtacgtacgtacgtacgtacaacgtacgtagtcgacgtaccagtccgtacgtcttacgtaccttcgtacgttactacccgg

SEQ ID NO: 92530 - DNA, 821 bp, Homo sapiens
  misc_feature: GYAE6OF02HVP2B.45.19.B08.1.454.CMB.1.raw
tcagacgcgatcgacacgaccggtgctcgatttagtgagtcagtaagggggaggaacgtgctcagttaggacccagacggaaccatggaagccccagcgcagcttctcttcctcctgctactctggctcccagataccactggagaaatagtggtgacgcagtctccaggccaccctgtctgtgtctccgaggggagagagtcaccctgtcctgcacggcagtcaaagtgttcgcgacggatacttagcctgtacagcagacgtaccgtgaccacgcctacccgaggccttccgtacgacttacgttaagtcggtcgacctacgtccctccggtacgggtcccttcggtcggtcccgttaccccgcgtacgggttacgacgggtcggtaaccgtggggttcggggtaccggtacgggggaactaacgggttaacggtttacccgaccggtttacctaccaaaccctaaggtacccgaggtacccgacggtccgtaacggtcgtaacggttaccgtaagggttaaatttacgtttcggtacgtttaattttaacgtttacgttttgtaccttagtaacttaacgtttaattaaaacgttacggtaccgttcgggtaccccgttaggggttaacccggttacccggggtacccgggtaaaccgggtaaccgggtttaaggggtaaaccggttaaaaccgttaacccgggtaaaaaccgggttacgggtttaaccgggagggtaaccccgttaccggtaaccccgtaaccgttacggttacccgttttaccgggttaaccctttacggttaccctttcccccgg

SEQ ID NO: 92531 - DNA, 713 bp, Homo sapiens
  misc_feature: GYAE6OF02FV7XG.45.19.B08.1.454.CMB.1.raw
  modified_base (145)..(145): a, c, t, g, unknown or other
  misc_feature (145)..(145): n is a, c, g, or t
  modified_base (203)..(203): a, c, t, g, unknown or other
  misc_feature (203)..(203): n is a, c, g, or t
  modified_base (333)..(333): a, c, t, g, unknown or other
  misc_feature (333)..(333): n is a, c, g, or t
  modified_base (362)..(362): a, c, t, g, unknown or other
  misc_feature (362)..(362): n is a, c, g, or t
  modified_base (536)..(536): a, c, t, g, unknown or other
  misc_feature (536)..(536): n is a, c, g, or t
  modified_base (615)..(615): a, c, t, g, unknown or other
  misc_feature (615)..(615): n is a, c, g, or t
  modified_base (625)..(625): a, c, t, g, unknown or other
  misc_feature (625)..(625): n is a, c, g, or t
tcagacgcgatcgacacgaccggtgctcgatttagtgagtcagtaagggggaggaactgctcagttaggacccagacggaaccatggaagccccagcgcagcttctcttcctcctgctactctggctcccagataccacgtgganaaagtgtggtgacgcagtcctccgaggccacccgtgtctggtcgtcctcggaaggggnacggacgtccacccgttctccgtgaccgtacggcctaggtacaaaggttcgttaccgaccgacggtactacgttacgccgtaggaccagtacgagacgcgtacggacctacgccctccgacgtctcccgntactcgtagtggcgctaccgtcctccggnggtcctaggtccggtcccgtccccgacgttacggttcaggtgacgtagggtccgggttacgtaggacgtagtaccgttcaccgttaccgccgtaacctagtccgaacgccgtacgtccgtaccggaccgtaggttaacgttcgtttagacccgtttaagttacctacggttagngtaaccgtcgggtagtccggtagggtaaccgcggccggtactccggttaaccgtaccggttcggggaggtaaacccggngtaaccgggnggtaccgtacgaaccggaacgttaccgtaggacggtccctacgaccgttaccgtacggttcttaccggtacctttcgaccgttccccg

SEQ ID NO: 92532 - DNA, 559 bp, Homo sapiens
  misc_feature: GYAE6OF01C72H0.35.1.A01.1.454.CMB.1.raw
  modified_base (298)..(298): a, c, t, g, unknown or other
  misc_feature (298)..(298): n is a, c, g, or t
  modified_base (329)..(329): a, c, t, g, unknown or other
  misc_feature (329)..(329): n is a, c, g, or t
  modified_base (459)..(459): a, c, t, g, unknown or other
  misc_feature (459)..(459): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcaccatctcctgcactggaacctgcagtgatgttgggaattatgactatgtctcctggtaccaacttcacccagacacacgtccccaaaccntcgatctacaatgtacaatacttccgccctnaggtactcctaattcgttctctggctccaagtctggctatcggccggtcctccgtcgcccctattcctctcggacctccgaggctggaggaccgagctgtatttagtggagctagtctttatagtagaanctagtcacctacttcgaggtttaggacgtttcgggacgggtaacgggaccctaaggcccgttcggaaccccgttcgttaacgggtccaccggtaaccccg

SEQ ID NO: 92533 - DNA, 524 bp, Homo sapiens
  misc_feature: GYAE6OF01BM4W5.35.1.A01.1.454.CMB.1.raw
  modified_base (275)..(275): a, c, t, g, unknown or other
  misc_feature (275)..(275): n is a, c, g, or t
tcagtacagatcgtcacgaccggtgctcgatttagacgtctcatcagggcctgggctctgctcctcctcacctcctcactcagggcacaggctcttgggcccagtctgccctgattcagcctccctccgtgtccgggtctcctggacagtcagtcaccatctcctgcactggaacctgcagtgatgttgggaattatgactatgtctcctggtaccaacttcacccagacacacgtccccaaaccatgatctacaatgtcaatattccggccctnaggacgtccctaatcgtttctctggctccaagtctggctatgcggcctccgtgcccatctctggactccaggctgaggacgaggctgattagtggagctgcttatatagaagcagtcgcctacttcacgttagacgttcgggcggaaggaccaagcgtacgacccgtctaggtcagacccaggcctcgccccctggtccacgtcctcgttccccgccctccctcaccgtatcctagtactggcgccggg

SEQ ID NO: 92534 - DNA, 531 bp, Homo sapiens
  misc_feature: GYAE6OF01E1PH6.35.1.A01.1.454.CMB.1.raw
tcagtacagatcgtcacgaccggtgctcgatttagacgtctcatcagggcctgggctctgctcctcctcacctcctcactcagggcacaggctcttgggcccagtctgccctgattcagcctccctccgtgtccgggtctcctggacagtcagtcaccatctcctgcactggaacctgcagtgatgttgggaattatgactatgtctcctggtaccaacttcacccagacacagtccccaaacccatgatctacaatgtcaatattcggcctcaggagtccctaatcgtttctctggctccaagtctggctatgcggcctccgtgcccatctctggactccaggctgaggacgaggctgattagtggagctgcttatatagaagcagtgccacttcacgttagattcgggcggacgggaccgaagcgtagaccgtcgtacggtccgagcccgaaggcctcgccccctcggtccaccgtccgtcgttccccaccctccctccaccgtacttcctagtacctgaggtcccggg

SEQ ID NO: 92535 - DNA, 721 bp, Homo sapiens
  misc_feature: GYAE6OF01DV4OF.35.1.A01.1.454.CMB.1.raw
  modified_base (247)..(247): a, c, t, g, unknown or other
  misc_feature (247)..(247): n is a, c, g, or t
  modified_base (295)..(295): a, c, t, g, unknown or other
  misc_feature (295)..(295): n is a, c, g, or t
tcagtacagatcgtcacgaccggtgctcgatttagacgtctcatcaggggcccagtgctggggtctcaggaggcagcgctctcgggacgtctccaccatggcctgggctctgctattcctcaccctctcactcagggcacagggtcctgggcccagtctgccctgactcagcctgcctcgtgtctgggtctcctggacagtcagtcaccatctcctgcactggaacctgcagtgatgttggaattangactatgtctctggtaccaacttcaccagacacacgtaccccaaaccntcgatctaacaatcgtacaaattacttccggccctacaaggtacttacccctaaattccggtttactcgtcggtaccttacctaaaggttccgtaggtacttaacgtccgggcccgggtccctttcccggttcgacccccctaattcccgttaccgttacggggtaacccttcccgaaagggtccttacgggaacgggacccggtaacgggtccttagggttaattttaacggttcggggaacgtcccgttaggtaccttttaaagtaacgttaacggaaacggtcccgtaaagggttccggtaaccccttaaccgtttaccgtaacgggttttaacgacgggtttacccggggacgggaacggggtaaacccctaaggtcccgtacggtaaccccggtttccgtaaagggttcccaaacccgggg

SEQ ID NO: 92536 - DNA, 537 bp, Homo sapiens
  misc_feature: GYAE6OF01EX0D0.35.1.A01.1.454.CMB.1.raw
  modified_base (313)..(313): a, c, t, g, unknown or other
  misc_feature (313)..(313): n is a, c, g, or t
  modified_base (422)..(422): a, c, t, g, unknown or other
  misc_feature (422)..(422): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcaccatctcctgcactggaacctgcagtgatgttggaattatgactatgtctcctggtaccaacttcacccacgacacacgtcccaaaccccaactgatctacaatntcaatattcgcctcagagtcctaatcgttctctgctccagtactggctatgcggccgtccgtcgcccgactctctcggactccaggctgaggacgaggctgattattgngctgcttatatagaagctagtgcctacttacctacgttaaggtatttacgggccgggtagggacccgaaacgtccgtacggacccggtacccttacgggtcacggtaacccccgg

SEQ ID NO: 92537 - DNA, 510 bp, Homo sapiens
  misc_feature: GYAE6OF01ATZBK.35.1.A01.1.454.CMB.1.raw
  modified_base (341)..(341): a, c, t, g, unknown or other
  misc_feature (341)..(341): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcaccatctcctgcactggaacctgcagtgatgttggaattatgactatgtctcctggtaccaacttcacccagacacagtccccaaaccatgatctacaatgtcaatattcggcctcaggatcctaatcgttctntgctcaagtctggctatgcgcctcgtgcccatctctggactccaggctgaggacgaggctgattagtggatctgcttatatagagcagtcgacctacttcacgttagacgttcgggcggtacgggaccaaaggtcctcggtaccgtaccgtaggtccaaggtaccccgg

SEQ ID NO: 92538 - DNA, 514 bp, Homo sapiens
  misc_feature: GYAE6OF01A9OEC.35.1.A01.1.454.CMB.1.raw
  modified_base (273)..(273): a, c, t, g, unknown or other
  misc_feature (273)..(273): n is a, c, g, or t
  modified_base (392)..(392): a, c, t, g, unknown or other
  misc_feature (392)..(392): n is a, c, g, or t
tcagtacagatcgtcacgaccggtgctcgatttagacgtctcatcagggcctgggctctgctcctcctcacctcctcactcagggcacaggctcttgggcccagtctgccctgattcagcctcctccgtgtccgggtctcctggacagtcagtcaccatctcctgcactggaacctgcagtgatgttgggaattatgactatgtctcctggtaccaacttcacccagacacagtccccaaaccatgatctacaatgtacaatattcggccctnaggatccctaatcgtttctctggctccaagtctggctatgcggcctcgtgcccatctctggactccaggctgaggacgaggctgattagtcggagtctgtcttaatataagaagcagtnccacttcacgttagattcggcggaggaccaagctagaccgtcgtaggtcagcccaaggcctcgccccgtggtccaccgtctcgttcccgccctcctccacgtactctagtactgcgtccggg

SEQ ID NO: 92539 - DNA, 536 bp, Homo sapiens
  misc_feature: GYAE6OF01AJNQD.35.1.A01.1.454.CMB.1.raw
  modified_base (273)..(273): a, c, t, g, unknown or other
  misc_feature (273)..(273): n is a, c, g, or t
  modified_base (294)..(294): a, c, t, g, unknown or other
  misc_feature (294)..(294): n is a, c, g, or t
tcagtacagatcgtcacgaccggtgctcgatttagacgtctcatcagggcctgggctctgctcctcctcacctcctcactcagggcacaggctcttgggcccagtctgccctgattcagcctccctccgtgtccgggtctcctggacagtcagtcaccatctcctgcactggaacctgcagtgatgttgggaattatgactatgtctcctggtaccaacttcacccagacacagtccccaaaccatgatctacaatgtcaatattcggccctnaggagtcccctaatcgtttcnctgctccaagtctggctatgtcggcctccgtgcccatctctggactccaggctggaggacgaggctgatttagttgggagtctgtcttatatagaagcagtcgcctacttcacgttagattcggcggaggaccaagctacgaccgtcgtagtcacgcccgaaggcctcgccccctcggtccaccgtccgtccgttccccacccttccctaccaccgtactcgtagtacctggacggtccggg

SEQ ID NO: 92540 - DNA, 660 bp, Homo sapiens
  misc_feature: GYAE6OF01CKZWG.35.1.A01.1.454.CMB.1.raw
tcagtacagatcgtcacgaccggtgctcgatttagacgtctcatcagggcctgggctctgctcctcctcacctcctcactcagggcacaggctcttgggcccagtctgccctgattcagcctccctccgtgtccgggtctcctggacagtcagtcaccatctcctgcactggaacctgcagtgatgttggaattatgactatgtctcctggtaccaacttcaccagacacacgtaccccaaaccatgatctacaatgtacaatatccgcctgagacgtcctaatcgtttctcgtgctaccaagtctggctagtcgccggcctcgtcgcccatctcgtcggactccgaggtctaggaggacgtaggtctagtatttacggtggacgtcgtgtacttataagtagaagactagtcacctacttcgtaacgttacgtagttaccgggacgggtaagggaccgaacgtccgtacggtacccggttacccgtaacgggtaccgaccggaccccgaacgggtcccgttcccggtaccccccggtaccgggttcctaccccggttcccgtttccccggttccccccggtccccctttaccccgttacccgaaccggttacccgttaccgtttaaccggtaccgttacgggtaccgggtacccggggg

SEQ ID NO: 92541 - DNA, 506 bp, Homo sapiens
  misc_feature: GYAE6OF01BR6M1.35.1.A01.1.454.CMB.1.raw
  modified_base (371)..(371): a, c, t, g, unknown or other
  misc_feature (371)..(371): n is a, c, g, or t
  modified_base (478)..(478): a, c, t, g, unknown or other
  misc_feature (478)..(478): n is a, c, g, or t
  modified_base (499)..(499): a, c, t, g, unknown or other
  misc_feature (499)..(499): n is a, c, g, or t
tcagtacagatcgtcacgaccggtgctcgatttagacgtctcatcagggcctgggctctgctcctcctcacctcctcactcagggcacaggctcttgggcccagtctgccctgattcagcctccctccgtgtccgggtctcctggacagtcagtcaccatctcctgcactggaacctgcagtgatgttgggaattatgactatgtctcctggtaccaacttcacccagacacagtccccaaaccatgatctaacaatgtcaatattcggccctcaggacgtccctaatcgtttctctggctccaagtctggctatgcggcctccgtgcccatctctggacctccaggctgaggacgaggctgattattacngcagctcatatacaacagcagcactctcgtgttcggcggaggaccaagctcgaccgtccgtaggtcacgcccgaggcctcgcccctcggtccacgtctcgttccccnccctcctcacgtctctgctgngtccggg

SEQ ID NO: 92542 - DNA, 567 bp, Homo sapiens
  misc_feature: GYAE6OF01CH0U2.35.1.A01.1.454.CMB.1.raw
  modified_base (294)..(294): a, c, t, g, unknown or other
  misc_feature (294)..(294): n is a, c, g, or t
  modified_base (488)..(488): a, c, t, g, unknown or other
  misc_feature (488)..(488): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcaggcacaggctcttgggcccagtctgccctgattcagcctccctcgtgtccgggtctcctggacagtcagtcaccatctcctgcactggaacctgcagtgatgtaggaattatgactatgtctcctgtaccaacttcaacagacacacgtaccccaaaccntagactactaacaatgtacaattcttccgccctgaacggacgttaccctaattccgttactctggcctaccgtaagtctggcttagtcgccggtcctccgtcgcccattctcgttacggacctccgaaggtcctaggacggacgaggtctagtactttagtgggatcttgactttaatagtagaagtctagtcncctattccgtaagttagacggttccgggagggaacggtaccaaggtcctacggaacccgttcgaacggtcacggacccg

SEQ ID NO: 92543 - DNA, 556 bp, Homo sapiens
  misc_feature: GYAE6OF01BJNMB.35.1.A01.1.454.CMB.1.raw
tcagtacagatcgtcacgaccggtgctcgatttagacgtctcatcagggcctgggctctgctcctcctcacctcctcactcagggcacaggctcttgggcccagtctgccctgattcagcctccctccgtgtccgggtctcctggacagtcagtcaccatctcctgcactggaacctgcagtgatgttgggaattatgactatgtctcctggtaccaacttcacccagacacagtccccaaaccatgatctacaatgtacaatattcggccctacaggacgtcccctaatcgtttctctggctccaagtctggctatgcggcctccgtcgcccatctctggactccgaggctgaggacgagctgattagttggagcgtgacttaatagtaagaagcagtcgacctacttacgacgttagacgttccgggacggacgggaccaagcgtagacccgtcgtaggtccacgcccaaggctccgccccgttcggtcctaccgtccgtcgttccccgcccttcccgtaccaccgtacttccgtagtaccgtggcgtccgggg

SEQ ID NO: 92544 - DNA, 581 bp, Homo sapiens
  misc_feature: GYAE6OF01AW8V8.35.1.A01.1.454.CMB.1.raw
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcaccatctcctgcactggaacctgcagtgatgttggaattatgactatgtctcctggtaccaacttcaccagacacacgtaccccaaaccatcgatctacaatgtacaatacttccggccctcgaggacgtccctaattcgtttctctggcctaccaagtctggctagtcggccggtcccttccgtcgcccctattcctcgtcggacctccgaggtcctgggaggacgaggtctagagtttagtggagtctgtcttagtagtagaagtcagtcgacctacgttcgaacggtttagacgtttccgggacgggtacggaacccgtaaggtcccgttacggaccccgttaccgtaacgggtccgaacggtacccccgg

SEQ ID NO: 92545 - DNA, 768 bp, Homo sapiens
  misc_feature: GYAE6OF01C8KSU.35.1.A01.1.454.CMB.1.raw
  modified_base (247)..(247): a, c, t, g, unknown or other
  misc_feature (247)..(247): n is a, c, g, or t
  modified_base (295)..(295): a, c, t, g, unknown or other
  misc_feature (295)..(295): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcaccatctcctgcactggaacctgcagtgatgttggaattngactatgtctcctgtaccaacttcaccagacacacgtaccccaaaccntgatctaacaatgtacaaatacgttccggccctgaacggtacgttaccccttaaatttcccgttttactcgttcgggtaccctacccgtaaaggtccgttagggacctttaagttcggcccgggttcccttaccccggtttccgacccccctaagttcccgttaccgttacgggtaacccttcccgaaggggtcccttaggggaacggggtaaccggtaacgggtcctttagggttaacgttttaacggttttggggaacgttccgtttacggttaacctttttaaagtaacgttaaacgggaaacgtcccgtaaggttccggtacccccttaacggttttacccgtaacgggttttaaaggtaccggttttacccgggggaccggggtaaacggggaaacccctaaagggtcccgttaacgggtaacccccggtttccggtaaacggggttcccaacccgggtaacccccgg

SEQ ID NO: 92546 - DNA, 620 bp, Homo sapiens
  misc_feature: GYAE6OF01CJVYM.35.1.A01.1.454.CMB.1.raw
  modified_base (431)..(431): a, c, t, g, unknown or other
  misc_feature (431)..(431): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcaccatctctgcactggaacctgcagtgatggttaggaattatgactatgtctcctgtaccaacttcaccagacacaccgtaccccaaccatgactctaacaatgtacaatcttccggccctagacggtactaccctaattcgttactcgtcggctaccgtaagtctggctagtcgccgcctccgtcgccctattctcgtcggacctcgaggctaggacggacgngtctagtatttagtgggactctagtactttagtacgtagaacgtactacggtccgaccgttacttttaccgaacggtttaacggtaccgggtttccgggggaaccggggtaacgggaacccctaaagggtccccgttaaccgggaaccccgtttccggtaaacgggtcccgtaaccgggtaacccccgg

SEQ ID NO: 92547 - DNA, 634 bp, Homo sapiens
  misc_feature: GYAE6OF01CVQ3X.35.1.A01.1.454.CMB.1.raw
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (349)..(349): a, c, t, g, unknown or other
  misc_feature (349)..(349): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcaccatctcctgcactggaacctgcagtgatgttggaattangactatgtctcgtgtaccaacttcacccagaccacacgtaccccaaaccntcgatctaanatgtacaatcgttccggccctgaggctacctaattcgttcncgtgcctacagtctggctagtcgccgtccttccgtcgccctagtcctcgtcggacctccgaggcctaggacggacgaggcttaggtatttaggtcggactcgtgtacctttaagtagtaacggaacgtcgtacggttccgaccccttaacgtttccgtaacggttttaaggacgggttttacccgggggaacgggtaaaccggggtaacccctaaagggtcccgttaaccgggtaacccccggtttaccggtaaacgggttcccgaaacccgggtaacccccggg

SEQ ID NO: 92548 - DNA, 629 bp, Homo sapiens
  misc_feature: GYAE6OF01CZURQ.35.1.A01.1.454.CMB.1.raw
  modified_base (306)..(306): a, c, t, g, unknown or other
  misc_feature (306)..(306): n is a, c, g, or t
  modified_base (440)..(440): a, c, t, g, unknown or other
  misc_feature (440)..(440): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcaccatctcctgcactggaaccagcagtgacggttggtgttataactatgtctcctggtaccaacaccaccaggacaaacgccccaaactcatgatttangatgtacagtaatccggccctagtacgggtttctaatcgtacttctcgtggtctaccaagtcgtacggacaaaccgccggtcctcccgtcgacctacttctccgtggtcctccgaggtccttacggaccgacgnggtacttacgtatttactacgtgcagtctactataacgtaccaacagacagcctaacgttccttacggtcggttaccgggacgggtaaaccgggacccgaaacggtccggttaccggtaacccccgggttccgttaaaccgggtacccgaacccgggtaaccccgtaaaggggtccccttacccccggg

SEQ ID NO: 92549 - DNA, 539 bp, Homo sapiens
  misc_feature: GYAE6OF01ERRW7.35.1.A01.1.454.CMB.1.raw
  modified_base (295)..(295): a, c, t, g, unknown or other
  misc_feature (295)..(295): n is a, c, g, or t
  modified_base (343)..(343): a, c, t, g, unknown or other
  misc_feature (343)..(343): n is a, c, g, or t
  modified_base (375)..(375): a, c, t, g, unknown or other
  misc_feature (375)..(375): n is a, c, g, or t
  modified_base (443)..(443): a, c, t, g, unknown or other
  misc_feature (443)..(443): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcacatctcctgcactggaacctgcagtgatgttgggattatgactatgtctcctggtaccaacttcaccagacacacgtccccaaaccntgatctaacaatgtacaatacttcgcctcaggactccctaatcgttcnctggctcaagtctggctagtcgcgcctcgtcncctatcctctggactcgaaggctaggacggacaggctggatttagtggatctgacttatacgtagaancgtagtcgacctacttcaacggtttagtacgttcggggacggaacgggaccaaggcgttacggaacccgttcctaagggtaccgcggtaaccccgg

SEQ ID NO: 92550 - DNA, 578 bp, Homo sapiens
  misc_feature: GYAE6OF01A0GOL.35.1.A01.1.454.CMB.1.raw
  modified_base (272)..(272): a, c, t, g, unknown or other
  misc_feature (272)..(272): n is a, c, g, or t
  modified_base (353)..(353): a, c, t, g, unknown or other
  misc_feature (353)..(353): n is a, c, g, or t
tcagtacagatcgtcacgaccggtgctcgatttagacgtctcatcagggcctgggctctgctcctcctcacctcctcactcagggcacaggctcttgggcccagtctgccctgattcagcctcctccgtgtccgggtctcctggacagtcagtcaccatctcctgcactggaacctgcagtgatgttgggaattatgactatgtctcctggtaccaacttcacccagacacagtccccaaaccatgatctacaatgtcaatattcggccctnaggacgtcccctaatcgtttctctggcctcaagtctggctatgcgcctcgtcgcccatctctggactccgagctgaggacnggctgattagttggagtctgtactatatagaagcgtagtcacctacttacgtaacgttagacgttccgggacgggtaacggaccgaagtcgtacgacccgtacgtacggtcacgtaccgaacggcctccgcccctcggtacctacttccgttccggttacccccaccccttcccgtaccgaccggtacttacccgttacggttaaccgcggtacgggtcccgggg

SEQ ID NO: 92551 - DNA, 705 bp, Homo sapiens
  misc_feature: GYAE6OF01DA1IP.35.1.A01.1.454.CMB.1.raw
  modified_base (599)..(599): a, c, t, g, unknown or other
  misc_feature (599)..(599): n is a, c, g, or t
tcagtacagatcgtcacgaccggtgctcgatttagacgtctcatcagggcctgggctctgctcctcctcacctcctcactcagggcacaggctcttgggcccagtctgccctgattcagcctccctccgtgtccgggtctcctggacagtcagtcaccatctcctgcactggaacctgcagtgatgttggaattatgactatgtctcctggtacccaacttccacccagaccacacgtaccccaaacccatgatctaacaatgtacaattattccggaccctcaaggtacgtccccttaattccgttttcctctcggccttaccaagtctggctatcggcggcccttccgcgccctatcctcgtggtacctccgaggctaggaggacgaggtctagactttagtggacgtctagtacgttaatagtaacgaagacgtaggtcgaccctacgttacgtaacggtttagtacggtttccgggacgggtaacgggaacccgtaaggtccgtaccgggtaaccccggttacccgttacgggttacccgaaccggtaccccggtacggtcccgttaccccggtccccccggtccgggttacccncccgtttccccgttacccgtttaccccccgtaccccccttacccgttacccgtacccgttacctttacccgtttcggttaacccgtgggtacccgggtacccgggg

SEQ ID NO: 92552 - DNA, 679 bp, Homo sapiens
  misc_feature: GYAE6OF01CPFWB.35.1.A01.1.454.CMB.1.raw
  modified_base (259)..(259): a, c, t, g, unknown or other
  misc_feature (259)..(259): n is a, c, g, or t
  modified_base (306)..(306): a, c, t, g, unknown or other
  misc_feature (306)..(306): n is a, c, g, or t
  modified_base (664)..(664): a, c, t, g, unknown or other
  misc_feature (664)..(664): n is a, c, g, or t
tcagtacagatcgtcacgaccggtgctcgatttagacgtctcatcagggcctgggctctgctcctcctcacctcctcactcagggcacaggctcttgggcccagtctgccctgattcagcctcctccgtgtccgggtctcctggacagtcagtcaccatctcctgcacgtggaacctgcagtgagtggttagggaattatgactatgtcttcctgtaaccaacttcaacccagaccacacgtaccccaacatgatcaanaatgtacaatcttccggccctagaggtactaccctaattccgtttcncgtcggcctccgaagtctggcttagcgccgtcctcgtcgccctatctcgtcgacctccgagtctggaacggcgagtctagtactttagtcgggagcgtagtacgtttaagtaagtaacgaagccgtaggttaccgtaccctttaacgttccgtaacggtttacgtacggtttccggggtacgggaaccgggtaaccgaaaggtcccgtacggtaaccccgggtccgttaacgggtacccaaccggtacccggaacggtcccgtcccgggtaccccgttcggtaccctaccgttcccgttcccggttacccccgtccccttacccgtacctacccgttacgttcccgtacgttaccggnggtccggtacccggg

SEQ ID NO: 92553 - DNA, 829 bp, Homo sapiens
  misc_feature: GYAE6OF01AEJYW.35.1.A01.1.454.CMB.1.raw
tcagtacagatcgtcacgaccggtgctcgatttagacgtctcatcagggcctgggctctgctcctcctcacctcctcactcagggcacaggctcttgggcccagtctgccctgattcagcctcctccgtgtccgggtctcctggacagtcagtcaccatctcctgcactggaacctgcagtgatgttggaattatgactatgtctcgtgtaccacttcaccagacacacgtaccccaaaccatcgactactaacaatcgtactaaattacgttccggaccctacgaacggtaccgttaccccttaaatttccggttttcctccgtcggtaccttacccgtaagttccgtcgggtacttagtccggcccggtccccgttccggtccgacccctacgttccgttccggtacgggtacccttccggaacgggtccgttacggggaacgggaccggtaacggggtccttaggttaacgttttaggttcgggaacgttcgttacgtaacttttaagtaagtaacggtaaacgtacgtaacggttacgacccttaccgttttaaccggtaacggtttacggtacgggtttcccgggaacggggaaacgggtacccgtaacggtccgttacccgggttaccccggtaccggttaacgggttacccgaaccggtaacccggaacgggttccccgtacccccggtccccggtttacccgggttaccttaaccccgtttcccggttacccccggttacccccctaccccgttacccgttacccgtaaccggtaccgtttccctaacgggtttaccgtcgggggtaacggtccccggggg

SEQ ID NO: 92554 - DNA, 752 bp, Homo sapiens
  misc_feature: GYAE6OF01B6TQK.35.1.A01.1.454.CMB.1.raw
  modified_base (303)..(303): a, c, t, g, unknown or other
  misc_feature (303)..(303): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagtcctccctccgtgtccgggtctcctggacagtcagtcaccatcctcctgcactggaacctgcagtgatggttaggaattatgatatgtcctcgtggtaaccacttcacccagacacaccgtaccccaaaccntgactctaacaattcgtactaaacgttacgttccggaccctagaacgggtaccttaccccttaaattcccggtttctccgtacggtacctacgtaagtcgtacggcttagtcggacccggtcccttccggtctaccctacgttccgttcgtcgggtacccttacggacgggtacgtacgggaacgggtaccggtacgggtaccgtttaggtaacgttttacggttacgggagttccgttcgttacgttaagttaaggttaacggaacgtaccggtacggttaccggtaccccgttaaacgttttaccggtaacgggtttaacgtaaccggggttttacccgggggaaccgggttaacggggtaaaccccttaaacggggtccgtttaaccccgggaacccggtttaacccgggttaacccgggtaccggtaacccgggtaacccccggg

SEQ ID NO: 92555 - DNA, 848 bp, Homo sapiens
  misc_feature: GYAE6OF01DYXK2.35.1.A01.1.454.CMB.1.raw
tcagtacagatcgtcacgaccggtgctcgatttagacgtctcatcaggggcccagtgctggggtctcaggaggcagcgctctgggggacgtctccaccatggcctgggctctgctcctcctcacctcctcactcgagggcacaggtcttcgttgggcccagtctcgccctgatcagccctccctccggtgtccggtctccgtggacagtcacgtcaacctattcctcccgtgaccacgtcgggaaccctggctaaggttgagttggttaggtaaattacgtagaacttaagtcggttccttacccgttagggtaaacccaacctttaccaaccccgtaacgaacctaaccgtaaacccggttaacccccccgaaaaaccctaagtttacggaacttacccgttaaacgtaaaactttaggtaaaccctaaattaaccgtttcccgggaccccttacgaacgggtaccttaccttaacgttccgtttactctacgggtacctaccgaaaggttctcgggtacttaggtccgaccggtccccgttccggtccgtccctacgtccgttcgtacgacctaccgtacgggccgttagggaacggtacggacggtccgttagtaaagtttaggttaggacgtacgtttacgtaacgttttaaactaaaggtaaaccgtaacgaccgtacgttaccggacccttaaacgtttccgtaaaaggtttaccggggttaacttaccggggggaaccggggttaaacgggaaacccggtaaaccggtaccggttaaccggtaaaccccggtttacccgggtaaaccggggttaaacccggaacccccggttaaaccgggg

SEQ ID NO: 92556 - DNA, 663 bp, Homo sapiens
  misc_feature: GYAE6OF01ATWCE.35.1.A01.1.454.CMB.1.raw
  modified_base (273)..(273): a, c, t, g, unknown or other
  misc_feature (273)..(273): n is a, c, g, or t
  modified_base (309)..(309): a, c, t, g, unknown or other
  misc_feature (309)..(309): n is a, c, g, or t
tcagtacagatcgtcacgaccggtgctcgatttagacgtctcatcaggggcccagtgctggggtctcaggaggcagcgctcgtgggggacgtctccaccatggcctgggctctgctcctcctcacctcctcactcagggcacaggctcgttgggcccagtctcgccctgattcacgccctccctccggtcggtccgggtctccgtggacagtcagtccacctatcctcctgcctacgtcggaacctgactagtgattgggttaggtaattagngtacttatcgtctccgtacgtaacctactccaccanaccactaccgaccccaacatagtactactaactatcgtaactaattcgtccggaccctacggacggtaccttacctaagttccgttactcgttcggacctacgtagttcgtaggtctagtccggccgtcctccggtcaccctagtccgtcgtcgtacctccggaggtccgaggaacggtacggacgttcgtagttacgttggacggtattccgtagttaactaagtacggaagtacgtacgtacgtacgtaccgttactacggttaacggtagtaccgggtaccgggacgggaccgggtactaacgggttccgtaaccgggtaccgtacggtacggaccgcccggtaaccccgg

SEQ ID NO: 92557 - DNA, 908 bp, Homo sapiens
  misc_feature: GYAE6OF01EZZ8U.35.1.A01.1.454.CMB.1.raw
  modified_base (200)..(200): a, c, t, g, unknown or other
  misc_feature (200)..(200): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcgttgggcccagtctgccctgattcacgcctccctcgtgtccggtctcgtggacngtcagtcacctatctcctgactacgtcggaacctgctagtgtagttggttaggtaattagtacgtaacttagttcggttcccttaccgtacggtaaccctaaccgtttacccaaccccgtaacggaaccctaaccgtaacccgtaaccccccaaaaccctagtacgtaccttaacctaactaacgttcgtaactaaacgttacgttcccggaccctacggaacggtaccgtttaccccttaacgtttccgtttccgtcgtacggtacctaccgtaacgtcgtcgtacctagtccggtaccgtcccgttaccgtaccgtaccctacgtttccgttaccggttaccggtaacccgtaccgggtacgggtacccggtaacgggggtaacggggacccggttaacgggttaccgtttaacggtttaaacggtttttacgggtttacggggtaaaccgttcggtttaaccggtttaaccgtttaaaggttaaacggttaaaccgggtaaagttacccggttaacggggtttccctaaacccggttttaaccgttttaacccggtaaaacgggttttacgggtttaaaccggggttacccggggggtaaacgggtaaaccccgggtaaaacgttaccgggtacccgggtttaacccggggtaacccgtttaaccgggtacccggttaaccggaaacccccgggtaaccccgggg

SEQ ID NO: 92558 - DNA, 538 bp, Homo sapiens
  misc_feature: GYAE6OF01BUJGV.35.1.A01.1.454.CMB.1.raw
  modified_base (332)..(332): a, c, t, g, unknown or other
  misc_feature (332)..(332): n is a, c, g, or t
  modified_base (384)..(384): a, c, t, g, unknown or other
  misc_feature (384)..(384): n is a, c, g, or t
  modified_base (494)..(494): a, c, t, g, unknown or other
  misc_feature (494)..(494): n is a, c, g, or t
  modified_base (501)..(501): a, c, t, g, unknown or other
  misc_feature (501)..(501): n is a, c, g, or t
  modified_base (526)..(526): a, c, t, g, unknown or other
  misc_feature (526)..(526): n is a, c, g, or t
tcagtacagatcgtcacgaccggtgctcgatttagacgtctcatcagggcctgggctctgctcctcctcacctcctcactcagggcacaggctcttgggcccagtctgccctgattcagcctccctccgtgtccgggtctcctggacagtcagtcaccatctcctgcactggaacctgcagtgacgttgtgctgataactatgtctcctggtaccaacaccacccaggcaaacgcccccaaaatcatgatttatgaatgtcagtaatcggccctacaggggtttctaactcgtcttctcgtggcctccaagtctggacaacaccggcctccncgaccatctcgtggctccgagctacgacgacgaggctgtattattactgacngctacatactacaacccagcagccactctaggtcgtcggcggacggaccagctcgaccgtcgacgtcacgcccgaggcctccgccccgtgcctactccgtccgttccccnccttccncctacgacttcgtacgtacgtacgnggtccgggtacg

SEQ ID NO: 92559 - DNA, 622 bp, Homo sapiens
  misc_feature: GYAE6OF01D4VA8.35.1.A01.1.454.CMB.1.raw
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
  modified_base (368)..(368): a, c, t, g, unknown or other
  misc_feature (368)..(368): n is a, c, g, or t
  modified_base (414)..(414): a, c, t, g, unknown or other
  misc_feature (414)..(414): n is a, c, g, or t
  modified_base (474)..(474): a, c, t, g, unknown or other
  misc_feature (474)..(474): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcgaggcacaggctcttgggcccagtctgccctgattcagccctccctccgtgtccgggtctccgtggacagtcagtccacatcctcctgcacgtggaacctgcagtgtagttggttaggaattgtgtactagtgtcctccgtgtaaccaacttccaccagacacaccgtaccccaaaccntagactctaacaattnacaattcttccgcctacgagtactccttaattccgttacncgtcggcctaccgtaagtcctagtctacgtcgcccgtcctccgtcnccctatctcgtacgacctcgacggtctagggacggtacgacgtcgtagtagttttacggngacgtcgttagttacctttaagtagtaagtaacgcgtaggttcaccccttagttaccgtaacggtttagtccgggttacgggacgggtaaccgggaaccaggtaccgttaccggtacccgttacgtaaccggtgaccccggtacccgg

SEQ ID NO: 92560 - DNA, 844 bp, Homo sapiens
  misc_feature: GYAE6OF01ALXIL.35.1.A01.1.454.CMB.1.raw
  modified_base (195)..(195): a, c, t, g, unknown or other
  misc_feature (195)..(195): n is a, c, g, or t
  modified_base (247)..(247): a, c, t, g, unknown or other
  misc_feature (247)..(247): n is a, c, g, or t
tcagtacagatcgtcacgaccggtgctcgatttagacgtctcatcagggcctgggctctgctcctcctcacctcctcactcagggcacaggctcttgggcccagtctgccctgattcagcctccctccgtgtccggtctcctggacagtcagtcaccatctcctgcactggaacctgcagtgatgttgggaattntgactatgtctcctggtaccaacttcacccagaccacacgtaccccaaaccnttacgatcctaacaattcgtacaattacttccggccctacgaacggtacgttaccccttaaagttccgttttacctacgttcggtaccttacccgtaaagttccgtacggtccttaacgtccgggtcccggtccccgtttccccggtacggtacccccttaagttccccggttaccgttaccggggtaaccctttcccggaaacggggttccccgtttaacggggaaacgggttaacccggggaacgggtacccgtttaagggttaaaccgttttaacgggtttacggggtaacggttccgttacggttaccgtttaaagttaacgttaacggtaaacgtacgtaacggtacgtacccgtaccgtttaccgttaacggttacgtaacggttccgggtacgggtacgggaaccgtacggtaccgttacggtaaccccggtacggttaaccggtaccgtaccgtacccggaacgttccgtcccggtacccccgttacggtaccctaccgttcccgttccccggtttacccctaccccgttacccgtcccgtaaccgtaccgttaccgttaccggttaacgtccgggaacggttcccggg

SEQ ID NO: 92561 - DNA, 699 bp, Homo sapiens
  misc_feature: GYAE6OF01DMRUB.35.1.A01.1.454.CMB.1.raw
tcagtacagatcgtcacgaccggtgctcgatttagacgtctcatcaggggcccagtgctggggtctcaggaggcagcgctcgtggggacgtctccaccatggtctgggctctgctcctcctcacctcctcactcgaggcacaggctcgttcgggcccagtctcgccctgattcacgtccctccctccggtcggttccggtcctccgtggactagtcacgtccaccatcctcctcgactacgtaccggaacctgcgtagtggtattcgggtaagggtaattagtagtacttagtcgttccgtaccgtacgtaacctaccttaccaaccacgaccaaccgtacccgtaacccccaacatacgactactaacctatagtactaaacttccgtaccgaccctacgaaccggttaccttaccgttaacgtttccgttcgtaccgtcggtacccttaacgaacggttccgtacggtacttacggtccggtcccggttcccgtacccggtcctaccccttacttccgttaccgtccgtaccggacgtagtacccggtaggggaccgacggtacgtacgttacgttagttacggtgtacgtcttagtacttaagtaacgacgaggttcgacgtaccgtactacgttcgtaggttacggaccggtgggacggacgactgaccgtacgacgtcgtacggcaccggtacg

SEQ ID NO: 92562 - DNA, 744 bp, Homo sapiens
  misc_feature: GYAE6OF01BIIBG.35.1.A01.1.454.CMB.1.raw
  modified_base (197)..(197): a, c, t, g, unknown or other
  misc_feature (197)..(197): n is a, c, g, or t
  modified_base (248)..(248): a, c, t, g, unknown or other
  misc_feature (248)..(248): n is a, c, g, or t
tcagtacagatcgtcacgaccggtgctcgatttagacgtctcatcagggcctgggctctgctcctcctcacctcctcactcagggcacaggctcttgggcccagtctgccctgattcagccctccctccgtgtccgggtctcctggacagtcagtcaccatctcctgcactggaacctgcagtgatgttaggaattntgactatgtctcctggtaccaacttcaccagaccacacgtaccccaaaccntacgactactaacaattcgtactaaatttacctccgggcccttacgaacgggtaccttacccctttaaagtttccgttttcctcggttcggtacccttaccgaagtttccgtaggtaccttagtccggcccggtccccttcccgtcgtacccctagttcttccgtcggtaccctccgacggtcgtacgggacggacgtacggtcgtttagtaacgtttaggtcggacgttcgtacgttacttaagttaagtaacggtaacgtacgtaacggtcgtacccttaccgttccggtacggttaagtacggttccggggaacgggacggtaaccgacgtaccgtaccggtacccggttacgtaccggtaccgaccgtacccggtaacggccccgttacccggtcccccgttacggtacccttacccgttcccgttccccgttacccctacccctcccgtacccgtacgtaccttcggttacgtacgtcggtacggtccggg

SEQ ID NO: 92563 - DNA, 643 bp, Homo sapiens
  misc_feature: GYAE6OF01B85P0.35.1.A01.1.454.CMB.1.raw
  modified_base (349)..(349): a, c, t, g, unknown or other
  misc_feature (349)..(349): n is a, c, g, or t
tcagtacagatcgtcacgaccggtgctcgatttagacgtctcatcagggcctgggctctgctcctcctcacctcctcactcaggcacaggctcttgggcccagtctgccctgattcacgccctccctccgtggtccgggtctcctggacagtcagtcaccatctctgcactggaacctgcagtgattgttagggattatgactatagtcctcgtggtacctaacttccaacccagacaccgtacgtaccccaacatgactctaacaattgtacaattcgtccggtcctgacggtctaccttaattcgtttctcgtcgcctacacgtctaggctagcgccgcgtccgtcnccacttctacgtcgtactccggagtccgtaggcggacggtgtctgttaagttcggtagagtcgtgtacttagtaataggtaacgtcgacgtcgtaccacgttactacggtacgtcgtcggggaacggacggtaacaacggtcgttaccgaccggttcgtacggtaccgaccgacccggaggttcccgtcccgggtcccctacggtacccgttacccgttccttaccccggtccccctccccgtacctaccgaccgttacgtaccgttacggtaccgttcggccggtacccgggg

SEQ ID NO: 92564 - DNA, 772 bp, Homo sapiens
  misc_feature: GYAE6OF01EMK9P.35.1.A01.1.454.CMB.1.raw
  modified_base (217)..(217): a, c, t, g, unknown or other
  misc_feature (217)..(217): n is a, c, g, or t
  modified_base (471)..(471): a, c, t, g, unknown or other
  misc_feature (471)..(471): n is a, c, g, or t
tcagtacagatcgtcacgaccggtgctcgatttagacgtctcatcaggggcccagtgctggggtctcaggaggcagcgctctgggggacgtctccaccatggcctgggctctgctcctcctcacctctcactcgagggcacaggctcgttcgggcccagtcgtcgccctgacttcacgtccctccccgtcggttcggtcccgggtcctccgtggacncgtcgacgtcaaccacttcctcctgctacgtacggaaccctgacgtaggtgtagttacggttagggtaatttacgtagtaacttgttcgttccgttaccgttaccggttaaccctaaccttacccgaacccgacgtaaccctaacctaaccccgtaacccccaaaacctagtaccgtactacctaacgtaacgttagtaactaaacgttccgtcccgtacctacgaggttacccgttaccttagtttccgttcnccgtcgtcctacgtacgttcgtgtctacggtccgcccggtcctaccggtccgtacttcgtcgttaccgcggtacctaccggtggtacgacgggaggtaaccgtacgtgttaccggttaatttcggtggaacttcggttaccgttaattaacggtaataccggattaacgggaccgttaacgccctttaaagttccgggttaaacggtttacggcgggtttacccggacgggggaaaccttaacggtacgtaccggtaccgggttaacccgttccgaagggttcccgaaccgggtaacccgg

SEQ ID NO: 92565 - DNA, 902 bp, Homo sapiens
  misc_feature: GYAE6OF01AG1CL.35.1.A01.1.454.CMB.1.raw
  modified_base (325)..(325): a, c, t, g, unknown or other
  misc_feature (325)..(325): n is a, c, g, or t
tcagtacagatcgtcacgaccggtgctcgatttagacgtctcatcaggggcccagtgctggggtctcagggaggcagcgctcgtgggggacgtctccaccagtggcctgggctctgcctcctcctcacctcctcactcagggcacaggctcgttgggccctagtctgccctgattcagccctccgtcgtcgtccgggtctccgtggacagtcacgtccaacctactcctccgtgctacgtacggaacctgcgtagtgtagttggttagggtaattagtgtaacttgttcgtccttccgtacgttaacccaccttccaacccgtanaaccctaacgacccttaccccaaacccgtagtacgtacttacctaactatacgtacgtaactttaccgtccggtaccctaccgtaaccggtacccgtttaccccgttaaacgtttcccgttttacccgtcgttacccgggtaccttaccggttaacggttcgttacggtaacgttcggtcggtccccggttcccgtcccggtcccggtacccttcgtacccgtttccggtaccggttacccgtaccggtaccgggttaacgggtaaccggggaacgggtaacccggggtacggtttaccgttaagggttaacgttttaagggttcgggaacgttccggtttacgttaacgtttaacgtaaacgggttaagggtaaccgtaacggttaccggtaccggttaacccttacccgggtttaaacgtaaccggggtttaaccggtaccgggggttacccgggggtaaaacccggggtacgggtaaaccccgggaaccgggttaacccggtttaaaccccgggggtacccgttttaaccggggaacccgtttacccggtaaaaccccggggtacccccccggg

SEQ ID NO: 92566 - DNA, 796 bp, Homo sapiens
  misc_feature: GYAE6OF01D5E28.35.1.A01.1.454.CMB.1.raw
  modified_base (191)..(191): a, c, t, g, unknown or other
  misc_feature (191)..(191): n is a, c, g, or t
tcagtacagatcgtcacgaccggtgctcgatttagacgtctcatcagggcctgggctctgctcctcctcacctcctcactcagggcacaggctcttgggcccagtctgccctgattcagcctccctccgtgtccgggtctctggacagtcagtcaccatctcctgcacgtggaacctgcagtgacgttggngctagaataactatgtcctcctacggtaaccaaccaccaccgaggaccaaaccgccccaaaatcatagtaactttatgatcgtactaacgtaacgtccggtaccctagtacgggtttactagtccgtcttctcgtcgctaccgtaagtcgtggacctaaccgtacccggtcctaccctacgacctacttccgttacggtcgggtaccctaccggtacggtacgtacggaaccgggaccggacgggtacccttaggttaaacttttaacgttaccgtagtccgtaacgttacccttactaaacgttaacctaaacccgaaaccgtacgaccgaacgtaccctaccgtttaccggttccgggtttaccgggtaccgggaaccgggtaaccggaacgtaaccggtaccgtaacccggttacccggttaaccggttaccgggtacccgtaaccggtaaccccggtacgtaccccggtccccggttaccccgtacggttaccctaccgtttccccggttcccgttccccccgtaccccgtttacccgtaccgtacccgttaaccttcgggtttacctaacggtacgggtccggtccgggttaacccgggg

SEQ ID NO: 92567 - DNA, 840 bp, Homo sapiens
  misc_feature: GYAE6OF01BEFHB.35.1.A01.1.454.CMB.1.raw
tcagtacagatcgtcacgaccggtgctcgatttagacgtctcatcagggcctgggctctgctcctcctcacctcctcactcagggcacaggctcttgggcccagtctgccctgattcagccctccctccggtgtccgggtctccgtggacagtcagtcaccatcctctgcacgtaggaacctgctaggtagagttggttagggtaattagtagtaccttagttcggttcctaccgttacggttaaccctaaccttaccaacccaacgaaccaccgtaacccgtaacccccaaaaccgtatacgtactaacctaacgtaacttacgtaactaactaccgttccggacccttaggacgggttaaccttaccctaacgttttccgtttacgttaccggttcggtaccctaacgtaaggttcccgtaggtacttacgtccggcccggtacccgtccggtcctaccctaacgttcgtcgtaccggtacctaccggtcgggacggtacggacgggtacacgggttactaggttagttacggtaggtcgttacgttagttacgttaagtaagaacggtacgtacgtaacggtccctacctacgtttaaccggttaacggttacggtacgggttaccgggaaccggggtaaccggtaccgaacggttacccgttaaccgggtaccggttaccggttacggaacccggtaccggtaacccggtacggtaccccgtaccccggtacccgttccggtacccgttacccgttcccgttccccggttacccccgtccgttaaccctccggtacttccggttactaccgggttacggtccggtcgggtaccggg

SEQ ID NO: 92568 - DNA, 785 bp, Homo sapiens
  misc_feature: GYAE6OF01AOZ8C.35.1.A01.1.454.CMB.1.raw
  modified_base (369)..(369): a, c, t, g, unknown or other
  misc_feature (369)..(369): n is a, c, g, or t
  modified_base (576)..(576): a, c, t, g, unknown or other
  misc_feature (576)..(576): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcgagggcacaggctcgttgggcccagtctcgccctgacttcacgccctccctccgtgtcccggtctccgtggacagtcagtccacctatcctcctgctacgtcggaacctgacgtagtcgtagttgggttagggaatttacgcggtaacttacgttcgttacccttccgtaccggtaacccctaaaccgttccaaccccgaacgtacccaaccgtacccgtaaccccaaaacccgtnttaccggaacttacctaacaacgttcgtactaatttaccgttccgggaccctacgaacgggtaccttacccgttaagttccgttactccgtacggtcctacggtaagtcgtacggtcttacgtccgggtcccgtcccgtacggtccgtaccctagttcgttaccgtacggtaccctccgggacggtccgtaaggggaccggtaacgnggtccgttagtacggttttagtcgggtaactcggttaacttaagttagtaacgttaacggaacgtcggtaccgtacggtaccccttagttacccgttaaacgggtacgttccggttacccggggggaaggtaacccgggtaaccctaacggggtacctaccccgggttaccgggtacccgtaacggtccccggtaaccgtaaccccggg

SEQ ID NO: 92569 - DNA, 749 bp, Homo sapiens
  misc_feature: GYAE6OF01EKFC4.35.1.A01.1.454.CMB.1.raw
  modified_base (212)..(212): a, c, t, g, unknown or other
  misc_feature (212)..(212): n is a, c, g, or t
  modified_base (231)..(231): a, c, t, g, unknown or other
  misc_feature (231)..(231): n is a, c, g, or t
  modified_base (489)..(489): a, c, t, g, unknown or other
  misc_feature (489)..(489): n is a, c, g, or t
  modified_base (576)..(576): a, c, t, g, unknown or other
  misc_feature (576)..(576): n is a, c, g, or t
tcagtacagatcgtcacgaccggtgctcgatttagacgtctcatcaggggcccagtgctggggtctcaggaggccagcgctcgtgggggacgtctccaccatggcctgggctctgctcctcctcacctctcactcgagggcacaggcttcgttggggcccagtctcgcctgattccacgccctcccgtcgtcgtccgggtctaccgtggacncgtcacgtccactacttcncctgcacgtacgaaccgtgctagtgtacgtggttaaggtaattacgtagtaacgtagtcgttaccgttacgttacggtaaccctaaactcccaaaccaacgtaacccacctaacccgtaacccccaaaactactacgtactaacctactaagttacataacttacgtccgactacgagtacgtaccttaagttccgttacgtcgtacgtcctacgttaagtcgtagccgtaacgtcggtacccggtctccggtaaccnccctattccgtactcgggtaccctacggacgggtaccgaaggggaccggtaacggtaccgttacttaggtaagtttacgtacgggtnttaccgggttaacgttataaggtaactagggtaactcgacggttccctaccgttaacggtttacgtaaccggtttagggaaccggggttcgggaaacggtcccgggttaagaaccgggttacccgtacggtaaacccggttaccggaacggttaaccggcccgtaaaccgggg

SEQ ID NO: 92570 - DNA, 874 bp, Homo sapiens
  misc_feature: GYAE6OF01BF2HY.35.1.A01.1.454.CMB.1.raw
  modified_base (412)..(412): a, c, t, g, unknown or other
  misc_feature (412)..(412): n is a, c, g, or t
  modified_base (700)..(700): a, c, t, g, unknown or other
  misc_feature (700)..(700): n is a, c, g, or t
tcagtacagatcgtcacgaccggtgctcgatttagacgtctcatcagggggcccagtgctggggtctcaggaggcagcgctctggggacgtctccaccatggcctggggctctgctcctcctcacctcctcactcgagggcacaggctcgttcggggcccagtctacgtccctgattccacgcccttccccttccgtcggttcccggggtctccgtggactacgtcagtccaaccattcctccgtgacctacgtacggaaccttcggctaggttaggtagttggggtttaaggggaacttttaacgtaggttaacttattcggttcccgttaccgttagggttaacccctaaacctttcccaaacccccgtaacgaaccaacccgtaaaccccgtaaccccccaaaacccgngttacgaaccttactaacctaaagttacgttactaaacttccggttcccggtacccgttacggaaccgggttaacgtttaccccgtaacgttttccgtttccgttaccggtggttaaccccctacgtaaacggttccggtcgttaaaccgttcggtccgggtacccggttcccctacccggggttcctacccccgtacttacccgttcgggtacccggtaaccctaccggtacgggttaccgtaggggaaccggggtaacgggtccgtattacggtattttaacgggnggtaacgtcgtttaacggtattaacgttaggtaaggactcgtaagtttcccgaaccttacgtttcgaaacgggtttccgaaggggtcccgggggtacggggaaaccgtaacccctaggggtccccgttaacggggacccggtttaaccggtcaaccggggaaccccgtaccggg

SEQ ID NO: 92571 - DNA, 499 bp, Homo sapiens
  misc_feature: GYAE6OF02IZ0CJ.35.1.A01.1.454.CMB.1.raw
  modified_base (363)..(363): a, c, t, g, unknown or other
  misc_feature (363)..(363): n is a, c, g, or t
tcagtacagatcgtcacgaccggtgctcgatttagacgtctcatcagggcctgggctctgctcctcctcacctcctcactcagggcacaggctcttgggcccagtctgccctgattcagcctccctccgtgtccgggtctcctggacagtcagtcaccatctcctgcactggaacctgcagtgatgttgggaattatgactatgtctcctggtaccaacttcacccagacacagtccccaaaccatgatctaacaatgtcaatattcggccctcaggatccctaatcgtttctctggctccaagtctggctatgcgcctccgtgcccatctctggacctccaggctgaggacgaggctgattntggagctgcttatatagaagcagtgccacttcacgttagattcggcgaggaccagctgaccgtctaggtcagcccaggctcgcccctgtcacgtctcgttccccgccttcctcacgacttctcgtactgagtcggg

SEQ ID NO: 92572 - DNA, 607 bp, Homo sapiens
  misc_feature: GYAE6OF02G7I2O.35.1.A01.1.454.CMB.1.raw
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
tcagtacagatcgtcacgaccggtgctcgatttagacgtctcatcagggcctgggctctgctcctcctcacctcctcactcaggcacaggctctggcccagtctgccctgattcagcctcctccgtgtccggtctcctggacagtcagtcaccatctcctgcactggaacctgcagtgatgttgggaattatgactatgtctctgtacaacttcaccagacacacgtaccccaaaaccngtanaatacctaacaaatggtacaaatacttccggacccttcaaggactacctaatccgttttctctcggtctccaagttccgtggctacgttgccggttctccgtagcccctatccttctacggacctcgagcgtgagggaccgagggtctagagtttatgggagctgtacttatatagaagacagtagcgtaacttcgaacgttagtacttcgggtacggacgggaaccaaggccgttaggacccgttaccgtaacgggtccagacccgaaaggccgtaccgccccgtacgggtcctacccgtcgtttccgttcccccgaacccttcccgacgtacccgtatccttacggtactcggtacgtcggg

SEQ ID NO: 92573 - DNA, 485 bp, Homo sapiens
  misc_feature: GYAE6OF02HD7UZ.35.1.A01.1.454.CMB.1.raw
tcagtacagatcgtcacgaccggtgctcgatttagacgtctcatcagggcctgggctctgctcctcctcacctcctcactcagggcacaggctcttgggcccagtctgccctgattcagcctcactccgtgtccgggtctcctggacagtcagtcaccatctcctgcactggaacctgcagtgatgttgggaattatgactatgtctcctggtaccaacttcacccagacacagtccccaaaccatgatctacaatgtcaatattcggccctcaggagtccctaatcgttctctggctccaagtctggctatgcggcctccgtgcccatctctggactccaggctgagacgaggctgatttagtgagctgcttatatagaagcagtgccattcacgttagattcggcggaggacaagctgatcgtctagtcagccaagctcgcccctcggtcactctcgtcccacctcctcaccatctgtctcgg

SEQ ID NO: 92574 - DNA, 501 bp, Homo sapiens
  misc_feature: GYAE6OF02IPB0T.35.1.A01.1.454.CMB.1.raw
  modified_base (272)..(272): a, c, t, g, unknown or other
  misc_feature (272)..(272): n is a, c, g, or t
  modified_base (291)..(291): a, c, t, g, unknown or other
  misc_feature (291)..(291): n is a, c, g, or t
  modified_base (368)..(368): a, c, t, g, unknown or other
  misc_feature (368)..(368): n is a, c, g, or t
  modified_base (458)..(458): a, c, t, g, unknown or other
  misc_feature (458)..(458): n is a, c, g, or t
tcagtacagatcgtcacgaccggtgctcgatttagacgtctcatcagggcctgggctctgctcctcctcacctcctcactcagggcacaggctcttgggcccagtctgccctgattcagcctcctccgtgtccgggtctcctggacagtcagtcaccatctcctgcactggaacctgcagtgatgttgggaattatgactatgtctcctggtaccaacttcacccagacacagtccccaaaccatgatctacaatgtcaatattcggccctnaggatccctaatcgtttcnctggctccaagtctggctatgcggcctccgtgcccatctctgggcctccaggctgacgacgaggctgattattacgngctagctcatactaccaaccagcacgccacttctcgtgttcggcggaggaccagctgaccgtctaggtcacgcccagctcgcccctcgcnctctccgttcccgccctcctcacgctccgcgtcgcggcggtcg

SEQ ID NO: 92575 - DNA, 658 bp, Homo sapiens
  misc_feature: GYAE6OF02JCPGI.35.1.A01.1.454.CMB.1.raw
  modified_base (589)..(589): a, c, t, g, unknown or other
  misc_feature (589)..(589): n is a, c, g, or t
  modified_base (601)..(601): a, c, t, g, unknown or other
  misc_feature (601)..(601): n is a, c, g, or t
tcagtacagatcgtcacgaccggtgctcgatttagacgtctcatcagggcccagtgctggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcaccatctcctgcactggaacctgcagtgatgttggaattatgactatgtctctgtaccaacttcaccagacacacgtccccaaaccatcgactctaacaatcgtactaatacttccggacccttacgaacggtacgttacccccttaaatttccggttttaccttcctacgggtccttaccgtaaacgtttccgtcgggtaccttaagtcggtcccgggccctttccggtcgcccctaagttcctcgtcggtaccttacccgaaggtcccgttagggaaccgggtaaccggtcggtaccgttagtaacgttttaagttcgggaagtcgttcgtactttaataagtaaggacgcgtaacggtcgacctacttacgacggttagnggtttaccgggnggtaaacgggacccaaggtccgtcggtaccccggttacgtacggtccacggtacccg

SEQ ID NO: 92576 - DNA, 614 bp, Homo sapiens
  misc_feature: GYAE6OF02G9QET.35.1.A01.1.454.CMB.1.raw
  modified_base (248)..(248): a, c, t, g, unknown or other
  misc_feature (248)..(248): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcacatctcctgcactggaacctgcagtgatggttggaattangactatgtctcctgtaccaacttcaccagaccacacgtacccccaaaccatcgaactctaacaattgtacaatacttccggccctagacggtacgttaccctaattccgtttctacgtcggtcctaccgaagttcgtaggtcttacgtcggccggtccttcccggtcacccctagttcccgtcgttacgggacctcccggaagggccttggggaacggaccggaggtcttaggaagtttagtggactccgttagtactttaagtaacgtaagaagtcctaaggtccgtacctacgttacgtagtttacgacggtttcgggacgggtaacgaccgaagtccgtagacccgttcggagtccacgcccg

SEQ ID NO: 92577 - DNA, 624 bp, Homo sapiens
  misc_feature: GYAE6OF02H2O3W.35.1.A01.1.454.CMB.1.raw
  modified_base (262)..(262): a, c, t, g, unknown or other
  misc_feature (262)..(262): n is a, c, g, or t
  modified_base (301)..(301): a, c, t, g, unknown or other
  misc_feature (301)..(301): n is a, c, g, or t
  modified_base (578)..(578): a, c, t, g, unknown or other
  misc_feature (578)..(578): n is a, c, g, or t
tcagtacagatcgtcacgaccggtgctcgatttagacgtctcatcagggcccagtgctggggtctcaggaggcagcgctctgggacgtctccaccatggcctgggctctgctcctcctcacctcctcactcaggcacaggctcttggcccagtctgccctgattcagccctccctccgtcgtccgggtctcccgtggacagtcagtcaccatcctcctgacactggaacctgcagtgatggttaggaattatgactatgtcncctggtaccaacttcaccagacacacgtaccccaaaccntcgatacctaacaagtgtacaaattcgttccgaccctagtaacggaaccttccccttaaagtccgttttctcttcggtctacccgtaggtcttcggcttagtcgccggtccttccgcgtccctagtcgtctggtacctccgacggtctaggaacggaccggtagcttagtaagttagtggagtcgtagtactttaagaacgtaggaaacgtcgtagtacgtacctaactttaccggaagttttacggaagtttccggggacggacggttaaacccgngttccgtaacccggtaccgttaccggtacggtaccacgtaacccgg

SEQ ID NO: 92578 - DNA, 519 bp, Homo sapiens
  misc_feature: GYAE6OF02GW2D0.35.1.A01.1.454.CMB.1.raw
  modified_base (273)..(273): a, c, t, g, unknown or other
  misc_feature (273)..(273): n is a, c, g, or t
  modified_base (324)..(324): a, c, t, g, unknown or other
  misc_feature (324)..(324): n is a, c, g, or t
tcagtacagatcgtcacgaccggtgctcgatttagacgtctcatcagggcctgggctctgctcctactcacctcctcactcagggcacaggctcttgggcccagtctgccctgattcagcctccctccgtgtccggtctcctggacagtcagtcaccatctcctgcactggaacctgcagtgatgttgggaattatgactatgtctcctggtaccaacttcacccagacacacgtccccaaaccatgatctacaatgtcaatattcggccctnaggagtccctaatcgtttctctggctccaagtctggctatgcggcctccgngcccatctctggacctcaggctgaggacgagctgattagtggagctgcttatatagagcagtcgccacttacgacgttagacgttcgggacggaggaccaagctgaccgtcgtacggtcacgccaggcgtccgcccctcggtcacgtcctccgttcccaccctcctccacgtctcgtacgtacgtcgagtccggg

SEQ ID NO: 92579 - DNA, 585 bp, Homo sapiens
  misc_feature: GYAE6OF02GR2Z3.35.1.A01.1.454.CMB.1.raw
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcaccatctcctgcactggaacctgcagtgatgttgggaattatgactatgtctctggtaccaacttcacccagaccacacgtaccccaaaacccatacgatcctaacaatcgtacaattattaccggcccttacacggacgttcccctaaattccgtttctctggccttccaagtctggtctatcgcggtccctccgtcgccctatccgtctcggacctccgaggctggaacggtacgagtctgtatttagttggacgtctagtctttaatagtaagaagcgtaagtccgacctacgtttcgaacgttagtacgtttccgggacgggtacggaacctaaggtcctacggaacccgttcgtaagggccaggtaaccccgg

SEQ ID NO: 92580 - DNA, 590 bp, Homo sapiens
  misc_feature: GYAE6OF02JG43F.35.1.A01.1.454.CMB.1.raw
  modified_base (297)..(297): a, c, t, g, unknown or other
  misc_feature (297)..(297): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
  modified_base (346)..(346): a, c, t, g, unknown or other
  misc_feature (346)..(346): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcaccatctcctgcactggaacctgcagtgatgttggaattatgactatgtctcctggtacccaattcacccagacacacgtccccaaaccntgatctacaatgtcaatnttcggccctnaggtactccctaatcgtttcnctggcctcaagtctggctagtcgcgcctccgtgccctattcctctcggacctccgaggtcctggacggacgtacggcttgtaatttagttcgggagtcgttgtacctttaagtaacgtaggaacgtcgtaagtcgaccctacgtttacgacgttacggtacgtttaccggggacgggtaacgggacccaaacggtccgttaaccggtaccccgttaccgtaacgggtcccgaacggtaccccgg

SEQ ID NO: 92581 - DNA, 651 bp, Homo sapiens
  misc_feature: GYAE6OF02JWS1D.35.1.A01.1.454.CMB.1.raw
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcaccatctcctgcactggaacctgcagtgatggttggaattatgactatgtctcctgtaccaacttcaccagaccacacgtacccccaaaccatcgactctaacaatgtacaattacttccggaccctagacggtactaccctaattcgtttctctacggtcctaccgtaagtctaggtctagtcggtccggtccctccggtcgacccctagttcctccgttacgggaccttccggacggtccgtagggaacgggaccggtagggtccttaggtaactttaggtacgggactcgttaggtctttaagtaagtaagtaacgtctacggtcgacccttaagttcgtaacggtttagaaccgggtttaccgggaacgggaaccgggtaacctaacgggtccgttacgggtaaccccgttaccgtagggttacccaccggtaaccccgg

SEQ ID NO: 92582 - DNA, 546 bp, Homo sapiens
  misc_feature: GYAE6OF02HHSH9.35.1.A01.1.454.CMB.1.raw
  modified_base (275)..(275): a, c, t, g, unknown or other
  misc_feature (275)..(275): n is a, c, g, or t
  modified_base (294)..(294): a, c, t, g, unknown or other
  misc_feature (294)..(294): n is a, c, g, or t
tcagtacagatcgtcacgaccggtgctcgatttagacgtctcatcagggcctgggctctgctcctcctcacctcctcactcagggcacaggctcttgggcccagtctgccctgattcagcctccctccgtgtccgggtctcctggacagtcagtcaccatctcctgcactggaacctgcagtgatgttgggaattatgactatgtctcctggtaccaacttcacccagacacacgtaccccaaaccatgatctacaatgtcaatattcggccctnaggatccctaatcgtttcnctggctccagtctggctatgcgcctccgtgccctatctctggactccgaggctgaggacgagctagatttagttggagtcgtgtctttatagtagaagctagtcgacctacttcgagttagtagttcgggcggacggaccaagctacggacccgtcgtagcgacgcccgaaggcctccgcccctcggtccaccgtccgttcccgttcccgcccttccgtccgtaccgtctccgtacgtcctggacggccggg

SEQ ID NO: 92583 - DNA, 496 bp, Homo sapiens
  misc_feature: GYAE6OF02I18XL.35.1.A01.1.454.CMB.1.raw
  modified_base (258)..(258): a, c, t, g, unknown or other
  misc_feature (258)..(258): n is a, c, g, or t
  modified_base (314)..(314): a, c, t, g, unknown or other
  misc_feature (314)..(314): n is a, c, g, or t
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
  modified_base (424)..(425): a, c, t, g, unknown or other
  misc_feature (424)..(425): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctctcactcagggcacaggctcttgggcccagtctgccctgattcagcctccctccgtgtccgggtctcctggacagtcagtcaccatctcctgcactggaacctgcagtgatgttgggaattatgactatgtcntggtaccaacttcacccagacacagtccccaaaccatgatcaacaatctacaaatnttacggcctacaggagtcccctaaatcgtttctctggcctacaagtctgctatcgcgtcctcgtgcccatctctggacctcaggctgnggacnggctanagttatgnctnntanatagangnacagtcactatagtagagtaggtacgaggacgacgacgtcgtacgtcctacgtacgtacg

SEQ ID NO: 92584 - DNA, 523 bp, Homo sapiens
  misc_feature: GYAE6OF02HAZ3B.35.1.A01.1.454.CMB.1.raw
  modified_base (307)..(307): a, c, t, g, unknown or other
  misc_feature (307)..(307): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
tcagtacagatcgtcacgaccggtgctcgatttagacgtctcatcaggggcccagtgctggggtctcaggaggcagcgctctggggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaccacccaggcaaacgcccccaaactcatgattangatgtcagtaatcggccctcgtagggtttctaatcgacttctctgctccaagtctgcaacgacgccctcccgtgacccatccgtcgtcgggcctccgaggtctacgaccgacgaggctgatttatactgacngcctanatatacagcagcagactactctcgtcggttcggacggacgggaccaggctcgaccgtcgtaggtcacgcccgtaacgg

SEQ ID NO: 92585 - DNA, 518 bp, Homo sapiens
  misc_feature: GYAE6OF02FNIQB.35.1.A01.1.454.CMB.1.raw
tcagtacagatcgtcacgaccggtgctcgatttagacgtctcatcgggggcccagtgctggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcaccatctcctgcactggaacctgcagtgatgttgggaattatgactatgtctcctggtaccaacttcaccagacacagtccccaaaccatgatctacaatgtcaatattcggccctcaggagtccctaatcgtttctctggctcaagtctgctatgcgcctcgtgcccatctctggactccaggctggagacgaggcttgattatggagtctgcttatatagaagcagtgccacttcacgttagagtttccgggcggtaacgggaccaaggtcttacgacccgttccgtagggtccacggaccctaacggg

SEQ ID NO: 92586 - DNA, 707 bp, Homo sapiens
  misc_feature: GYAE6OF02GBOOP.35.1.A01.1.454.CMB.1.raw
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccggtctcctggacagtcagtcaccatctcctgcactggaacctgcagtgatgttgggaattagtgacttatgtcttcctggtacccaacttcaacccagaccacacgtaccccaaaccatgactctaacaattgtacaattacttccggaccctgaggtacgttccccttaaattccgtttactcgttcggccttacccgaaagttccgtaggtccttaagtcggacccgggtcccttccggtcgacccctagttcccttccgttagggtaacccttcccggacgggtcctacggaacgggtaaccgagggtccgttaggtaacgttttacggttcggggaacgtccgttacgggttaccttttaagtaaagttacgggtaaaacgtccgtaaagtcggtaccctaacgtttacgaaccggtttaaggtacggtttacccggggaagggtaaccgggtaaccctaaagggtccgttacggtaacccccggttacgttaacgggttaccaccggtaaccccgg

SEQ ID NO: 92587 - DNA, 548 bp, Homo sapiens
  misc_feature: GYAE6OF02G9UPS.35.1.A01.1.454.CMB.1.raw
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcaccatctcctgcactggaacctgcagtgatgttgggaattatgactatgtctcctggtaccaacttcacccagacacacgtcccccaaaacccatcgactctaacaatgtacaatattccggcctcaggactcctaatcgtttctctgctcagtctgctagtcgcggtcctccgtcgccccatcctctcggacctccgaggtctggacggacgaggcttagattagtgggatcgtagtctttagtagtagaacgcgtagtcgcctagtttccgaagtttagacgttcgggcgggaacggtaccaaggtcctacggtacccgtccgtaggtccaggaccccg

SEQ ID NO: 92588 - DNA, 658 bp, Homo sapiens
  misc_feature: GYAE6OF02FXQFZ.35.1.A01.1.454.CMB.1.raw
  modified_base (247)..(247): a, c, t, g, unknown or other
  misc_feature (247)..(247): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccggtctcctggacagtcagtcaccatctcctgcactggaacctgcagtgatgttggaattangactatgtctcctggtaccaacttccacccagaccacacgtacccccaaaccatcgactactaacaatgtacaaattacgttccggacccttacgacggtacgttaccctaaagtttccgtttactccgtcggtcccttaccgtaaggttcctaggtacttagtccggccggtcccttccggtcgcccctattcctcgtcggtacctccgaggtccgtagggaacggacggtacggtccgttaggtaacgttttagtacgggacgtccgttaggttacctttaagttacgtaaggaacgcgtacgtcgtacccttacgtttacgtaacggtttagtacggttaccgggacgggtaaccggtaacgtaacgcgttacggtacccgtacgtacgggtacccacggtaacccgg

SEQ ID NO: 92589 - DNA, 558 bp, Homo sapiens
  misc_feature: GYAE6OF02GT5J6.35.1.A01.1.454.CMB.1.raw
  modified_base (375)..(375): a, c, t, g, unknown or other
  misc_feature (375)..(375): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcaccatctcctgcactggaaccagcagtgacgttggtggttataactatgtctcctggtaccaacaccacccaggccaaacgcccccaaactcatgatttatgatgtcagtaatcggccctgtaggggtttactatcgcttctctggtctcagtctgcactcgcctccngacatctcgtgggtccgtccgggctggacgggacggacggtcgtagtatttagtttagtttggttgccttagattagtcgtactagggtagtagactaacttagtcgtcgttacggacgtgggaaccgtaacggtcctaccgtccgtacgcgacgacccgacgaccccaaccctcgtgtaccc

SEQ ID NO: 92590 - DNA, 619 bp, Homo sapiens
  misc_feature: GYAE6OF02GVHFV.35.1.A01.1.454.CMB.1.raw
  modified_base (355)..(355): a, c, t, g, unknown or other
  misc_feature (355)..(355): n is a, c, g, or t
  modified_base (457)..(457): a, c, t, g, unknown or other
  misc_feature (457)..(457): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcaccatctcctgcactggaacctgcagtgatggttaggattatgatatgtctcctgtaccctaacttcaacccagaccacacgtacccccaaaccatcgactctacaatgtacaattacgtcgccctgaggtactccctaatcgtttcngtcgctacagtctgctagtcgccgtcctccgtcgccctagtcctcgtcggtacctcgagggtctaggacggtacgacggtcgtagtaatttaggttcggganccgttgtacctttaagtactaacggaacgtccgtaaaggttccgacccttacgtttaccgaacggtttaggtacggttacccggggacggggtaaccgggtaaccctaggtacccgttacggtacccggttacccggttaggtcccgaccggtaacccccgg

SEQ ID NO: 92591 - DNA, 670 bp, Homo sapiens
  misc_feature: GYAE6OF02ISLKJ.35.1.A01.1.454.CMB.1.raw
  modified_base (296)..(296): a, c, t, g, unknown or other
  misc_feature (296)..(296): n is a, c, g, or t
tcagtacagatcgtcacgaccggtgctcgatttagacgtctcatcaggggcccagtgctggggtctcaggaggcagcgctctgggggacgtctccaccatggcctgggctctgctcctcctcacctcctcactcagggcacaggctcttgggcccagtctgccctgattcagcctccctccgtgtccgggtctcctggacagtcagtcaccatctctgcactggacctgcagtgattgtaggaattatgactatgtctctggtacctactcaccagacacgacgtaccccaaaccntacgactactaacaactacgtactaacttacgttccggaccctacgtaacggtaccgtttacccttaaagtttcccggtttaactccgttacggtcctaccgtaagtccgtaggtcctagtccggccgtccctcgtccgtacccagttcctcgtacggtacctaccgtaggaccgttagggacggaaccgtcgggtcctaaggttacgttagttcgggacgtacgttcgtactttagttaacgtacggaagtcgtaaacggtccgtaccttacgttacgtaacggtttacgaacggtttcggggaccgggttaaggaacccgttaggacccgttcggtaacccggttactacgggttacgaacccggtacccgg

SEQ ID NO: 92592 - DNA, 551 bp, Homo sapiens
  misc_feature: GYAE6OF02GELID.35.1.A01.1.454.CMB.1.raw
  modified_base (248)..(248): a, c, t, g, unknown or other
  misc_feature (248)..(248): n is a, c, g, or t
  modified_base (361)..(361): a, c, t, g, unknown or other
  misc_feature (361)..(361): n is a, c, g, or t
  modified_base (486)..(486): a, c, t, g, unknown or other
  misc_feature (486)..(486): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctcgtgtccgggtctcctggacagtcagtcaccatctcctgcactggaacctgcagtgatggttaggaattntgactatgtctcctggtaaccaacttccacccagaccacacgtacccccaaaccatgactctaacaatgtacaattcttccggccctagacggtacttccctaattcgtttcncgtcggcctacgagtctggactagtcgccgtcctccgtcgcccattcctcgtcggacctcgaggctaggacggacgaggtcttgtatttagtaggactcgtgtactttatagtagagtcaggtcncctattcgagttagacgtcggacggaacgacaagccgtacgaccgtacgtaggtccacgtacccg

SEQ ID NO: 92593 - DNA, 866 bp, Homo sapiens
  misc_feature: GYAE6OF02IQOPL.35.1.A01.1.454.CMB.1.raw
  modified_base (197)..(197): a, c, t, g, unknown or other
  misc_feature (197)..(197): n is a, c, g, or t
tcagtacagatcgtcacgaccggtgctcgatttagacgtctcatcagggcctgggctctgctcctcctcacctcctcactcagggcacaggctcttgggcccagtctgccctgattcagccctcctccgtgtccgggtctcctggacagtcagtcaccatctcctgcactggaacctgcagtgatgttgggaattangactatgtctcctggtaccaacttcaccagacacacgtccccaaaccatgatcctaacaatgtacaaatacttccggcctacgaaggtacttaccccttaaagttccgttttacctccgttcgggtaccttacccgtaaacggtttcctacgggtacctttaagtccggtacccgggttccccgttacccggttcggacccccttagttcccgttaccgttacgggtaaccccttcccggaacgggtccgttacgggtaaacggggaacccgaagggtcccttaaggttaaccgttttaagtttcggggaacggtcccgtttagggtaacctttaagttaaacgttaaacgggtaaacgtcgtaaaggttccgaacccggttaactttacccggtaaacggtttaaggaacgtttccggggacgggtaacgggaacccgtaaacggtccgtaccgggtaaccccggttaccgttaacgggttaccgaacggtacccccgttaaagggtccccttacccgggttaccccccggttaccgggtttacccgtaaccccgtttcccggtttaccccggttttaccccccggaaccccgtttccccgttaccggtaacccgttaacctttacccggtaccgttaacccggtttacggacccgggttaccggggg

SEQ ID NO: 92594 - DNA, 682 bp, Homo sapiens
  misc_feature: GYAE6OF02H0E0S.35.1.A01.1.454.CMB.1.raw
  modified_base (497)..(497): a, c, t, g, unknown or other
  misc_feature (497)..(497): n is a, c, g, or t
  modified_base (544)..(544): a, c, t, g, unknown or other
  misc_feature (544)..(544): n is a, c, g, or t
  modified_base (567)..(567): a, c, t, g, unknown or other
  misc_feature (567)..(567): n is a, c, g, or t
tcagtacagatcgtcacgaccggtgctcgatttagacgtctcatcaggggcccagtgctggggtctcgaggaggcagcgctcgtggggacgtctccaccatcggcctgggctctgctcctcctcacctcctcactcacgggcacgaggcctcgttcgggccctagtcctcgccctgtacttcacgtccctccctccgtcggtcccgggtctcccgtaggactaggtcagtccacctatccttcctgcctacgtacggaacctgaccgtagtgtacgttggttacgggtaattagtagtaactagtcgttacctcgtacggtaaccctaaccttccaacctacgaaccaacctaaccgtaacccccaaaacctatacgtactaaccaactaactagtaacaacttaccgtccgaccctagaacggtacctacttaacgtccgttctcgtcgtactaccgtacgttcgtacgctgtcgccgtactcgcctcctacgtcncgtacgtccacgtacggctaggacggtcggtggtctagttacttaancgttgacgactcgtctattccgngaccgtagccaacggttaccgtaacgtttcggttaacgggtccggtaaccgggaaggtaaccgttaacggttgttaccccgtaagaccggttaccgaacgccccggtagtccccg

SEQ ID NO: 92595 - DNA, 913 bp, Homo sapiens
  misc_feature: GYAE6OF02JWX1S.35.1.A01.1.454.CMB.1.raw
tcagtacagatcgtcacgaccggtgctcgatttagacgtctcatcaggggcccagtgctggggtctcaggaggcagcgctctggggacgtctccaccatggcctgggctctgctcctctcacctcctcactcagggcacaggctcgttgggcccagtctcgccctgattcagcctccctccgtgtccgggtctccgtggacagtcagtcaccatctcctgcactcggaacctggacagtgactggtagggtattagtagtactagtgttcctccgtacggtaaccctacgttaccaccgaacgtacaccgtaacccgtaccccctaaaaccgtatacggtacttaacctaactaacgttacgtactaaaacgtttccgttacccggacccttacggtaaacggttacccgttaacccgtttaacgtttccggttttcctacgtttccgggtaccccttaacggttaaaccggtttcccgtagggaccctttaagggtccggtaaccccgggtacccgtttcccgggtacctaccccggtaacttttcccggtaccgtacgggtaacccttaccggggtaacccggttcgaaaggggtacccgggttaaacggaccgggtttacccgttaggggtttaaccttttacgggacgggtttaaccgttccgttaaaccggttacgtttaaggttaaaccgtaacggttaaaccggaccgtttaaacggttcccggtaccccgttacgtttttaacccgaaccggggttttacgtaaccgggttttaacccggggggaccgggttaaaccgggggaaaccctttaaccggggggtttccctttaacccgggggttaaccccggttttaaacccggtacccggggttaaacccggttacccggttaaaacccccggggg

SEQ ID NO: 92596 - DNA, 663 bp, Homo sapiens
  misc_feature: GYAE6OF02JB1K5.35.1.A01.1.454.CMB.1.raw
  modified_base (227)..(227): a, c, t, g, unknown or other
  misc_feature (227)..(227): n is a, c, g, or t
tcagtacagatcgtcacgaccggtgctcgatttagacgtctcatcaggggcccagtgctggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcacatctcctgcactgaaccngcagtgacgttggtgctgataacgtatgtctccgtcggtaccaacaccacccaggacaacgacccccaaactcatagtatttactgatgtacagtaacgtccggtaccctacgtacgggtttactaacgtccgtcttctcgttcgtacctaccgtaacgtctcggaccaaccgaccggtccctccccgtacgaccctacgttccgttacggtccgggtcctaccgacggtccgtacggtaaccggaacggtaggtccgttagttacgtttaacttaccgtgacgtacgtcttaacgagttaactaacgaacggtactaacggcaacgtaccgtacctttccgtacgggtttcggttacccggggacgggtaacgggtaacccgtacggtaccggttaccggtaccccgttacccggttacggaccctaacccgggg

SEQ ID NO: 92597 - DNA, 731 bp, Homo sapiens
  misc_feature: GYAE6OF02HPC88.35.1.A01.1.454.CMB.1.raw
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
tcagtacagatcgtcacgaccggtgctcgatttagacgtctcatcagggcctgggctctgctcctcctcacctcctcactcagggcacaggctcttgggcccagtctgccctgattcagcctccctccgtgtccgggtctcctggacagtcagtcaccatctcctgcactggaaccagcagtgacgttggtgctgataactatgtctctgtaccaacaccaccagcaaacgccccaaactcatgtattatgatntanagtaatcggcctcgtaggggtttactaagtcgtcttactctcggtactaccgtaacgtcgtacggacctaaaccaccgggtccctacccgtcgacctaactcctcgttcggggcctccgtaaggacgttacggaaccgggaacgggtaacgggtccttaacggtaacttttaaccgtttaaacgtcggtaccgtacggtccttaacctaaattaacttaaacgaaacgtaacaggaccgtaacgacctaccttccgttccgggttaggtttccggggaacggggtaccgggaaacccgaacgtaccgtaccgtaccccggtaccgtacggtaccaacggtaccccgaaacggtccgtcccgtacccccgtaccggttaccgtacccgttcgttcccggttcccccgcccccgtttccctaaccgtaacccgtaccgttccttaacgggttaaccgtcggtacgggtacccgggg

SEQ ID NO: 92598 - DNA, 745 bp, Homo sapiens
  misc_feature: GYAE6OF02IB9ZJ.35.1.A01.1.454.CMB.1.raw
tcagtacagatcgtcacgaccggtgctcgatttagacgtctcatcaggggcccagtgctggggtctcaggaggcagcgctctcgggacgtctccaccatggcctgggctctgctattcctcaccctcctcactcagggcacagggtcctgggcccagtctgccctgactcagcctgccttccgtgtctgggtcctcctggacagtcgatccaccatcctcctgcacgtggaaccagcagtgacgttggtggttataactatgtctcctggtaccaacacccacccgaggaccaacgacccccaaactcatgtatttatgatcgtacagtaacgtccggtcccctgtacggggttttactaacgtccgtctttctcgtcgggtcctaccgtaacgttccgtacggtaaccaaccgtacccgggtcccttcccgtacgtaccctacgttcccgttcggtcgggtaccctaccgtacgggtacgttacgggaaccggtaacgggaccggttaccggttagttaacgttttaaccttaaccgtcggtaccgtacggtaccttaaccgaactttaaccgttaaacgaaccggtacctaacggaccgtaacgtacctaccgttccgttaccgggtttccgggttaccggggaacccggggttaacggggaaaccccgtaacggtaccggttaccgggtaccccggttacccggttaaccgggtaccgtacccggaccccggtaacccgggg

SEQ ID NO: 92599 - DNA, 660 bp, Homo sapiens
  misc_feature: GYAE6OF02F70UD.35.1.A01.1.454.CMB.1.raw
  modified_base (249)..(249): a, c, t, g, unknown or other
  misc_feature (249)..(249): n is a, c, g, or t
  modified_base (302)..(302): a, c, t, g, unknown or other
  misc_feature (302)..(302): n is a, c, g, or t
  modified_base (442)..(442): a, c, t, g, unknown or other
  misc_feature (442)..(442): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcaccatctcctgcactggaacctgcagtgatggttggaattangactatgtctcctggtaccaacttccaccagaccacacgtacccccaaaaccntacgactacctaacaagtcgtacaattacgttccggccctagacggtaccgtacccttaagtttccgtttcctcgttacggaccttaccgtaaaggttcctacgggtacttagtccggacccgggtcccttcccggtacncccctattcccgtcgtcggtacctccggaggtccgtaggacgggacgtaggtcgtagtactttaggtgggacgttctcggtactttaagtaacgtaaggaactcgtagtccgtaccctaacgtttacgtaacggttaggtcggttacccggggacgggtaacggtacccgaggtcccgttacgggacccgttacgtagggtcccaccggtaaccccgg

SEQ ID NO: 92600 - DNA, 639 bp, Homo sapiens
  misc_feature: GYAE6OF02HPWWJ.35.1.A01.1.454.CMB.1.raw
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
  modified_base (434)..(434): a, c, t, g, unknown or other
  misc_feature (434)..(434): n is a, c, g, or t
tcagtacagatcgtcacgaccggtgctcgatttagacgtctcatcagggcctgggctctgctcctcctcacctcctcactcagggcacaggctcttgggcccagtctgccctgattcagcctccctccgtgtccgggtctcctggacagtcagtcaccatctcctgcacgtggaacctgcagtgatgttagggaattatgactatgtctcctggtaaccaacttcaccagaccacactaccccaaaccntgactctanaatgtacaatacgttccgacctacgacggtactaccctaattccgtttcctcgtcggacctaccgaagtcgtaggtctatcggcgtccccgtcgacgtcccatccgtcgtcgactccgagtctggacggtcgacgtctagtacttagtggactcgtagtacttaatagtaacgaancgtaacgtcgacctagttacgaacgttacgcgttacggggacggtaacggaacctacgtcgtaccgaccgttaccgtagacgtaccggacctaaggtcccgtccgccccgtacggtcctaccggtcccttcccggttacccccgccgttacccgtaacgaccgttaccgtcccgttaacggtacccgttaggaccggtacccggg

SEQ ID NO: 92601 - DNA, 583 bp, Homo sapiens
  misc_feature: GYAE6OF02IKTI5.35.1.A01.1.454.CMB.1.raw
  modified_base (320)..(320): a, c, t, g, unknown or other
  misc_feature (320)..(320): n is a, c, g, or t
  modified_base (335)..(335): a, c, t, g, unknown or other
  misc_feature (335)..(335): n is a, c, g, or t
  modified_base (376)..(376): a, c, t, g, unknown or other
  misc_feature (376)..(376): n is a, c, g, or t
  modified_base (383)..(383): a, c, t, g, unknown or other
  misc_feature (383)..(383): n is a, c, g, or t
  modified_base (454)..(454): a, c, t, g, unknown or other
  misc_feature (454)..(454): n is a, c, g, or t
  modified_base (475)..(475): a, c, t, g, unknown or other
  misc_feature (475)..(475): n is a, c, g, or t
  modified_base (484)..(484): a, c, t, g, unknown or other
  misc_feature (484)..(484): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcaggcacaggctcttgggcccagtctgccctgattcagcctccctcgtgtccggtctcctggacagtcagtcaccatctcctgcactggaacctgcagtgattggttagggaatttatgtaacttagtcgtccttccgtacggtaaccctaacttccaacccagaccaccacgtacccccaaaacctntcgactactacaatntacatctcgcctgagactcctatcgttctgtgctacgtatntcgctancgccggtcctccgcgcccattcctcgtacgctccgaggtctaggacggtacgagtcttaggtatttacggnggacgtcgttagtactttaanagtaagacncgtagtccgaccttacgttccgtaggtttagcggttaccgggacgggtaacggaccctaagccgttacggacccgttccggtagtaccgtaccgaccgg

SEQ ID NO: 92602 - DNA, 793 bp, Homo sapiens
  misc_feature: GYAE6OF02HB3M4.35.1.A01.1.454.CMB.1.raw
  modified_base (248)..(248): a, c, t, g, unknown or other
  misc_feature (248)..(248): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcagggcacaggctcttgggcccagtctgccctgattcagcctccctccgtgtccggtctcctggacagtcagtccaccatctcctgcactggacctgcagtgatggttggaattangactatgtctcctggtacctaacttcaccctagaccactacgtaccccaaacccagtacgactacctaacaattcgtacaattacgttccggacccttacgaggtaccgttacccgttaaatttccgttttctaccgttacggccttaccgtaagttccgtagggtaccttaagttcgggtcccggtcccgttacccggtccggtacccctacgttcccgtacccgttacgggtaaccttcccgaacgggtcccgttagggaaccgggaaccgggttacgggtccttaaggtaacgttttacggtgggggttaacctcgtttcgggttaacttttaacgttaaacggttaacggaaccgttacggttaacggttacccggttacccttaacccggttttccgtaaaccgggttttacggtaaaccgggttttacccgggggaccgggggtaaaccggggttaaccccaaagggtttcccggttaaccgggtaaccccccgggtttacgttaaccggggttacccggtaacccgtaacccccgggg

SEQ ID NO: 92603 - DNA, 633 bp, Homo sapiens
  misc_feature: GYAE6OF02IWT9N.35.1.A01.1.454.CMB.1.raw
  modified_base (298)..(298): a, c, t, g, unknown or other
  misc_feature (298)..(298): n is a, c, g, or t
  modified_base (419)..(419): a, c, t, g, unknown or other
  misc_feature (419)..(419): n is a, c, g, or t
  modified_base (456)..(456): a, c, t, g, unknown or other
  misc_feature (456)..(456): n is a, c, g, or t
tcagtacagatcgtcacgaccggtgctcgatttagacgtctcatcaggggcccagtgctggggtctcaggaggcagcgctctggggacgtctccacatggcctgggctctgctcctcctcacctctcactcagggcacaggctcttgggcccagtctgccctgattcagcctccctccgtgtccgggtctcctggacagtcagtcaccatctcctgcactggaacctgcagtgatgttaggaattatgactagtgtctctggtaccacttaccacctagacacacgtaccccaaaccngtgactctacatcgtacaattactcggcctacaggacttacccgtaatccgtttactcgtgtctaccaagttctggtactacgtcggccgtccttccgtacgccctatcttcgtacgtacnccggtagcgtacgaggaacgcgtcgtagtatttaggnggtcgttacttacgttaataagtaagtacgtactacgggttacgttacctaaccggtttacaacgggtttaacggtacggtttaccggggaacggggtaaacgggtaaccctaagggttcccgttaacggtacccgggttacctaacgggtcctaaccgggtaccccgtaaccgggg

SEQ ID NO: 92604 - DNA, 725 bp, Homo sapiens
  misc_feature: GYAE6OF02HJL9F.35.1.A01.1.454.CMB.1.raw
  modified_base (233)..(233): a, c, t, g, unknown or other
  misc_feature (233)..(233): n is a, c, g, or t
tcagtacagatcgtcacgaccggtgctcgatttagacgtctcatcaggggcccagtgctggggtctcaggaggcagcgctctggggacgtctccaccatggcctgggctctgctattcctcaccctctcactcagggcacagggtcctgggcccagtctcgccctgactcagcctgcctccgtgtctgggtcctctggacagtcgatcaccatctcctgcacgtacggaaccngcctagtggtacggtttggtggttaactaactagtcgtcctccgtacggtaacccaaaccaccccaacccacgggaaccaaaccgaccccccaaacttaccaacgttagtaactttagtacgtaagttcgtaaccgtagtaacgtcccggtcccgttacggttaacgggtttactaactcgttaccttcgtccgtggtacctaccgtagtccgtaggaccctaacggcccgtaccctcccgtacgtacctacgttctccggtcggaccctcgtaccggtctaccggaacgtacggacggttacgtagttaacttactagtacgactacgtcctacgtaattacgaaacgtagcctaacaccgagtacctaccgtttccggtacgttccggggtccggaacccggggtaacggtaaacccgtaggttacccggttaccggtaaccccggttacggttaaccggtaaccgacccgggtaacccgtaccccgggg

SEQ ID NO: 92605 - DNA, 709 bp, Homo sapiens
  misc_feature: GYAE6OF02G8606.35.1.A01.1.454.CMB.1.raw
  modified_base (200)..(200): a, c, t, g, unknown or other
  misc_feature (200)..(200): n is a, c, g, or t
  modified_base (504)..(504): a, c, t, g, unknown or other
  misc_feature (504)..(504): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctctcactcaggcacagctcgtgggcccagtctgccctgattcagccctccctccgtggtccggtctccgtaggacngtcagtccacactctccgtgacctacgcggaacctgaccgtaggtagtagtcgggttaagggtaaactttgtactacttatcgttccgtccgttacggtaaccctaacttcccgaacccaacgtaccaacccgtaaccgaccccctaaaaccatcattaccaactaacggtctaactaaagttacctccccggtcctacgtaacgggtaccttacccttaatttccgttccttacgcggtaccctacgtaacgtcgtcgtactacggttcgcccggtaccgttccgttcgtcccctacgtttcnccggtaccgaacgtcccgaaggtccgtacggaacggtaccgggagttcgttaaggagttttaggccgggtatcggttacttagttaaactagtacgagtcgagtcccgtacgtacgtttaccagggttaccgtaggtccgggtaaacggaccggaactagggtccctacggtaaccgttcgggactaccggaacgttacccccgg

SEQ ID NO: 92606 - DNA, 847 bp, Homo sapiens
  misc_feature: GYAE6OF02HXSZG.35.1.A01.1.454.CMB.1.raw
tcagtacagatcgtcacgaccggtgctcgatttagacgtctcatcagggcctgggctccactacttctcaccctcctcgctcactgcacaggttcttgggccagtttcacgctgactcacgccccactctgtgtcggagtcgtaccgggaaagacggttaccatctcctgccacccgcagcaggtggacagactaacttaccgtccggtctagttcggtgacgtaggttcggtaaccaggcacggccgggcccgggtaccttcccccgttacccccaccgtacccgtactaccgttaccggtaacggaaacgtaacctaaacgttaaaaaccggtccccgttacgggttacggggtttccctaggtaacgtttccgggtttctaccggttcggtaccctacccgtagttcccggaccttaccggttcccttaccttaacgttccgtaccgtcccccgtttaaacctaacccgtacgttcccttacggtaaccggttaactaacggaacggttaacgtacgggaacgggaacggtacgtacgttacctaaacgttaccttagtacgttccgtagtttttccgggttaaggacggtaccgtaagtcgttacgggtgggtttacggggttcgggaccgggggtaccggggtaacgacgtcgtaccggtacccgtacgtaacgtccgacggtaccgaacgggtcctacccggtcccgtacgttccgtaacgttcccgttacccgtcccgtcccgtacccgttaccacgttaccgttcggttccgtaccgggttacgggtcccgggaacgtcccgggcggtaacgggtaaccggcccgtagtaggccgtagg

SEQ ID NO: 92607 - DNA, 884 bp, Homo sapiens
  misc_feature: GYAE6OF02HNO89.35.1.A01.1.454.CMB.1.raw
  modified_base (275)..(275): a, c, t, g, unknown or other
  misc_feature (275)..(275): n is a, c, g, or t
tcagtacagatcgtcacgaccggtgctcgatttagacgtctcatcaggggcccagtgctggggtctcaggaggcagcgctctggggacgtctccaccatggcctgggctctgctcctcctcacctcctcactcgaggcacaggctacgttcgggccagtctgccctgacttcgagccctcctccggtcgtccgggtcttccgtggacagtcacgtcaccattccgtcctcgctacgtacggtaacctgacaagttgagttaggttaggtaattangtaacgttagttgtccttcgtacggttaaccctaacgttccaaccgaagaccgaacctaacccggtaacccccaaaaacctagtactaacttaaccgttaacaagttacgtaactaaacgtttacgtccccgaaccttacgaacgggtaaccttacccttaagttccgtttactcgtacggacctaacgtacgttcgtacggttacctagtccggtccggtacccttaccggtccctaaccctcttaccgttaccggtacggtaaacccgtttccgggaaacgggttccgtaacggggaaccggttaaaccgggtacgtaccggtttaagtaacggtttttaacggcggggttacgttaccgttttaacgtaacggtttaaaaccgtagtttaaacgggaacgttaacccgtttaacggtaaccccgttaaccttcgggtttaaacccgtttaacgggggtttaaccgtttaacccggggttaaccggggggaaccggttaaaaccccgggggttaacgaacccggggttacccggtttaaacccggggttaccccggttttaaccgggtaaaccccgtttaacccgggaccccggttaaaccccgggg

SEQ ID NO: 92608 - DNA, 782 bp, Homo sapiens
  misc_feature: GYAE6OF02JJGW8.35.1.A01.1.454.CMB.1.raw
tcagtacagatcgtcacgaccggtgctcgatttagacgtctcatcaggggcccagtgctggggtctcaggaggcagcgctctgggggacgtctccaccatggcctgggctctgctcctcctcacctcctcactcgagggcacaggctcgttcgggcccagtctcgcctgattcacgccctcccctcgtcggtccggtctccgtaggtacagtcacgtccactatcctcctgccacgtacggacctgcagtgagttggtaggtaacttagtacggtaacttactcgttccctaccgttacgtaaccctaaaccttccaacccgtaacgaaccctaccgaacccgttaacccccaaaccgtactacgtaactaccgtaactaactacgtaactaacgttaccgttaccggtaccctacgtaacgggttacccttacccttaacgtttaccgtttcgtaccgtacggtaaccctacggttaaacgttcgtacgtacgttacggtcgcccgttaccgttcccggtcctacccgttaatcccgttacgtccggtaacctccggagtccggaaggtacgggaccggtagtctaaggttacttacggtcggaacttcgtaacgttacgttaaatggtaaacggtcgttaccggtaataccggtaccttaccgtaacggttaaccgttacgggtccggtttaaccgggggaacggaacccgggtaacgtacccggttaccgtaaccggtaccccggttaaggtacccggtaccggaccccgtaacccggg

SEQ ID NO: 92609 - DNA, 781 bp, Homo sapiens
  misc_feature: GYAE6OF02GFY7K.35.1.A01.1.454.CMB.1.raw
tcagtacagatcgtcacgaccggtgctcgatttagacgtctcatcaggggcccagtgctggggtctcaggaggcagcgctctggggacgtctccaccatggcctgggctctgctcctcctcacctcctcactcgagggcacgaggctcgtcggcccagtctcgccctagacttccgacgtccctcccgtccggtcggtcccgggttcctccgtaggacctacggtcgacttaccacctactccgtccgtgcctaacgtacggaaccagccgtagtcgtacggttggtacgtcgtagtaacttaacgttacgttccgtccgttaccgtaccgtaaacccaaccgaacccgaacccggtaacggaaccctaaaaccccgacccctaaactcgtaacgttacgttaagttacgtagtacgttacgtaaccgtaacgttaaccggtccccggtaccgttacggtttaacggttactaccgtcgttacttccgtcgtacgtacgtacgtacgtcgtacgaaccgtaccgtcccgtacctaccgtacgtacctcgtccgtcggtcgtaccgtccggtacgtcgacggacgtacgttcgtacttacgttacgttacgtcgtcgtaccttacgtacttaacgtaacgtaacgtacgacgacgtaccgaccgtacgttaccttacggtaccggttacgggtcggggaaccgggtaccggtaaccgaccggttaccggtacccgttaacccgggtacccgttacggtaacccggtacccggaccgaacccg

SEQ ID NO: 92610 - DNA, 671 bp, Homo sapiens
  misc_feature: GYAE6OF02FORK1.35.1.A01.1.454.CMB.1.raw
  modified_base (200)..(200): a, c, t, g, unknown or other
  misc_feature (200)..(200): n is a, c, g, or t
  modified_base (378)..(378): a, c, t, g, unknown or other
  misc_feature (378)..(378): n is a, c, g, or t
tcagtacagatcgtcacgaccggtgctcgatttagacgtctcatcagggcctgggctctgctcctcctcacctcctcactcagggcacaggctcttgggcccagtctgccctgattcagcctccctcgtcgtccggtctcctggacagtcagtcaccatctcctgcactggaacctgcagtgatcggttaggaatttagngtactatcgtaccttctaggtacctaacttccaccagacaccactacccccgaactgtacactctaactagttcgaactaattcgtccggccctagtaacggtccttacccttaagtttccgtttcgtacgtcggtcctccgtaagtctggtctagtcgtcgtcctcgtacgaccctntccttcgtcggacctaccgtggtcgtacggacggacgtacgtcgttagtacgttagtcggagtcttagtacgttataagtaggtaacgtcgtacgtcgacctacgttacgtacggttgtaacgtcggaacggtacggacgacgtcgttaacggccgttacgtacgtcgacccgtacaaccggtccgtacccgcccggttacggcctaccggttcccgttccccggttaccccgtccccgtaccgttacccgacgtttccgtaccgttacggtaccggttggcccggttacggg

SEQ ID NO: 92611 - DNA, 896 bp, Homo sapiens
  misc_feature: GYAE6OF02GYNNJ.35.1.A01.1.454.CMB.1.raw
  modified_base (125)..(125): a, c, t, g, unknown or other
  misc_feature (125)..(125): n is a, c, g, or t
  modified_base (223)..(223): a, c, t, g, unknown or other
  misc_feature (223)..(223): n is a, c, g, or t
  modified_base (230)..(230): a, c, t, g, unknown or other
  misc_feature (230)..(230): n is a, c, g, or t
  modified_base (238)..(238): a, c, t, g, unknown or other
  misc_feature (238)..(238): n is a, c, g, or t
tcagtacagatcgtcacgaccggtgctcgatttagacgtctcatcagggcccagtgctggggtctcaggaggcagcgctctggggacgtctccaccatggcctgggctctgctgctcctcactcncctcactcaggacacagggtctggcacagtctcgcctgactcagtcctagcctccgtgtcgtgggtctccgtggacgagtcgatacaccatctaccgngcctacncggaaccngtcagtcgagttggttgggggttactcgtaccgtttagttccgttaccgtaggttaactaccgaaaccgtacgacccgaaccccggaaggggtaaaccaaaaccccggtacccccccaaaactttacccgtaaacgtttacgttaaggtttttaaacgttcggtaacgtttacggttaaaccgtaaacggttttaaaccggttaccccgggttaccccggttttaaacccgggtttaacggggtttttaaccgttaacgtttacccggtttaaccgttttttcggttaccggtttccggtaaacccgtttaacccgggaaaccggttttacgtaacccggaaccccgttaaaacccgttaaccccggggtacccccttaaccccggttaacgggtaaaacccttccggtttaccggtaacccgggttaccggggaccccgtttaacccgggaaccgtaacgggtacgtaacccgggtagggtacccggtaagtaccgttttaacgttacttaacgtcgaaccgtgtaccgttacaaacggttcctaaaaccgaccgtagaccctagttacctcgttaaccgttccgggtaaggttccgggaaccgggtaccggtaacccaacgggtacccgttaccgtacccgggttacggtaaccgg

SEQ ID NO: 92612 - DNA, 728 bp, Homo sapiens
  misc_feature: GYAE6OF02GBF9B.35.1.A01.1.454.CMB.1.raw
  modified_base (174)..(174): a, c, t, g, unknown or other
  misc_feature (174)..(174): n is a, c, g, or t
  modified_base (187)..(187): a, c, t, g, unknown or other
  misc_feature (187)..(187): n is a, c, g, or t
  modified_base (276)..(276): a, c, t, g, unknown or other
  misc_feature (276)..(276): n is a, c, g, or t
  modified_base (348)..(348): a, c, t, g, unknown or other
  misc_feature (348)..(348): n is a, c, g, or t
tcagtacagatcgtcacgaccggtgctcgatttagacgtctcatcagggcctgggctctgctcctcctcacctcctcactcaggcacaggctcgttggcccagtctgccctgactcagcctgcctcgtgtctggtctcctggacagtcgatcaccatcctctgcacgtgaaccngcagtgacgttgngctagataactagtcgtctccgtaggtacccaaacaccacccgtaggaccaaaaccgcccccctaaaactcgaagttgtaacttttacnggactgtacaagttaacgccggtccctacggtacgggtttacctaagtcgtcttctcgtcgctaccgatcgngaccaaccgccgtcctccgtacgactactcctacgcggtacctaccgaggtcctaggaccgtaacgacggtccgttaggaacttttacgtaccgttagacctacgtccgtaactaagttaaacctacgtaacgtacgtaacgcccgtaagcccttaacccgttcgggttacccgggttcggtccggggtaaccgggacggttaaccgaaacggtcccgtaccggtaccggttaccgtacgggtaccctaacggaaccgtaacgcccgttaccccgtcccggttaacccggcctttaccggttaccccgttcccgggtttccccctaccggttacccaccggttaccgtaccctttaccgggttaccgacgttacccgggg

SEQ ID NO: 92613 - DNA, 721 bp, Homo sapiens
  misc_feature: GYAE6OF02JM7OL.35.1.A01.1.454.CMB.1.raw
  modified_base (673)..(673): a, c, t, g, unknown or other
  misc_feature (673)..(673): n is a, c, g, or t
tcagtacagatcgtcacgaccggtgctcgatttagacgtctcatcagggcctgggctctgctcctctcacctcctcactcagggcacaggctcttgggcccagtctgccctgattcgagcctccctccgtgtccgggtctcctaggacagtcagtcaccatctccgtgcactggaacctgctagtcgtagttggtttacgggaatttatacgacttagtcgttcctccgttacgggttaaccccaacgtttccaaccccgtaagaaaccccgtccgtaacctaccccccgaaaaaccttgtaccgtaacttaccttaaacgaattaccgttaactaaactaggtttcccggacccttacgacggtaacgtaacccctttaagttccgtttacgtctacggtccctacgtaacgttcgcgtctagtccggaccggtcctccggttacgcctctcgtacgtcgtacctccgaagtcgtacgggtaacgcgacgacgttgaagtttcgagcgtgtcgtacgtatacgtaacgagacgtgtaccgacttacgttaaccgtaggttacgtacggtccggtaagggtaccgacgtacgtcgtaccgtacccgtacgtaccgtcgtaccgtaacggtacgtacccgtcgtcccgtacgctaccgtccgttccggtccccnccgtaccgtcctacggtactcgttaccggtacgtacgtccggtaccgg

SEQ ID NO: 92614 - DNA, 199 bp, Homo sapiens
  misc_feature: GYAE6OF01A3QXV.18.78.H01.1.454.CMB.1.raw
  modified_base (174)..(199): a, c, t, g, unknown or other
  misc_feature (174)..(199): n is a, c, g, or t
tcagtacgagtatgcacgaccggtgctcgatttagtgtgagtagtttgggtttgggggaaggaggaagactgacggtcccccaggagttcaggtgctgggcacagcggccctgggctgcctggtcaaggactacttcccatactcgtactgagcgggctggcaaggcgcatagnnnnnnnnnnnnnnnnnnnnnnnnnn

SEQ ID NO: 92615 - DNA, 130 bp, Homo sapiens
  misc_feature: GYAE6OF01B279E.18.78.H01.1.454.CMB.1.raw
  modified_base (130)..(130): a, c, t, g, unknown or other
  misc_feature (130)..(130): n is a, c, g, or t
tcagtacgagtatgcacgaccggtgctcgatttagtgtgagtagtttgggtttgggcacagcggccctgggctgcctggtcaaggactacttcccatactcgtactgagcgggctggcaaggcgcatagn

SEQ ID NO: 92616 - DNA, 149 bp, Homo sapiens
  misc_feature: GYAE6OF01BYRB3.18.78.H01.1.454.CMB.1.raw
  modified_base (129)..(149): a, c, t, g, unknown or other
  misc_feature (129)..(149): n is a, c, g, or t
tcagtacgagtatgcacgaccggtgctcgatttagtgtgagtagtttgggttgggcacagcggccctgggctgcctggtcaaggactacttcccatactcgtactgagcgggctggcaaggcgcatagnnnnnnnnnnnnnnnnnnnnn

SEQ ID NO: 92617 - DNA, 140 bp, Homo sapiens
  misc_feature: GYAE6OF01AV3NP.18.78.H01.1.454.CMB.1.raw
  modified_base (131)..(140): a, c, t, g, unknown or other
  misc_feature (131)..(140): n is a, c, g, or t
tcagtacgagtatgcacgaccggtgctcgatttagtgtgagtagtttgggtttgggcgacagcggccctgggctgcctggtcaaggactacttcccatactcgtactgagcgggctggcaaggcgcatagnnnnnnnnnn

SEQ ID NO: 92618 - DNA, 562 bp, Homo sapiens
  misc_feature: GYAE6OF01AZF7F.18.78.H01.1.454.CMB.1.raw
  modified_base (476)..(476): a, c, t, g, unknown or other
  misc_feature (476)..(476): n is a, c, g, or t
  modified_base (549)..(549): a, c, t, g, unknown or other
  misc_feature (549)..(549): n is a, c, g, or t
  modified_base (552)..(552): a, c, t, g, unknown or other
  misc_feature (552)..(552): n is a, c, g, or t
  modified_base (556)..(556): a, c, t, g, unknown or other
  misc_feature (556)..(556): n is a, c, g, or t
  modified_base (559)..(562): a, c, t, g, unknown or other
  misc_feature (559)..(562): n is a, c, g, or t
tcagtacgagtatgcacgaccggtgctcgatttagtgtgagtagtttgggtttgggggctttgccgtgggcccagtctgaccctgaacttcaacctggaccctccgtggtacctgggtctccctgggacctagttcgtactccaccatctcctggcacctggaaccagcccgagtagtacgttggttggttataactatgtctcctggtacccaacagtcacccaggcgaaaagcccccaaactccatcgatttatggactgttcagtaatccggccctacaggggttttctaatccgcttctctggctaccaaggtctggcaaccacggcctccctgaccatcgtcgtgggctccaggctggacggacgaggctgacttatactgtcagctcatagtacaaggcagctagcactcaacgttcttacggaactgggaccaaggtccaccgtctaggtcagacccaaggccaacccnctcgtcactctcgttcccgcctctccactacctcgtactcgacgccgggctcggacagggccgctaataggcngcncgcncannnn

SEQ ID NO: 92619 - DNA, 130 bp, Homo sapiens; identical to SEQ ID NO: 92615
  misc_feature: GYAE6OF01EXJK4.18.78.H01.1.454.CMB.1.raw
  modified_base (130)..(130): a, c, t, g, unknown or other
  misc_feature (130)..(130): n is a, c, g, or t

SEQ ID NO: 92620 - DNA, 494 bp, Homo sapiens
  misc_feature: GYAE6OF01DZCS1.18.78.H01.1.454.CMB.1.raw
  modified_base (423)..(423): a, c, t, g, unknown or other
  misc_feature (423)..(423): n is a, c, g, or t
  modified_base (481)..(481): a, c, t, g, unknown or other
  misc_feature (481)..(481): n is a, c, g, or t
  modified_base (486)..(494): a, c, t, g, unknown or other
  misc_feature (486)..(494): n is a, c, g, or t
tcagtacgagtatgcacgaccggtgctcgatttagtgtgagtagtttgggtttggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattatactgcagctcatatacaagcaccagcactctctatgtcttcggaactgggaccaaggtcaccgtctaggtcagcccaaggccaaccccntcgtcactctgttccccgccctcctccatacctcgtactgacgcgggctggcaaggcncatgnnnnnnnnn

SEQ ID NO: 92621 - DNA, 491 bp, Homo sapiens
  misc_feature: GYAE6OF01DNB13.18.78.H01.1.454.CMB.1.raw
  modified_base (365)..(365): a, c, t, g, unknown or other
  misc_feature (365)..(365): n is a, c, g, or t
  modified_base (483)..(491): a, c, t, g, unknown or other
  misc_feature (483)..(491): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaaactcatgatttatgatgtcagtaatcggccctcaggggtttctaatcgcttctctggctccaagtctggcaacacggcctcctgaccatctctgggctccaggctgaggacgaggctgattatactgcagctcatatacaagcagcagcactnaaagtcttcggaactgggaccaaggtcaccgtctaggtcagcccaaggccaaccccactgtcactctgttcccgccctcctccatactcgtactgagcgggctggcaaggcgcatagnnnnnnnnn

SEQ ID NO: 92622 - DNA, 600 bp, Homo sapiens
  misc_feature: GYAE6OF01CYKWL.18.78.H01.1.454.CMB.1.raw
  modified_base (389)..(389): a, c, t, g, unknown or other
  misc_feature (389)..(389): n is a, c, g, or t
  modified_base (451)..(451): a, c, t, g, unknown or other
  misc_feature (451)..(451): n is a, c, g, or t
  modified_base (462)..(462): a, c, t, g, unknown or other
  misc_feature (462)..(462): n is a, c, g, or t
tcagtacgagtatgcacgaccggtgctcgatttagtgtgagtagtttgggtttgggggcgtctgggagaggagcttccacgccttgggattcccagctcgtctccactcggtgatcggcactgaatacaggagactcaccatggagtttgggctgaagcggtggtttcgtgtagcgtattaaagtgtcagtgtgagtgcagctggtgagtccggggacgccttggtccagccgtggggggtccctgaaactctccgtgtgcagcctatggttcacgttcagtggctacgtgctagtcgccacgtcggtccgccaggtctttccggggaaaggtctggagtggggttcgcgtagttgaacgcaaagctacagttacgcgacagcatagtncgtgtcgcgtgaagcagtcacgtctacacgaatcgattacaagaacacgtacgtatacgttnactaatagaanacgactagaaacgtacgacgtacggaccgtacgtaagttactagtacgttaggaccgtagggtacggtaagttacgtaggttaggggtaagttaacggtaacggtaaccggtaaacggggggtacgtacggtaaccgg

SEQ ID NO: 92623 - DNA, 132 bp, Homo sapiens
  misc_feature: GYAE6OF01CVD0C.18.78.H01.1.454.CMB.1.raw
  modified_base (130)..(132): a, c, t, g, unknown or other
  misc_feature (130)..(132): n is a, c, g, or t
tcagtacgagtatgcacgaccggtgctcgatttagtgtgagtagtttgggtttgggcacagcggccctgggctgcctggtcaaggactacttcccatactcgtactgagcgggctggcaaggcgcatagnnn

SEQ ID NO: 92624 - DNA, 174 bp, Homo sapiens
  misc_feature: GYAE6OF01CJQGJ.18.78.H01.1.454.CMB.1.raw
  modified_base (173)..(174): a, c, t, g, unknown or other
  misc_feature (173)..(174): n is a, c, g, or t
tcagtacgagtatgcacgaccggtgctcgatttagtgtgagtagtttgggtttgggggaagaggaagactgacggtcccccaggagttcaggtgctgggcacagcggccctgggctgcctggtcaaggactacttcccatactcgtactgagcgggctggcaaggcgcatagnn

SEQ ID NO: 92625 - DNA, 130 bp, Homo sapiens; identical to SEQ ID NO: 92615
  misc_feature: GYAE6OF01DYFJW.18.78.H01.1.454.CMB.1.raw
  modified_base (130)..(130): a, c, t, g, unknown or other
  misc_feature (130)..(130): n is a, c, g, or t

SEQ ID NO: 92626 - DNA, 342 bp, Homo sapiens
  misc_feature: GYAE6OF01AET87.18.78.H01.1.454.CMB.1.raw
  modified_base (301)..(301): a, c, t, g, unknown or other
  misc_feature (301)..(301): n is a, c, g, or t
  modified_base (306)..(342): a, c, t, g, unknown or other
  misc_feature (306)..(342): n is a, c, g, or t
tcagtacgagtatgcacgaccggtgctcgatttagtgtgagtagtttgggtttgggggtttactaactcgcttactctacggctccaaggtctggcaacacggcctccctgaccatctctgggcctcccaggctgaggacgaggctgatttattacctgcagctcatatacaagcaccagcactctctatgtcttcggaactgggaccaaggtcaccgtcctaggtcacgcccaaggccaacccactgtccactctgttcccaccctcctccatactcgtactgagcgggctggcaaggcncatgnnnnnnnnnnnnnnnnnnnnnnnnnnnnnnnnnnnnn

SEQ ID NO: 92627 - DNA, 579 bp, Homo sapiens
  misc_feature: GYAE6OF01EHOSL.18.78.H01.1.454.CMB.1.raw
  modified_base (355)..(355): a, c, t, g, unknown or other
  misc_feature (355)..(355): n is a, c, g, or t
  modified_base (570)..(570): a, c, t, g, unknown or other
  misc_feature (570)..(570): n is a, c, g, or t
  modified_base (577)..(578): a, c, t, g, unknown or other
  misc_feature (577)..(578): n is a, c, g, or t
tcagtacgagtatgcacgaccggtgctcgattttagtgtgagtagtttgggtttgggggtcgtttgcctgggcccaggtctgccctgactcgaacctgcctccggttcgtctcgggtctcctcggacgagtccgatcaccatctcctgcgactcggaaccagcagtgacgttggtggttataactactgtctcctggtaccaaccagcaccaggcaaaggcccccaaactcatgactttatgatgtcgagtaatcggaccctctaggggtttctaacttcgtactttcgtactggactccaagtcctgggccaaccacggcctccctgaccatctctgggctcagctgaggacgngggctgattagttactgcagctcgatactacgaagcagtcagtcactacaagtcttacggaactcgggaccaaggtcaccgtctagtcacgacctaaggtcccaacccgctacgtacacttcctacgtttcccacccgttccctacgactacgttccgtaactagaacggcggtctggaccgaacggccgacctaagttacgctactcacgtccncgcatcnnc

SEQ ID NO: 92628 - DNA, 515 bp, Homo sapiens
  misc_feature: GYAE6OF01EG1JF.18.78.H01.1.454.CMB.1.raw
  modified_base (324)..(324): a, c, t, g, unknown or other
  misc_feature (324)..(324): n is a, c, g, or t
  modified_base (419)..(419): a, c, t, g, unknown or other
  misc_feature (419)..(419): n is a, c, g, or t
  modified_base (508)..(508): a, c, t, g, unknown or other
  misc_feature (508)..(508): n is a, c, g, or t
tcagtacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgtcctgactcaacctgcctccgtgtctgggtctcctggacagtcgatcaccatctcctgcactggaaccagcagtgacgttggtggttataactatgtctcctggtaccaacagcacccaggcaaacgccccaaaactcatgatttatgatgtcactaatcggcctnagggtttctaatcgcttctctggctccaagtctggcaacacggcctccctgaccatctctgggctccaggctgaggacgaggctgattattactncagctcatataacaagcacagcactctctatcgtactcggaactgggaccaaggtcaccgtcctagtcacgcccaacggcccaaacccnctgtacc

SEQ ID NO: 92629 - DNA, 692 bp, Homo sapiens
  misc_feature: GYAE6OF01CYAAS.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagcggtcgttcggtctaaggcgtattaaagtgcagtgtgagtgcagctgtggagtccggggagcttggccagccgtgggggtccctgaaactcgtctgtgcagctctgggttcacctttccgtacgtgtctctcgtctatcgcgtcgtcggtccgccgacggtcgtaccgggtaacggtacggtggtaggtcgggtcggtacgtagtagaacgacgaacgtacgtaacgtaacgtacgtacgacgacgactagtacgtcgtcgtacgtcggtacggtaacggtaacggtacgtacgttaccgtaccgtaccgtaccgtaacgtaaacgtaacgtaacgtaacgtaaacgaacgtaaccggtaacgtactacgtacgtaacgtaagtaacgaacgaacgaaccgtaacggaaaccggaacggaacgtaccggtaccgtacgttacgttaacgtacgtacgtacgtaacgtaacggtagtacgttaacgttaggttagggtaggttacgtacggtaacgggtaaacggggtacgtacggtacg

SEQ ID NO: 92630 - DNA, 143 bp, Homo sapiens
  misc_feature: GYAE6OF01B8G1Y.18.78.H01.1.454.CMB.1.raw
  modified_base (130)..(143): a, c, t, g, unknown or other
  misc_feature (130)..(143): n is a, c, g, or t
tcagtacgagtatgcacgaccggtgctcgatttagtgtgagtagtttgggtttgggcacagcggccctgggctgcctggtcaaggactacttcccatactcgtactgagcgggctggcaaggcgcatagnnnnnnnnnnnnnn

SEQ ID NO: 92631 - DNA, 494 bp, Homo sapiens
  misc_feature: GYAE6OF01ARO2A.18.78.H01.1.454.CMB.1.raw
  modified_base (419)..(419): a, c, t, g, unknown or other
  misc_feature (419)..(419): n is a, c, g, or t
  modified_base (436)..(436): a, c, t, g, unknown or other
  misc_feature (436)..(436): n is a, c, g, or t
  modified_base (484)..(487): a, c, t, g, unknown or other
  misc_feature (484)..(487): n is a, c, g, or t
  modified_base (489)..(494): a, c, t, g, unknown or other
  misc_feature (489)..(494): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattatactgcagctcatatacaagcagcagcactcaagtcttacggaactgggaccaaggtcacgtcaggtcagcccaaggccaacccntcgcactctcgttcccnccctcctcacttacctcgtactgacgcggctggcaaggccgctagagnnnncnnnnnn

SEQ ID NO: 92632 - DNA, 174 bp, Homo sapiens; identical to SEQ ID NO: 92624
  misc_feature: GYAE6OF01BUAWH.18.78.H01.1.454.CMB.1.raw
  modified_base (173)..(174): a, c, t, g, unknown or other
  misc_feature (173)..(174): n is a, c, g, or t

SEQ ID NO: 92633 - DNA, 489 bp, Homo sapiens
  misc_feature: GYAE6OF01DBTW8.18.78.H01.1.454.CMB.1.raw
  modified_base (478)..(478): a, c, t, g, unknown or other
  misc_feature (478)..(478): n is a, c, g, or t
  modified_base (483)..(489): a, c, t, g, unknown or other
  misc_feature (483)..(489): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaccagcagtgacgttggtggttataactatgtctcctggtaccaacagcacccaggcaaagccccaaactcatgatttatgatgtcagtaatcggccctcaggggtttctaatcgcttctctggctccaagtctggcaacacggcctcctgaccatctctgggctccaggctgaggacgaggctgattagttactgcagctcatatacaagcagcagcactctctatgtcttcggactgggaccaaggtcaccgtctaggtcagcccaacggcccaacccactgccactctcgttcccgccctcctcactctcgtactgagcggctgcgaaggcgnatagnnnnnnn

SEQ ID NO: 92634 - DNA, 588 bp, Homo sapiens
  misc_feature: GYAE6OF01DQMM7.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggaggtccgggggaggcttggtccagcctggggggtccctgaaactctcctgtgcagcctctgggttcaccttcagtggctctgctatgcacgtgggtccgccaggcgttaccggggaaagggcgtggagtgggttggccgtattagaagacaaagctaacagttacgcgacagcatatgctgcgtcggtagaaggcgaggttcacgtctccgaagaaatagatacaaagaacgacggacgtatctagacaatagaacgacgacctacgaaaaccgaggaaccgacggaccgtagtaattactagtactagacgtaggtaggtattacgtagtttaggggtagttagtacggacggtaaacggggggtacgtacgtaacgg

SEQ ID NO: 92635 - DNA, 572 bp, Homo sapiens
  misc_feature: GYAE6OF01AFF16.18.78.H01.1.454.CMB.1.raw
  modified_base (457)..(457): a, c, t, g, unknown or other
  misc_feature (457)..(457): n is a, c, g, or t
  modified_base (554)..(554): a, c, t, g, unknown or other
  misc_feature (554)..(554): n is a, c, g, or t
  modified_base (558)..(558): a, c, t, g, unknown or other
  misc_feature (558)..(558): n is a, c, g, or t
  modified_base (564)..(564): a, c, t, g, unknown or other
  misc_feature (564)..(564): n is a, c, g, or t
  modified_base (566)..(566): a, c, t, g, unknown or other
  misc_feature (566)..(566): n is a, c, g, or t
  modified_base (569)..(569): a, c, t, g, unknown or other
  misc_feature (569)..(569): n is a, c, g, or t
tcagtacgagtatgcacgaccggtgctcgatttagtgtgagtagtttgggtttgggggcctttagcctcgggcccaggtctgcccctgactcaacctgcctccgtgtctgggtctcctggacagtcgatcacctatctcctgcactggaaccagcacgtgacgttggtggttataactatgtctcctggtaccaacagcaccaggacaaagccccaaacgtcatgatttatgatgtcagtatcggcctcacgggtttctaatcgcttctctggctccaagtctggccaacgacggcctccctgaccagtctcgtggctccaggctgagacgagctgattatactgcacgctacatactaacgaagcagcacgcacgtctactaatcgtacttacggaactcggggaaccagggtccaaccgtcctaaggtcaacgcccgaaaggccccaaaccccgntacggacctacgttcctaccgtaccccgcccgttcctcctaattcctcgtactggaacgcgggtacgtaggaccgtaacggccgactagttaccgtntacnctcgancncgngcg

SEQ ID NO: 92636 - DNA, 496 bp, Homo sapiens
  misc_feature: GYAE6OF01BE68A.18.78.H01.1.454.CMB.1.raw
  modified_base (423)..(423): a, c, t, g, unknown or other
  misc_feature (423)..(423): n is a, c, g, or t
  modified_base (449)..(449): a, c, t, g, unknown or other
  misc_feature (449)..(449): n is a, c, g, or t
  modified_base (486)..(496): a, c, t, g, unknown or other
  misc_feature (486)..(496): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcgaggggtttctaatcgcttctctggctccaagtctggcaacacggcctccctgaccatctctgggctccaggctgaggcgagctgattattactgcagctcatatacaagcagcagcactcaagtcttacggaactgggaccaaggtcaccgtctaggtcacgcccaaggcccaacccnctgtccactctccgtcccaccctccnccactactcgtactgacgcggctggcaggcgcatagnnnnnnnnnnn

SEQ ID NO: 92637 - DNA, 489 bp, Homo sapiens
  misc_feature: GYAE6OF01D4MSH.18.78.H01.1.454.CMB.1.raw
  modified_base (422)..(422): a, c, t, g, unknown or other
  misc_feature (422)..(422): n is a, c, g, or t
  modified_base (477)..(477): a, c, t, g, unknown or other
  misc_feature (477)..(477): n is a, c, g, or t
  modified_base (481)..(489): a, c, t, g, unknown or other
  misc_feature (481)..(489): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaaactcatgatttatgatgtcagtaatcggccctcaggggtttctaatcgcttctctggctccaagtctggcaacacggcctcctgaccatctctgggctccaggctgaggacgaggctgattattactgcagctcatatacaagcacagcactctctatcgtcttcggaactgggaccaggtcaccgtctagtcacgccacgcccaacccntcgtcactctcgtcccgcctcctccatactcgtactgacgcggctggcaaggcanatgnnnnnnnnn

SEQ ID NO: 92638 - DNA, 192 bp, Homo sapiens
  misc_feature: GYAE6OF01EF6TG.18.78.H01.1.454.CMB.1.raw
  modified_base (173)..(192): a, c, t, g, unknown or other
  misc_feature (173)..(192): n is a, c, g, or t
tcagtacgagtatgcacgaccggtgctcgatttagtgtgagtagtttgggtttgggggaagaggaagactgacggtcccccaggagttcaggtgctgggcacagcggccctgggctgcctggtcaaggactacttcccatactcgtactgagcgggctggcaaggcgcatagnnnnnnnnnnnnnnnnnnnn

SEQ ID NO: 92639 - DNA, 500 bp, Homo sapiens
  misc_feature: GYAE6OF01B46VZ.18.78.H01.1.454.CMB.1.raw
  modified_base (224)..(224): a, c, t, g, unknown or other
  misc_feature (224)..(224): n is a, c, g, or t
  modified_base (424)..(424): a, c, t, g, unknown or other
  misc_feature (424)..(424): n is a, c, g, or t
  modified_base (448)..(448): a, c, t, g, unknown or other
  misc_feature (448)..(448): n is a, c, g, or t
  modified_base (490)..(500): a, c, t, g, unknown or other
  misc_feature (490)..(500): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttangatgtcagtaatcggccctcaggggtttctaatcgcttctctggctccaagtctggcaacacggcctccctgaccatctctgggcctccaggctgaggacgaggctgattatactgcagctcatatacaagcagcagcactcaagtcttacggaactgggaccaagggtcaccgtctaggtcacgcccaagcccaacccnctgccactctcgtccccgcctccnccaatcctcgtactgagccgggctggacaaggcgacagtagnnnnnnnnnnn

SEQ ID NO: 92640 - DNA, 612 bp, Homo sapiens
  misc_feature: GYAE6OF01CY07V.18.78.H01.1.454.CMB.1.raw
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
  modified_base (334)..(334): a, c, t, g, unknown or other
  misc_feature (334)..(334): n is a, c, g, or t
  modified_base (344)..(345): a, c, t, g, unknown or other
  misc_feature (344)..(345): n is a, c, g, or t
  modified_base (601)..(612): a, c, t, g, unknown or other
  misc_feature (601)..(612): n is a, c, g, or t
tcagtacgagtatgcacgaccggtgctcgatttagtgtgagtagtttgggtttgggggtctttgccgtgggcccagtctgccctgactcaacctgcctccgtgtctgggtctcctggacagtcgatcaccatctcctgcactggaaccagcagtgacgttggtggttataactatgtctcctgaccaacagcaccagcaaagccccaaatcatgatttatgatgtcataatcggccctgtaggggtttctaatcgcttctctggctccaagttcnggcaaacncggcctccnaccatctctggctccaggctgaggagaggtctgattattacncgctatctannacactatctgagtggtcggtggggtcgtcgggacgggacggaccgtaggcgtacgggtaccggtcgggtacgggtaccgaacggacccggaacggtcccgtcccggtcccccgttaccggtacctacccgttccgtttcccgttacccccctaccccttccccttaacccgtaaccgttaacccgttacccggttaacgtcgggtaccgggtaccggggtaccgtacgggaccggaaacgggtccgacgaagtagnnnnnnnnnnnn

SEQ ID NO: 92641 - DNA, 510 bp, Homo sapiens
  misc_feature: GYAE6OF01DHFE4.18.78.H01.1.454.CMB.1.raw
  modified_base (503)..(503): a, c, t, g, unknown or other
  misc_feature (503)..(503): n is a, c, g, or t
tcagtacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcacagcactctctatgtcttacgactgggaccaaggtcacgtccaggtcacgcccaacggcccaacccntcgtacc

SEQ ID NO: 92642 - DNA, 514 bp, Homo sapiens
  misc_feature: GYAE6OF01BRWZ8.18.78.H01.1.454.CMB.1.raw
  modified_base (306)..(306): a, c, t, g, unknown or other
  misc_feature (306)..(306): n is a, c, g, or t
  modified_base (504)..(504): a, c, t, g, unknown or other
  misc_feature (504)..(504): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttangatgtcagtaatcggcctcgtagggtttctaatcgtcttctctggctcaagtctgcaacgacgcctcctgaccatctctgggctccgaggctgaggacgaggctagtattattactgcagctcatatacaagcagcagcactcaagtctacggactcggacaggtcaccgtctagtcacgacccaacggcccaacccnctgtctaccg

SEQ ID NO: 92643 - DNA, 485 bp, Homo sapiens
  misc_feature: GYAE6OF01EV30R.18.78.H01.1.454.CMB.1.raw
  modified_base (344)..(344): a, c, t, g, unknown or other
  misc_feature (344)..(344): n is a, c, g, or t
  modified_base (355)..(355): a, c, t, g, unknown or other
  misc_feature (355)..(355): n is a, c, g, or t
  modified_base (419)..(419): a, c, t, g, unknown or other
  misc_feature (419)..(419): n is a, c, g, or t
  modified_base (454)..(454): a, c, t, g, unknown or other
  misc_feature (454)..(454): n is a, c, g, or t
  modified_base (473)..(473): a, c, t, g, unknown or other
  misc_feature (473)..(473): n is a, c, g, or t
  modified_base (477)..(485): a, c, t, g, unknown or other
  misc_feature (477)..(485): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaaactcatgatttatgatgtcagtaatcggccctcaggggtttctaatcgcttctctggctccaagtctggcaacacggcctccctgaccatctctgggccagtccagggctggaggcaggcttagattatacngcagctcatanacaagcagcagcatcaagtcttcggaactgggaccaaggtcacgtcaggcagcccaagccaccnctgtcactcctctcccgcctcctcatactcgtacngacgcgggctggcaggcanatgnnnnnnnnn

SEQ ID NO: 92644 - DNA, 128 bp, Homo sapiens
  misc_feature: GYAE6OF01CRTBH.18.78.H01.1.454.CMB.1.raw
tcagtacgagtatgcacgaccggtgctcgatttagtgtgagtagtttgggtttggcacagcggccctgggctgcctggtcaaggactacttcccatactcgtactgagcgggctggcaaggcgcatag

SEQ ID NO: 92645 - DNA, 491 bp, Homo sapiens
  misc_feature: GYAE6OF01C74YO.18.78.H01.1.454.CMB.1.raw
  modified_base (189)..(189): a, c, t, g, unknown or other
  misc_feature (189)..(189): n is a, c, g, or t
  modified_base (225)..(225): a, c, t, g, unknown or other
  misc_feature (225)..(225): n is a, c, g, or t
  modified_base (377)..(377): a, c, t, g, unknown or other
  misc_feature (377)..(377): n is a, c, g, or t
  modified_base (421)..(421): a, c, t, g, unknown or other
  misc_feature (421)..(421): n is a, c, g, or t
  modified_base (465)..(465): a, c, t, g, unknown or other
  misc_feature (465)..(465): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
  modified_base (486)..(490): a, c, t, g, unknown or other
  misc_feature (486)..(490): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaanagcacccaggcaaaggccccgaaactcatgatttanggactgtcactaatcggcctcaggggtttcaatcgcttctctggctccaagtctggcaacacggcctccctgaccatcactgggctcaggctgatgatgagctgattatactgccagtcctatgacatgagctgagtgttcgatgtcttcgntctgggaccaaggtcaccgtctaagtcagcccaagccaaccctncgtcactctcgttcccacctctccattacctcgtactgagcggntggcaaggcgnagtagntnannnnng

SEQ ID NO: 92646 - DNA, 528 bp, Homo sapiens
  misc_feature: GYAE6OF01EMRM7.18.78.H01.1.454.CMB.1.raw
  modified_base (516)..(516): a, c, t, g, unknown or other
  misc_feature (516)..(516): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctcaagtctgcaacacggcctccctgaccatctctgggctccagctgaggacgaggctgattattactgcagctcatatacaagcagcagcactcaagttcttacggaacgtgggaaccaaggtccaccgtcctaggtaccacgacccgaacggaccccaaaccccnctcgtctacccg

SEQ ID NO: 92647 - DNA, 504 bp, Homo sapiens
  misc_feature: GYAE6OF01CJN00.18.78.H01.1.454.CMB.1.raw
  modified_base (352)..(352): a, c, t, g, unknown or other
  misc_feature (352)..(352): n is a, c, g, or t
  modified_base (430)..(430): a, c, t, g, unknown or other
  misc_feature (430)..(430): n is a, c, g, or t
  modified_base (469)..(469): a, c, t, g, unknown or other
  misc_feature (469)..(469): n is a, c, g, or t
  modified_base (479)..(479): a, c, t, g, unknown or other
  misc_feature (479)..(479): n is a, c, g, or t
  modified_base (491)..(491): a, c, t, g, unknown or other
  misc_feature (491)..(491): n is a, c, g, or t
  modified_base (494)..(494): a, c, t, g, unknown or other
  misc_feature (494)..(494): n is a, c, g, or t
  modified_base (496)..(504): a, c, t, g, unknown or other
  misc_feature (496)..(504): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatcctcgtgggcctccgaggcctggacggacgaggctgattatactgcagctnatatacagcagcagcactcaagtctacggactgggacctaaggtcaccgtcgtagtcacgacccaacggcccaacccnctcgtcactctcgtcccaccctcctccactcctcgtacncgacgcggcnggcaaggcgcanagnannnnnnnnn

SEQ ID NO: 92648 - DNA, 490 bp, Homo sapiens
  misc_feature: GYAE6OF01DM79X.18.78.H01.1.454.CMB.1.raw
  modified_base (481)..(490): a, c, t, g, unknown or other
  misc_feature (481)..(490): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaaactcatgatttatgatgtcagtaatcggccctcaggggtttctaatcgcttctctggctccaagtctggcaacacggcctcctgaccatctctgggctccaggctgaggacgaggctgattatactgcagctcatatacaagcagcagcactcaagtcttcggaactgggaccaaggtcacgtctagtcagccaaggccaacccactgtcactctcgttcccgccctcctccatactcgtactgacgcgggctggcaaggcgcatagcnnnnnnnnnn

SEQ ID NO: 92649 - DNA, 310 bp, Homo sapiens
  misc_feature: GYAE6OF01DNGC8.18.78.H01.1.454.CMB.1.raw
  modified_base (290)..(310): a, c, t, g, unknown or other
  misc_feature (290)..(310): n is a, c, g, or t
tcagtacgagtatgcacgaccggtgctcgatttagtgtgagtagtttgggtttggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaaaccccatgtcactctgttcccgccctctccaatactcgtactgagcggctggcaaggcgcatagnnnnnnnnnnnnnnnnnnnnn

SEQ ID NO: 92650 - DNA, 542 bp, Homo sapiens
  misc_feature: GYAE6OF01AQ39Y.18.78.H01.1.454.CMB.1.raw
tcagtacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgtttggtggttataactatgtctcctggtaccaacagcacccaggacaaacgcccccaaactcatgatttatgatgtcactaatccggccctcgtaggggtttctaatcgcttctctggctcaagtctggcaacacggccctccctgacctatctcgtcgggcctccgaggctggaggacgaggctagattattactgcagctcatactaacagccaaccgagcctactctactatcgtcgttcggaacgtcgggacctaggtccacccgtcctaggtcacgacccaacggccccaacccgtgtccg

SEQ ID NO: 92651 - DNA, 500 bp, Homo sapiens
  misc_feature: GYAE6OF01BHF1M.18.78.H01.1.454.CMB.1.raw
  modified_base (449)..(449): a, c, t, g, unknown or other
  misc_feature (449)..(449): n is a, c, g, or t
  modified_base (490)..(500): a, c, t, g, unknown or other
  misc_feature (490)..(500): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtccaccgtctaggtcagcccaaggccaaccccactgtccactctcgttcccgccctccnccactactcgtactggacgcgggctggcaagggcgcatagnnnnnnnnnnn

SEQ ID NO: 92652 - DNA, 303 bp, Homo sapiens
  misc_feature: GYAE6OF01EXX1O.18.78.H01.1.454.CMB.1.raw
  modified_base (285)..(285): a, c, t, g, unknown or other
  misc_feature (285)..(285): n is a, c, g, or t
  modified_base (291)..(303): a, c, t, g, unknown or other
  misc_feature (291)..(303): n is a, c, g, or t
tcagtacgagtatgcacgaccggtgctcgatttagtgtgagtagtttgggtttggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtccactctgttcccacctcctccatactcgtactgagcggctggcaaggcncatagnnnnnnnnnnnnn

SEQ ID NO: 92653 - DNA, 894 bp, Homo sapiens
  misc_feature: GYAE6OF01A4T24.18.78.H01.1.454.CMB.1.raw
  modified_base (272)..(272): a, c, t, g, unknown or other
  misc_feature (272)..(272): n is a, c, g, or t
tcagtacgagtatgcacgaccggtgctcgatttagtgtgagtagtttggggtttgggggggtctcaggaggcagcgctctcgggacgtctccaccatggcctgggctctgctacttcctcaccctcctcactcgagggcacgagggtcctcgggcccagtctcgccctgacctcaacctgcccttccgtgtcgtgggtcctcctggacagtcgatccacatctcctgccacgtggaccagctaggtggtacgttggttagttaactaacgtntcgtcctaccgtacgtaccaacacgccaacccgacggaccaaaccgaccccaaatctatgtatttagagattcgtacgtaacgttaaccgtccggtacccgtttacgggttacgggtttactaaccgttccgttaccgtttccgttaccggtaccgttacccgttaacccgtaacggtacccggtaacggtaaccccgaaaccccggttacccgggtccccctttacccgtaccgtaaccccgttacgtttcccggtacccggttccgggggtaccctaccccggggtaagggtaccgggtaacggggtaacccgggttacgggtaacggtttaccgttaacgggtttaaacctttaccggtttaccgaccggtaccgtaacgttaaccctaacttaaacgtaacccgtaaacggaccgaaccggtaacggaaccgtttaaaccgaaccctttaacgggaccggtttaacgttacccgggtttaaacggacccgggtaaccgggtaaacccgtaccggtaccccggtaacccggttacccggaacccggtaccccgaaacccccggtaaccgtaacccccggtacccctaaccggtccttcccgttcccgtttaccccccgg

SEQ ID NO: 92654 - DNA, 520 bp, Homo sapiens
  misc_feature: GYAE6OF01EQ8T2.18.78.H01.1.454.CMB.1.raw
  modified_base (419)..(419): a, c, t, g, unknown or other
  misc_feature (419)..(419): n is a, c, g, or t
  modified_base (435)..(435): a, c, t, g, unknown or other
  misc_feature (435)..(435): n is a, c, g, or t
  modified_base (449)..(449): a, c, t, g, unknown or other
  misc_feature (449)..(449): n is a, c, g, or t
  modified_base (512)..(512): a, c, t, g, unknown or other
  misc_feature (512)..(512): n is a, c, g, or t
tcagtacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacagcacccaggcaaacgcccccaaactcatgatttatgatgtcactaatcggcctcagggtttctaatcgcttctctggctcaagtctggcaacacggcctcctgaccatctctgggcctccgaggctggaggacgaggctgtattacttacngcagtctcaatactanaagcagcagcactnaacgttctacggaacgtggacctaaggtcaccgtcctaggtccacgtcccaaggcccaacccngtcgtacc

SEQ ID NO: 92655 - DNA, 490 bp, Homo sapiens
  misc_feature: GYAE6OF01DROW6.18.78.H01.1.454.CMB.1.raw
  modified_base (320)..(320): a, c, t, g, unknown or other
  misc_feature (320)..(320): n is a, c, g, or t
  modified_base (336)..(336): a, c, t, g, unknown or other
  misc_feature (336)..(336): n is a, c, g, or t
  modified_base (425)..(425): a, c, t, g, unknown or other
  misc_feature (425)..(425): n is a, c, g, or t
  modified_base (478)..(478): a, c, t, g, unknown or other
  misc_feature (478)..(478): n is a, c, g, or t
  modified_base (483)..(490): a, c, t, g, unknown or other
  misc_feature (483)..(490): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcctcatctttggtagcaacaatcggccctcaggggtccctgaccgattctctggctccaagtctggcacctcagcctcctggccatcactgggctccaggctgagntgagctgactattacngccagtcctatgacagtgagctgagtggtcgtatgtcttcggatcgtgggaccaggtccaccgtctaagcagcccaaggcccaaccctntcgcactctctcccaccctctccatacctctactgacgcggctggacaaggcnagtgnnnnnnnn

SEQ ID NO: 92656 - DNA, 641 bp, Homo sapiens
  misc_feature: GYAE6OF01BGY0D.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttcctgttgcttattttagaaggtgtccagtgtgacgtgcagctggtggagtcgtgggggagcttggtccaggccgtggggggtccctgagactctccgtgtgcaggccctgcattcattcttaatagttattggatgcacgtgggtcccgccgagggccgtaccgggggaagggcccgggaggtggggtcggaccaacagtaatgacaaagagtaggaactgaagaaacgaacttagtaggtaggaccttcgtaggtaggaacggggcctattccaacctatcctacgaagaacgaacaaacactaaacgtaactttactagtatctagaactaaagtcgaaacacgaccctacgtaaggacggacccggaaggacgaccggtcttaggtagttaactttacggtggtacggtacgggaaaggtacggtacggaacgggttcgggaccgttagggggaacctagggttccgggtaccggg

SEQ ID NO: 92657 - DNA, 626 bp, Homo sapiens
  misc_feature: GYAE6OF01DSPV8.18.78.H01.1.454.CMB.1.raw
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagctgggtttccttgttgctattttaaaaggtgtccagtgtgaggtgcagctggtggaggtccgggggaggcttggtccagccgtgggggtccctgaaactctcctgtgcagcctctcgggttcaccttcagtggctctgctatgcacgtcgggtccgccgaggccgttaccggggaaagggccgtgggaaggttggggttcggaccggttattaaggaaagacgaaaagctaaacgagttaccgacgaacagacaatatgcgtgcgtcggtagaaaggcgtacggtcaccgtctacagtaaatgattacaaagaacgacgacgtactctacgactaaatacgaacacgaccgtaagaaaccgacggacgacggacgtagtacttacgtagtaactacgacgtaggtaggtacttacgtagtttacggggtaagtttacggtacggtacgggtaaacggggggtacgtaaccgg

SEQ ID NO: 92658 - DNA, 505 bp, Homo sapiens
  misc_feature: GYAE6OF01AGBNX.18.78.H01.1.454.CMB.1.raw
  modified_base (499)..(505): a, c, t, g, unknown or other
  misc_feature (499)..(505): n is a, c, g, or t
tcagtacgagtatgcacgaccggtgctcgatttagtgtgagtagtttgggtttgggggctttgcctgggtcctgggcccagtctgccctgactcagcctgcctccgtgtctgggtctcctggacagtcgatcaccatctcctgcactggaaccagcagtgacgtggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattatactgcagctcatatacaagcaccagcactctctatgtcttcggactgggaccaaggtcaccgtctagtcagcccaaggcccaacccactcgtcactctcgttccccaccctcctccactacctcgtactgacgcgggctcgggcaaggcgacatacgnnnnnnn

SEQ ID NO: 92659 - DNA, 896 bp, Homo sapiens
  misc_feature: GYAE6OF01BMJL0.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggaggtccgggggaggcttggtccagccgtgggggtccctgaaactctcctgtgcagcctcgtgggttcaccttcagtggctctgctatgcacgtgggtccgccgacgggtccgttcccggggaaaggggccgtgggaggttgggggtttcgggacccggttaagtttaaggaaacggtcgaaaaacggtccttaaaacgaacggtttaaccggaccggtaaccgaaggacctaagttaacgttggtccttcgggccggtttacggggtaagggaaaacgggtccgtaacgggtttacccgtaaccccggttacccgttaccccgtaaacggtaaaacttacgggtaaactttaaccgaaaaacggaaacccgtaaccggggtacccggttaaacgttccgttaacggtaaccgtaaaaacgttacggaaaacccgtaacggtaaccccgttaaaccgggaaaaaacccgggtaaacggggaaacccgtaaacccggggtacccggttacggttaaaccgtttaacgttacggttaaaccgtaaacggtaaccggtaaggggttaagggttaacggtttaaacggttaacgggttttaagggggggtaacggttttaacgggttacccgggtaaccgggggttaaaaacccgggggggggtttaaccgttaaaccgggttaaacccggg

SEQ ID NO: 92660 - DNA, 498 bp, Homo sapiens
  misc_feature: GYAE6OF01B1NN0.18.78.H01.1.454.CMB.1.raw
  modified_base (243)..(243): a, c, t, g, unknown or other
  misc_feature (243)..(243): n is a, c, g, or t
  modified_base (420)..(420): a, c, t, g, unknown or other
  misc_feature (420)..(420): n is a, c, g, or t
  modified_base (444)..(444): a, c, t, g, unknown or other
  misc_feature (444)..(444): n is a, c, g, or t
  modified_base (489)..(498): a, c, t, g, unknown or other
  misc_feature (489)..(498): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcactaatcggccctnaggggtttctaatcgcttctctggctccaagtctggcaacacggcctccctgaccatctctgggctccaggctgaggacgaggctgattatactgcagctcatatacaagcacagcactctctatgtcttcggaactgggaccaggtcacgtcctagtcagcccaaggcccaacccnctcgctactctcgtcccgcctccncctatacctcgtactgacggcggtctggaccacggcgacagtcgnnnnnnnnnn

SEQ ID NO: 92661 - DNA, 457 bp, Homo sapiens
  misc_feature: GYAE6OF01BTEG1.18.78.H01.1.454.CMB.1.raw
  modified_base (449)..(457): a, c, t, g, unknown or other
  misc_feature (449)..(457): n is a, c, g, or t
tcagtacgagtatgcacgaccggtgctcgatttagtgtgagtagtttgggtttgggggctttgcctgggtgctgttggtaccaggagacatagttataaccaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctcaggctgaggacgaggctgattattactgcagctcatatacaagcagcagcactcaagtctcggaactgggaccaggtcaccttcagtcagcccaggccaacccatgcactctcgttcccgccctcctccactctcgtactgagcgggctggcaggcgcatgnnnnnnnnn

SEQ ID NO: 92662 - DNA, 508 bp, Homo sapiens
  misc_feature: GYAE6OF01E0G5L.18.78.H01.1.454.CMB.1.raw
  modified_base (495)..(495): a, c, t, g, unknown or other
  misc_feature (495)..(495): n is a, c, g, or t
  modified_base (499)..(500): a, c, t, g, unknown or other
  misc_feature (499)..(500): n is a, c, g, or t
  modified_base (502)..(508): a, c, t, g, unknown or other
  misc_feature (502)..(508): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaaactcatgatttatgatgtcactaatcggccctcaggggtttctaatcgcttctctggctccaagtctggcaacacggcctccctgaccatctctgggctccaggctggaggacgaggctgattattactgcagctcatatacaagcaccagcactctctatgtcttcggaactgggaccaaggtcaccgtcctagtcacgcccaaggcccaaccccatcgtcactctcgttccccaccctccctccactacctcgtactgacgcgggctgggaccaagggcanatgnncnnnnnnn

SEQ ID NO: 92663 - DNA, 501 bp, Homo sapiens
  misc_feature: GYAE6OF01AK1I7.18.78.H01.1.454.CMB.1.raw
  modified_base (489)..(489): a, c, t, g, unknown or other
  misc_feature (489)..(489): n is a, c, g, or t
  modified_base (493)..(495): a, c, t, g, unknown or other
  misc_feature (493)..(495): n is a, c, g, or t
  modified_base (497)..(501): a, c, t, g, unknown or other
  misc_feature (497)..(501): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcacagcactctctatcgtcttcggaactgggaccaggtcaccgtctagtcacgcccaacggccaaccccactcgtcactcctcgttccccgcccttcctccactacctcgtactcgacgcggctcggcgagcgnatgnnncnnnnn

SEQ ID NO: 92664 - DNA, 512 bp, Homo sapiens
  misc_feature: GYAE6OF01D6VO1.18.78.H01.1.454.CMB.1.raw
  modified_base (445)..(445): a, c, t, g, unknown or other
  misc_feature (445)..(445): n is a, c, g, or t
  modified_base (499)..(499): a, c, t, g, unknown or other
  misc_feature (499)..(499): n is a, c, g, or t
  modified_base (501)..(502): a, c, t, g, unknown or other
  misc_feature (501)..(502): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (508)..(509): a, c, t, g, unknown or other
  misc_feature (508)..(509): n is a, c, g, or t
  modified_base (511)..(512): a, c, t, g, unknown or other
  misc_feature (511)..(512): n is a, c, g, or t
tcagtacgagtatgcacgaccggtgctcgatttagtgtgagtagtttgggtttgggggctttgcctgggcccagtctgccctgactcaacctgcctccgtgtctggtctcctggacagtcgatcaccatctcctgcactggaaccagcagtgacgttggtggttataactatgtctcctggtaccaacagcacccaggcaaagcccccaaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttacggaactgggaccaaggtcaccgtccaggtcacgacccaaggcccaaccccactcgcactctccgttcccnccctacctccatacctccgtactgacgcgggctggaccaaggccgactatacgncnncncnanncnn

SEQ ID NO: 92665 - DNA, 673 bp, Homo sapiens
  misc_feature: GYAE6OF01DW075.18.78.H01.1.454.CMB.1.raw
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctcgtgtctgggtctcctggacagtcgatcaccatcctcctgcactggaaccagcagtgacgttggtgttaataactatgtctcctggtaaccaacacgcacccaggacaaaacgacccccaaactcatcgtatttatagtatgtacagtaacgtccggtccctcgtagggtttactaatcgtcttctcgtcggctaccgaagtcgtcggacaacgccggccctccctacgacctacttcctcgtcgggcctaccgaggtctaggacgggacgcggtctagtatttacttactgacgtagcctactaattaactaaccgaacgaccaaccgagtacctaaccttcgttacttagttaccgttaccgttaacgggaaaccgttacggggaaaccctaacgggttacccaaccccgggtttccgtaccgggttaacccacccgggtaacccccgaaaccggtaacccccctaaaccccgtacgttccggttaacccccg

SEQ ID NO: 92666 - DNA, 725 bp, Homo sapiens
  misc_feature: GYAE6OF01BV1CL.18.78.H01.1.454.CMB.1.raw
tcagtacgagtatgcacgaccggtgctcgatttagtgtgagtagtttgggtttgggggggtctcaggaggcagcgctctcgggacgtctccaccatggcctgggctctgctattcctcaccctcctcactcagggcacaggggtcccgtcgggcccagtctcgccctgactaccaaccgtcgcccttccggtgtcgtcgggttcctccgtggacaggtcgatccaccactccttcctgaccacgtacggaaccagctaggtcgtacggttggttagttaataactatcgtcctccgtacggtaaccaacgacgaccaacccgaggaaccaaacccgaccccctaaactctatagttaattttagtagtagttcgtacgtaagttaacgtcccggtaccctacggtttacggggtttactaacgtccgttcttctcgtcggtcctacgtaagtcgtacggaccaaacgtccggccctccgtacgacctattccgttcggtcgggtcctaccggacggtcgtagggaacgggtacgaacggtcttaagttactttaacgttacgtcgacgtacgtcctaactaacttaactaacgaacgaccaaccgacgtacctaccgttcttactacgttcgttaccgttacggtaacgtacgggaaccgtaacggtcctacccggttccgtacggtcaaccgacccgaaccgaccccaacccctgtcgtacccg

SEQ ID NO: 92667 - DNA, 300 bp, Homo sapiens
  misc_feature: GYAE6OF01D6CH4.18.78.H01.1.454.CMB.1.raw
  modified_base (294)..(300): a, c, t, g, unknown or other
  misc_feature (294)..(300): n is a, c, g, or t
tcagtacgagtatgcacgaccggtgctcgatttagtgtgagtagtttgggtttggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtccactctcgttcccaccctcctccatactcgtactgagcgggctggcaaggcgcatagnnnnnnn

SEQ ID NO: 92668 - DNA, 527 bp, Homo sapiens
  misc_feature: GYAE6OF01EJQ03.18.78.H01.1.454.CMB.1.raw
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
  modified_base (362)..(362): a, c, t, g, unknown or other
  misc_feature (362)..(362): n is a, c, g, or t
  modified_base (507)..(507): a, c, t, g, unknown or other
  misc_feature (507)..(507): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (522)..(527): a, c, t, g, unknown or other
  misc_feature (522)..(527): n is a, c, g, or t
tcagtacgagtatgcacgaccggtgctcgatttagtgtgagtagtttgggtttgggggcgtttgcctgggcccagtctgccctgactcaacctgtcctccgtgttctgggtctcctggacagtcgatcaccatctcctgcactggaaccagcagtgacgttggttggttataactatgttactcctggtaccaacagcacccaggcaaacgcccccaaaatcatggatttatgatgtcaggtaatcggccctcaggggtttctaatcgcttctctggctccaagtcttggcaacncggcctcctgaccagtcnctgggcctccgaggctggaggacgaggctgattatactgcagctcatanacaagcaccagcactgtctaatgttcttacgaactggacaaggtcaccgttcaggtcacgcccaagccaaccccatgtacactctgttccccgccctccgtacctatacctcgtaactcgaagcggtcttcgacgtaaggcccgnacgttagnancgtgnnnnnn

SEQ ID NO: 92669 - DNA, 611 bp, Homo sapiens
  misc_feature: GYAE6OF01C0KJ9.18.78.H01.1.454.CMB.1.raw
  modified_base (277)..(277): a, c, t, g, unknown or other
  misc_feature (277)..(277): n is a, c, g, or t
  modified_base (294)..(294): a, c, t, g, unknown or other
  misc_feature (294)..(294): n is a, c, g, or t
  modified_base (358)..(358): a, c, t, g, unknown or other
  misc_feature (358)..(358): n is a, c, g, or t
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagcgtggtttcgtgtaggctatttaaagtgtcagtgtgaggtgcagctggtggaggtccgggggaggcttgggtccagccgtggggggtccctgaaactctcctgtgcagctctggttcaccttnagtggctctgctatgcnctgggtccgcgaggcttccgggaaaggcgtggaggtgggttggcgtataggaagcaaagctaanagttacgcgacagcatatgctgcgttcggagaaggcgtaaggttcaaccgtctaccaagaaactagaattacaaacgaacgacggtacgtatctagacaaatagaacagaccgtaagaaaccgaggaaccgacggtccgtaggttacttaacgtacgttactacggtaacgtaagggtaggttaagttacgtaagggtttaggggtaagttaggtacggtaacgggtaaaccgggggggtaacttaaaccggg

SEQ ID NO: 92670 - DNA, 510 bp, Homo sapiens
  misc_feature: GYAE6OF01EQDNI.18.78.H01.1.454.CMB.1.raw
  modified_base (367)..(367): a, c, t, g, unknown or other
  misc_feature (367)..(367): n is a, c, g, or t
  modified_base (453)..(453): a, c, t, g, unknown or other
  misc_feature (453)..(453): n is a, c, g, or t
  modified_base (501)..(510): a, c, t, g, unknown or other
  misc_feature (501)..(510): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgatttatactgcagctcatatacaagcaccagcactcntatgtcttggaactgggacaggtcacgtctaggtcacgcccaaggcccaaccccactcgtacaccttctcgttccccacccttccncctaatacctcgtactcggagccgggctcggactaagggccacaatgnnnnnnnnnn

SEQ ID NO: 92671 - DNA, 672 bp, Homo sapiens
  misc_feature: GYAE6OF01E3KLR.18.78.H01.1.454.CMB.1.raw
  modified_base (660)..(660): a, c, t, g, unknown or other
  misc_feature (660)..(660): n is a, c, g, or t
  modified_base (663)..(663): a, c, t, g, unknown or other
  misc_feature (663)..(663): n is a, c, g, or t
  modified_base (665)..(668): a, c, t, g, unknown or other
  misc_feature (665)..(668): n is a, c, g, or t
  modified_base (670)..(672): a, c, t, g, unknown or other
  misc_feature (670)..(672): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcaccaggcaaacgcccccaaactcatgatttatgatgtcactaactcggccctcgtaggggtttctaatcgtctttctctggctccaagtctaggaccaaaccgaccggcctccctgacctatccgtcgtcggctaccgaggtcgtaggacggacggaggtctagtaacttagtactgcacgtcctacaataacgtaacaacgaccaaccgtacgtacctacgttacttacttaagttccggttaccgttaaccgggaaccgtaccgggaaccctaacggtcccgtacccggttaccgttacggccaaccggacccccaaacggaccccctaacccgtcgttccgtaccctacccgtttcccgttcccgtttccccccgacccttacccgtacctaacgttacccgttccgtaacggtcggaaccggggtccgggtcgtacgggaaccgtaacgggccaagtaacggtncancnnnncnnn

SEQ ID NO: 92672 - DNA, 509 bp, Homo sapiens
  misc_feature: GYAE6OF01AT66W.18.78.H01.1.454.CMB.1.raw
  modified_base (433)..(433): a, c, t, g, unknown or other
  misc_feature (433)..(433): n is a, c, g, or t
  modified_base (506)..(506): a, c, t, g, unknown or other
  misc_feature (506)..(506): n is a, c, g, or t
tcagtacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcctagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcactaatcggccctcaggggtttctaatcgcttctctggctccaagtctggcaacacggcctcctgaccatctctgggcctccgaggctggaggacggaggctgattacttactgcagctcatanacaagcaccagcactctctatgtcttgaactgggacctaggtcaccgtctaggcacgcccaaggcccaacccntcg

SEQ ID NO: 92673 - DNA, 776 bp, Homo sapiens
  misc_feature: GYAE6OF01D87T4.18.78.H01.1.454.CMB.1.raw
  modified_base (762)..(762): a, c, t, g, unknown or other
  misc_feature (762)..(762): n is a, c, g, or t
  modified_base (771)..(771): a, c, t, g, unknown or other
  misc_feature (771)..(771): n is a, c, g, or t
  modified_base (773)..(774): a, c, t, g, unknown or other
  misc_feature (773)..(774): n is a, c, g, or t
  modified_base (776)..(776): a, c, t, g, unknown or other
  misc_feature (776)..(776): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgactttggtggttataactatgtctcctggtaccaacagcaccaggcaaacgcccccaaactcatgatttatgatgtcagtaatcggcctcgtaggggtttctaatcgcttctctggcctcaagtctggcaacaccggcctccctgacccattcctcgtcgggcctaccgaggtccgtaggacgggacgtaggtccgttaggtaatttacttaaccgtgacgaacgtcctactaatttaactaacgaaacgtacaacggacgaaacgtacccgtaaaccgttaccgttaaacggttaccggttttaaccggggaaaccggttaccgggggtaaaacccctaaacgggggtttcccctaaaccccgggtttcccgtaaacggggttacccgaaaccggacccccggaaaaccggggtacccccctaaaccccccgttaacgttaccggttaccccaacgttttaccccgttaccccggtttaaccccccaacccccgtttacccttaacccgtaacccgtttaaccccgttacccggttaaccttacggggaaccggtccggggtaccttacggggaccgaaacgggtccgaacctaaggttacgcgtacncgcgcacancnngn

SEQ ID NO: 92674 - DNA, 516 bp, Homo sapiens
  misc_feature: GYAE6OF01EXOOS.18.78.H01.1.454.CMB.1.raw
  modified_base (366)..(366): a, c, t, g, unknown or other
  misc_feature (366)..(366): n is a, c, g, or t
  modified_base (508)..(508): a, c, t, g, unknown or other
  misc_feature (508)..(508): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggacaaacgcccccaaactcatgatttatgatgtcactaatcggcctcgtaggggtttctaatcgtcttctctgctcagtctgcaacncgcctcctgacatctctgggctccgagctggaggacgagctgtattattactgcagctacactatacaagccaccagactactctctatcgtcgtacggagtcggacacggtcaccgtctagcacgaccacgacccaacccngtcgtacc

SEQ ID NO: 92675 - DNA, 516 bp, Homo sapiens
  misc_feature: GYAE6OF01CERSD.18.78.H01.1.454.CMB.1.raw
  modified_base (224)..(224): a, c, t, g, unknown or other
  misc_feature (224)..(224): n is a, c, g, or t
  modified_base (507)..(516): a, c, t, g, unknown or other
  misc_feature (507)..(516): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttangatgtcagtaatcggccctcagggtttctaatcgcttctctggctccaagtctggcaacacggcctcctgaccatctctgggcctccaggctgaggacgaggctgattatactgcagctcatatacaagcagcagcactcaagtcttacggaactgggaccaaggtccaccgtctaggtcacgacccaaggcccaaacccactcgtccactcctcgttaccccacccttcctccaactacctcctaacgtcgacgccggctcgggacctaggccgacagtcgnnnnnnnnnn

SEQ ID NO: 92676 - DNA, 894 bp, Homo sapiens
  misc_feature: GYAE6OF01DPKNS.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctggtttccttgttgctattttaaaaggtgtccagtgtgaggtgcagctggtggagtccgggggaggcgttggtccagccgtcggggggtccctgaaactctcctgtgcagcctcgtgggttcaccttcagtggctctgctatgcacgtcgggtccgccgagggtccgtttaccgggggaaagggtccgtgggtaggttcgggggtttcggtacccggttaagtttaaggaaaggtaccgaaaaaggtccttaaaacgtaaggttaaccgacgaaccgtaggacctaattaagtcgtcgttggaccggttacgggttaaggaaacgggtcgtaacgggtttaccgtaacccggttaccgttacccgtaaacggtaaaacgttaacggtaacgtttaaccgaaaaacggaaaccggtaaacccgggtaaccggttaacgttaccgttaacggaacgtaaaacgtaacggtaaaccgtaaaccggtaacccgttaaaccgggaaaaaccccgggtaacgggaaacccggtaaacccgggtaccggttaccggtttaaacgtttaaaccgttacggttaaaccgttaaacggtaacggtaaacggggttagggttaaacgtttaaaccggttaaggggttttaacggggggttaaacgggttttaacgggttaaccggggtaaaccgggggttaaaaccgggggggggggtttaaacccgttaacccgggtttaaaacccgggg

SEQ ID NO: 92677 - DNA, 501 bp, Homo sapiens
  misc_feature: GYAE6OF01CWKCE.18.78.H01.1.454.CMB.1.raw
  modified_base (487)..(487): a, c, t, g, unknown or other
  misc_feature (487)..(487): n is a, c, g, or t
  modified_base (492)..(501): a, c, t, g, unknown or other
  misc_feature (492)..(501): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggcgagctgattattactgcagctcatactacaagccacagcactctctatgtcttacggaactgggaccaaggtcaccgtctaggtcacgcccaaggcccaacccatcgtcactcctcgttccccaccctcctaccatacctcgtactcgagcgggctggacaggcnagtgnnnnnnnnnn

SEQ ID NO: 92678 - DNA, 130 bp, Homo sapiens; identical to SEQ ID NO: 92615
  misc_feature: GYAE6OF01BUY2C.18.78.H01.1.454.CMB.1.raw
  modified_base (130)..(130): a, c, t, g, unknown or other
  misc_feature (130)..(130): n is a, c, g, or t

SEQ ID NO: 92679 - DNA, 517 bp, Homo sapiens
  misc_feature: GYAE6OF01CXBNE.18.78.H01.1.454.CMB.1.raw
  modified_base (224)..(224): a, c, t, g, unknown or other
  misc_feature (224)..(224): n is a, c, g, or t
  modified_base (438)..(438): a, c, t, g, unknown or other
  misc_feature (438)..(438): n is a, c, g, or t
  modified_base (502)..(502): a, c, t, g, unknown or other
  misc_feature (502)..(502): n is a, c, g, or t
  modified_base (507)..(517): a, c, t, g, unknown or other
  misc_feature (507)..(517): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttangatgtcagtaatcggccctcaggggtttctaatcgcttctctggctccaagtctggcaacacggcctccctgaccatgtctgggcctccgaggctggagggacgagggctagattattactgcagctacatatacaaagcagcagcactcaagttcgttacggaacgtgggaccaaggtccaccgtcgtaggtcacgcccaacggcccaacccnctctcacctctccgttccccaccctcctccactctcgtactggacgcggcgtgaccgaggccgnatggnnnnnnnnnnn

SEQ ID NO: 92680 - DNA, 493 bp, Homo sapiens
  misc_feature: GYAE6OF01A15O3.18.78.H01.1.454.CMB.1.raw
  modified_base (362)..(362): a, c, t, g, unknown or other
  misc_feature (362)..(362): n is a, c, g, or t
  modified_base (422)..(422): a, c, t, g, unknown or other
  misc_feature (422)..(422): n is a, c, g, or t
  modified_base (485)..(493): a, c, t, g, unknown or other
  misc_feature (485)..(493): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaaactcatgatttatgatgtcagtaatcggccctcaggggtttctaatcgcttctctggctccaagtctggcaacacggcctccctgaccatctctgggcctccaggctggaggacgaggctgattatactgcagctcatatacaagcacancactctctatgtcttacggactcgggacaggtcacgtctagcagcccaaggcccaacccntcgcactctcgtccccaccctcctccactctctactgacggcggctcggacaggccacatgcnnnnnnnnn

SEQ ID NO: 92681 - DNA, 309 bp, Homo sapiens
  misc_feature: GYAE6OF01BPG2W.18.78.H01.1.454.CMB.1.raw
  modified_base (269)..(269): a, c, t, g, unknown or other
  misc_feature (269)..(269): n is a, c, g, or t
  modified_base (297)..(309): a, c, t, g, unknown or other
  misc_feature (297)..(309): n is a, c, g, or t
tcagtacgagtatgcacgaccggtgctcgatttagtgtgagtagtttgggtttggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtccacgacccaagcccaaacccatgtcactctcgtcccgccctctccatactcgtacngagcgggctggacaagggcactagtagnnnnnnnnnnnnn

SEQ ID NO: 92682 - DNA, 572 bp, Homo sapiens
  misc_feature: GYAE6OF01CGCJH.18.78.H01.1.454.CMB.1.raw
  modified_base (224)..(224): a, c, t, g, unknown or other
  misc_feature (224)..(224): n is a, c, g, or t
  modified_base (466)..(466): a, c, t, g, unknown or other
  misc_feature (466)..(466): n is a, c, g, or t
  modified_base (564)..(564): a, c, t, g, unknown or other
  misc_feature (564)..(564): n is a, c, g, or t
  modified_base (566)..(572): a, c, t, g, unknown or other
  misc_feature (566)..(572): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaatcatgatttangatgtcactaatcggccctcgaggggtttctaatcgcttctctggctccaagtctggcaacacggcctccctgacctatctctcgggctccgaggctggaggacgaggctgtattatactgacagctacatactacaacgcaaccagccactctactatcgttcgttacggaacgtcgggaacctaacggtccacccggttccgtacggtccaacggacccctaaacggccccaaccccgtnttcgtacctacgttcctccgttcccccgcccttccgtacctacttacctcgtacgtcggacggcggtctacgggacaacgggtccacagtacgcgtancnnnnnnn

SEQ ID NO: 92683 - DNA, 569 bp, Homo sapiens
  misc_feature: GYAE6OF01BRPDX.18.78.H01.1.454.CMB.1.raw
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccggggaggcttggtccagcctggggggttcctgaaactctcctgtgcagcctctgggttcaccttcagtggctctgctatgcactgggtccgccaggcttccggggaaagggctggagtgggttggccgtattagaagcaaagctaacagttacgcgacagcatatgctgcgtcggtgaaggcaggtcaccgtctccagaaatgattacaaagaacacggacgtatactgacaaatagaacgacgaccgtacgaaaccgaggaacgacggacgtagtattactagtactagacgaggtaggtattacgagttaggggtagttagtacggacggtaaacggggggtacgtaaccgg

SEQ ID NO: 92684 - DNA, 515 bp, Homo sapiens
  misc_feature: GYAE6OF01C9SMW.18.78.H01.1.454.CMB.1.raw
  modified_base (406)..(406): a, c, t, g, unknown or other
  misc_feature (406)..(406): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (452)..(452): a, c, t, g, unknown or other
  misc_feature (452)..(452): n is a, c, g, or t
  modified_base (508)..(508): a, c, t, g, unknown or other
  misc_feature (508)..(508): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggcctcgtaggggtttctaatcgcttctctggctcaagtctgacaacacgcctcctgaccatctctgggctccgaggctgaggacgnggctgatttatactgcngctcatanacaagcaccagcactctactntgtcttcggacgtggaccaaggtcaccggtctaggtcacgtcccaagcccaacccnctgtacc

SEQ ID NO: 92685 - DNA, 627 bp, Homo sapiens
  misc_feature: GYAE6OF01CRVWW.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttcctgttgctatttaaaggtgtccagtgtgaggtgcagctggtggagtccgggggaggcttggtccagccgtggggggtccctggaaactctcctgtgcagcctctggttcaccttcagtggctctgctatgcacgtgggtcccgccgaggccgttaccggggaaaggcgtgggaggtgggttggaccgttattaggaagacaaagctaacgagttacgacgacagcatatgctgcgtgggtagaaaggcgtacggttcgaccgtcctaccaagtaaatgtaattaacgaaagaacgacggtacgtatcgtagacaatacgaacaacgaccgtaacggaaaaccggacggaaccgacggtaccgtagtacgttaacgtgtaacgtagaacgtagggtagtaacgttaacgtaggtttaggggtagttacgtacgggacgggtaaaccggggggtacgtacgtacgg

SEQ ID NO: 92686 - DNA, 614 bp, Homo sapiens
  misc_feature: GYAE6OF01DCR9Q.18.78.H01.1.454.CMB.1.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatcctcctgcactggaaccngcagtgacgttggtgttataactntgtcttcctggtaccaacagccacccaggacaaagcccccaaatcatgatttatgatgtcagtaactccggccctcgtaggggtttctaatcgtcttctctgctcaagtcgtcgacaccgacggtccctccctcgacctatcctcgtcgggcctccgaggctggaggacgaggctagatttactactgcagtcctactaatataacaacgtcaacgacgtagccgtaacttacgtaacgttccgttaccgggaaaccggtacggggaacccgtaacggtacccgtaacccgttaccgtaacggtacccgaaccggaaccccgtaacgggaacccccaacccctacgtccgtccgttacccg

SEQ ID NO: 92687 - DNA, 555 bp, Homo sapiens
  misc_feature: GYAE6OF01BWNCJ.18.78.H01.1.454.CMB.1.raw
  modified_base (307)..(307): a, c, t, g, unknown or other
  misc_feature (307)..(307): n is a, c, g, or t
  modified_base (447)..(447): a, c, t, g, unknown or other
  misc_feature (447)..(447): n is a, c, g, or t
  modified_base (545)..(545): a, c, t, g, unknown or other
  misc_feature (545)..(545): n is a, c, g, or t
tcagtacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggaccaaacgcccccaaactcatgatttangatgtcagtaatcggcctcgtagggtttctaatcgcttctcgtcggctcaagtctggacaacaccggcctccctgacccatcctcgtcgggcctccgaggctaggaggacgaggcttgaatttattacgtgactagctanataatacaagacagacagcactctagtcgttacggaacgtcgggaacctaaggtccaccgtcgtacggtaccacgacccgaacggaccccaaacccgntcgtctaccg

SEQ ID NO: 92688 - DNA, 603 bp, Homo sapiens
  misc_feature: GYAE6OF01CXO7J.18.78.H01.1.454.CMB.1.raw
  modified_base (589)..(589): a, c, t, g, unknown or other
  misc_feature (589)..(589): n is a, c, g, or t
  modified_base (597)..(600): a, c, t, g, unknown or other
  misc_feature (597)..(600): n is a, c, g, or t
  modified_base (602)..(603): a, c, t, g, unknown or other
  misc_feature (602)..(603): n is a, c, g, or t
tcagtacgagtatgcacgaccggtgctcgatttagtgtgagtagtttgggtttgggggctttgcctgggcccagtctgccctgactcaacctgcctccgtgtctggtctcctggacagtcgatcaccatctcctgcactggaaccagcagtgacgttggtggttataactatgtctcctggtaccaacagcacccaggacaaacgcccccaaactcatgatttatgatgtcactaatccggccctcgaggggtttctaatcgtcttctctggctccaagtctggcaacacgcctcctgaccatctctgggcctccgaggcctgacggacgaggctgtattagttactgacacgctacattaatacaagccaaccagctactctctatcgtcttcgacgtacggaccgtaacgtacgcccgttaccgtacgtacgacctacccgaacccggacccgaacccccacctcgtaccgtacctccgttcccttcccgtaccccttaccctacccgtacctaccgttacccgttacctcggtaacggtccgggtccggtacggaccgtaaccgggccgtcgtaacgtaccgtagntacgtcgnnnngnn

SEQ ID NO: 92689 - DNA, 972 bp, Homo sapiens
  misc_feature: GYAE6OF01A8E1D.18.78.H01.1.454.CMB.1.raw
tcagtacgagtatgcacgaccggtgctcgatttagtgtgagtagtttgggtttgggggctctgggagaggagctccagccttgggattcccaactgtctccactcggtgatcggcactgaatacaggagactcaccatggagtttgggctgagctgggttttccttgttgctattttaaaggtgtccagtgtgaggtgcagcgtggtggagtccgggggaggcttggtccagccgtgggggtccctgaaactctcctgtgcacgcctctgggttcaccttcagtggctctgctatgcacgtcgggtcccgccgacgggtccgtttacccgggggaaaaggggtccgttggggtagggttcgggggttttcgggacccggttaagtttaacgggaaacggacctaaaaaggtaccttaaaacgtaacggtttaaccggaccggtaaaccgaacggacctaacgttaacttcggaccgttcgggtaccgggtttaccggggtaagggtaaaaacggggccgtaacggggtttacccgtaaccccggttaccgttacccgtaaaggtaaaacgttacggtaaacgtttaaccgaaaaaacggtaaacccggtaaccggggtaaccggttaacgttaccgtaaggtaaccgtaaaaacgttaacggaaaacccgtaacgggtaacccgttaaaccgggaaaaaccccgggtaaacggggtaaacccggtaaacccggggttacccgggttaacgggtttaaaccgtttaaccggttaacggtttaaaccgttaaaccgggtaaaccgttaaacgggggttaacgggttaaacgttttaaccgggttaaggggtttttaacggggggggttaaacggttttaaccgggttaacccgggggtaaacccggggggttaaaaacccggggggggggtttaaacccgtttaaacccgggttaaaccgggttaaacccgggg

SEQ ID NO: 92690 - DNA, 511 bp, Homo sapiens
  misc_feature: GYAE6OF01BU5CI.18.78.H01.1.454.CMB.1.raw
  modified_base (363)..(363): a, c, t, g, unknown or other
  misc_feature (363)..(363): n is a, c, g, or t
  modified_base (453)..(453): a, c, t, g, unknown or other
  misc_feature (453)..(453): n is a, c, g, or t
  modified_base (508)..(508): a, c, t, g, unknown or other
  misc_feature (508)..(508): n is a, c, g, or t
tcagtacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaagcccccaaatcatgatttatgatgtcactaatcggccctcgaggggtttctaatcgcttctctggctcaagtctggcaacncggcctccctgaccatctcgtcgggtctccgaggctgacggacgaggctgattatactgcagctcatatacaagccaaccagctactctntatgtcttcggactcggaccaggtccaccgtctagtcacgccaagcccaacccgntcg

SEQ ID NO: 92691 - DNA, 543 bp, Homo sapiens
  misc_feature: GYAE6OF01BYGW3.18.78.H01.1.454.CMB.1.raw
  modified_base (246)..(246): a, c, t, g, unknown or other
  misc_feature (246)..(246): n is a, c, g, or t
  modified_base (341)..(341): a, c, t, g, unknown or other
  misc_feature (341)..(341): n is a, c, g, or t
  modified_base (435)..(435): a, c, t, g, unknown or other
  misc_feature (435)..(435): n is a, c, g, or t
  modified_base (536)..(536): a, c, t, g, unknown or other
  misc_feature (536)..(536): n is a, c, g, or t
  modified_base (538)..(539): a, c, t, g, unknown or other
  misc_feature (538)..(539): n is a, c, g, or t
  modified_base (541)..(543): a, c, t, g, unknown or other
  misc_feature (541)..(543): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaaactcatgattttatgatgtcagtaatcggccctnaggggtttctaatcgcttctctggctccaagtctggcaacacggcctccctgaccatctctgggctccaggctgaggacgaggctgattattacngcagctcatatacaagcagcagcactacagtcttacggaacgtcgggaaccaaggtcacccgtcgtaacggtcagaccccaaggccccaacccncgtcgtaccacttcttaccgttccccacccttccctacccacttacctccgtacgtcggacggtccggctcgggccaaagggcccgcagtaggcagcacgncnncnnn

SEQ ID NO: 92692 - DNA, 554 bp, Homo sapiens
  misc_feature: GYAE6OF01COFN7.18.78.H01.1.454.CMB.1.raw
  modified_base (456)..(456): a, c, t, g, unknown or other
  misc_feature (456)..(456): n is a, c, g, or t
  modified_base (545)..(547): a, c, t, g, unknown or other
  misc_feature (545)..(547): n is a, c, g, or t
  modified_base (549)..(554): a, c, t, g, unknown or other
  misc_feature (549)..(554): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggcctctaggggtttcaatcgtcttctctcggctcaagtctggaccaacaccggcctccctgacctatctcgtgggcctccgaggctggaggacgagctgtattattacgtgcagctacatatacaagcaacagcactctctatcgttctacggtaacgtcgggaacctaaggtcctaacccgtcgtaacggtcacgacccaacggaccccaaccctntcgtaccacttccttcgttccccacccttcctacctactacctccgtactcggacggtccggtcgtcggacgaacggtccgatagtcgnnncnnnnnn

SEQ ID NO: 92693 - DNA, 510 bp, Homo sapiens
  misc_feature: GYAE6OF01C3NXZ.18.78.H01.1.454.CMB.1.raw
  modified_base (340)..(340): a, c, t, g, unknown or other
  misc_feature (340)..(340): n is a, c, g, or t
  modified_base (500)..(510): a, c, t, g, unknown or other
  misc_feature (500)..(510): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaaatcatgatttatgatgtcactaatcggccctcaggggtttctaatcgcttctctggctccaagtctggcaacacggcctcctgaccatctctgggcctccgaggctgaggacgaggctgattattacngcagctcatatacaagcagcagcactcaagtcttcggaacgtgggaccaaggtcacgtctaggtcacgcccaacggcccaaccccactcgtctactcctcgttccccaccctcctccattacctcgtactggacgcggtcgtaggccaggccgcatacgnnnnnnnnnnn

SEQ ID NO: 92694 - DNA, 807 bp, Homo sapiens
  misc_feature: GYAE6OF01EDHO7.18.78.H01.1.454.CMB.1.raw
  modified_base (269)..(269): a, c, t, g, unknown or other
  misc_feature (269)..(269): n is a, c, g, or t
  modified_base (310)..(310): a, c, t, g, unknown or other
  misc_feature (310)..(310): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaaccagcagtgacgttggtgttataactatgtctctgtaccaacngcacccaggacaaacgcccccaaactcactgtaattttagngtattgtactaagtaacgtcccggtcccttcggtaacggggttttactaacgtcgtacttccgtcgtcggtcctaccgaagttcgtaggaccaaaccgtaccggtcccttacccgtacgaccctaacgttcctacggttcggggtccctaccggacgggtaccgtacgggaaacgggaccggtacgggtacgttaggttaacgttttaacgttaccgtacgtaccgtaacgtccttaacgtaacttaacgtaacgaaacgggactaacggaccgtaacgtaccgttaaaccgttaaccggttaaacggtttcccggttttaaacccgggaaaccgggttaccgggggtaaaaccccgttaaaccggggttaccccttaaaccccgggtttacccggttaaacggggttaacccaaaccccgggttaaacccccgaaaacccgggtaaccccccgtaaaaccccccgttacggttaccggttaccccttaaaccccgg

SEQ ID NO: 92695 - DNA, 640 bp, Homo sapiens
  misc_feature: GYAE6OF01AE6UJ.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccaggccgtggggggtccctgaactctcctgtgcagcctcgtgggttccaccttcagtggctctgctatcgcactcgggtccgccgaggcgttaccggggaaagggcctgggaggttggggttcggacccggttagttaaggaacgacaaaagcctaaacgagttaacgcgtaacgagcataagtgctgcgtcggtagaaggcgtaggttccaccgtctaccaagaaatgattacaaagactacggactatctagacaagtagtaaacacgaccgtaacggaaaacccggacggaaccgaccggtaccgttacgtaattaccgtagtaaccgtagaccgtagggtagtaattacggaggtttaggggagttacgtacggaagggaaaccggggggttactacggtaaccggg

SEQ ID NO: 92696 - DNA, 562 bp, Homo sapiens
  misc_feature: GYAE6OF01AVLCJ.18.78.H01.1.454.CMB.1.raw
  modified_base (552)..(552): a, c, t, g, unknown or other
  misc_feature (552)..(552): n is a, c, g, or t
  modified_base (554)..(562): a, c, t, g, unknown or other
  misc_feature (554)..(562): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgccccccaaaactcatgatttatgatgtcagtaatccggccctcgtaggggtttctaatcgcttctctggctccaagtctggcaacaccggcctccctgaccatctcgtcgggcctccgaggctaggaggacgaggctagatttattactgcagctcaatactacaagcagcagcactacaagttccgtacgggaactcgggaacctaaggtccaccggtcctaggtccacgcccgaacggccccaaacccctcgtacgtccaccttcgtccgttccccgccccttcccgcctaacttcctaccgtactcggacggccgggctacggaccgaagggccgtacagtcgncnnnnnnnnn

SEQ ID NO: 92697 - DNA, 655 bp, Homo sapiens
  misc_feature: GYAE6OF01DYHG0.18.78.H01.1.454.CMB.1.raw
  modified_base (303)..(303): a, c, t, g, unknown or other
  misc_feature (303)..(303): n is a, c, g, or t
  modified_base (641)..(641): a, c, t, g, unknown or other
  misc_feature (641)..(641): n is a, c, g, or t
  modified_base (646)..(646): a, c, t, g, unknown or other
  misc_feature (646)..(646): n is a, c, g, or t
  modified_base (649)..(650): a, c, t, g, unknown or other
  misc_feature (649)..(650): n is a, c, g, or t
  modified_base (652)..(652): a, c, t, g, unknown or other
  misc_feature (652)..(652): n is a, c, g, or t
  modified_base (654)..(654): a, c, t, g, unknown or other
  misc_feature (654)..(654): n is a, c, g, or t
tcagtacgagtatgcacgaccggtgctcgatttagtgtgagtagtttgggtttgggggctttggcctcgggcccacgtcgtgtccctggacttcaaccttgcctccgtgtcgtgggtctcctggacagtcgatccaccatctcctgcactggaccagtcagtgacgttggttaggttataactatgtctcctggtaccaacagcgacccgaggccaaaggcccccaaaactcgaatgatttagtcgatgtcagtaactcggccctcaggggtttcaagtcgcttctctggctacagtctgganaacacggccctccgtcgacctagtcctcgtaggggcctccgagggcgtggaggaccgaggtctgtaatttagttacgtgacgtggcctacaataatacaagccaacacgccacgtcgtcgtatcgttacgttacggaaccgttgggaacccaacggttacctaaccccgttaccgtaacgggtcaaaccgtaccccgaaacggtcccccaaaaccccctagttacggtacccactttacccgtcgttaccccccgccccgttaccctaccgtaacgttacccttccggttaacgtcggaaccggtccgggtcgtacgggacgacggtcgactagcgancgtancanncntng

SEQ ID NO: 92698 - DNA, 488 bp, Homo sapiens
  misc_feature: GYAE6OF01DX018.18.78.H01.1.454.CMB.1.raw
  modified_base (247)..(247): a, c, t, g, unknown or other
  misc_feature (247)..(247): n is a, c, g, or t
  modified_base (423)..(423): a, c, t, g, unknown or other
  misc_feature (423)..(423): n is a, c, g, or t
  modified_base (441)..(441): a, c, t, g, unknown or other
  misc_feature (441)..(441): n is a, c, g, or t
  modified_base (460)..(460): a, c, t, g, unknown or other
  misc_feature (460)..(460): n is a, c, g, or t
  modified_base (480)..(488): a, c, t, g, unknown or other
  misc_feature (480)..(488): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaaactcatgattttatgatgtcagtaatcggccctnaggggtttctaatcgcttctctggctccaagtctggcaacacggcctcctgaccatctctgggctccaggctgaggacgaggctgatttatactgcagctcatatacaagcagcagcactcaagtcttcggaactgggaccaagggtcaccgtctaggcacgcccaggccaacccnctctcactctcgttcccnccctcctccatctcgtacngacgcggctgcagcgcatgnnnnnnnnn

SEQ ID NO: 92699 - DNA, 630 bp, Homo sapiens
  misc_feature: GYAE6OF01D7YFA.18.78.H01.1.454.CMB.1.raw
  modified_base (225)..(225): a, c, t, g, unknown or other
  misc_feature (225)..(225): n is a, c, g, or t
  modified_base (615)..(615): a, c, t, g, unknown or other
  misc_feature (615)..(615): n is a, c, g, or t
  modified_base (627)..(630): a, c, t, g, unknown or other
  misc_feature (627)..(630): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttangatgtcagtaatcggccctcgaggggttcttactacgtcttcttctcgtcgtcctaacgtacgtcggtcgaaccacggacccgtcccctcgaccgaactctcctcgggtcgtccctacggacgtcgtagggacggagggtctacggtatttaatttactcgcacggctactactaattacaaagaccgagacgacgacacctactaacgtactttcgggaaacgtacgggaccgaacgtcgtacccgttcccgtacggtacgacgacccgaaccgggacctaaccccacctagttccgactacccttcgttccccgtaaccctccctacctactaccttccggtcttacgggacgtcgggccgtggacccgtaaggcccggctaataggntgcactgagtcnnnn

SEQ ID NO: 92700 - DNA, 550 bp, Homo sapiens
  misc_feature: GYAE6OF01B99D7.18.78.H01.1.454.CMB.1.raw
  modified_base (350)..(350): a, c, t, g, unknown or other
  misc_feature (350)..(350): n is a, c, g, or t
  modified_base (535)..(535): a, c, t, g, unknown or other
  misc_feature (535)..(535): n is a, c, g, or t
  modified_base (540)..(542): a, c, t, g, unknown or other
  misc_feature (540)..(542): n is a, c, g, or t
  modified_base (544)..(550): a, c, t, g, unknown or other
  misc_feature (544)..(550): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcgaggggtttctaatcgcttctctggctccaagtctggcaacgacggcctccctgaccatctctgggcctccaggctggaggacgaggctgtattatactgcagctnatataacaacgcaaccagcactctctatcgttcgttacggaacgtcgggaccaaggtccaccgtcctaggtccacgacccgaacggccccaacccctactcgtactactccttcgttcccccgccctccctacctacttaccgttcgtacctcggacggtccgggtctcgggacgaacggccganagtgnnngnnnnnnn

SEQ ID NO: 92701 - DNA, 509 bp, Homo sapiens
  misc_feature: GYAE6OF01D8J0U.18.78.H01.1.454.CMB.1.raw
  modified_base (248)..(248): a, c, t, g, unknown or other
  misc_feature (248)..(248): n is a, c, g, or t
  modified_base (310)..(310): a, c, t, g, unknown or other
  misc_feature (310)..(310): n is a, c, g, or t
  modified_base (496)..(496): a, c, t, g, unknown or other
  misc_feature (496)..(496): n is a, c, g, or t
  modified_base (502)..(509): a, c, t, g, unknown or other
  misc_feature (502)..(509): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaaagcccccaaaactcatgattttatgatgtcactaatccggccctnaggggtttctaatcgcttctctggctccaagtctggcaacacggcctccctgacccatcctntcgggctccaggctgaggacgaggctgatttattactgcagctcatatacaagcaccagcactctctatgtcttcgaactgggacaaggtcacgtcctaggtccacgcccaaggcccaaccctctcgtcactcctcgttcccgccctcctcctactactcgtactcgagcggctcggcaaggccgnactgcnnnnnnnn

SEQ ID NO: 92702 - DNA, 519 bp, Homo sapiens
  misc_feature: GYAE6OF01A5EH0.18.78.H01.1.454.CMB.1.raw
  modified_base (509)..(511): a, c, t, g, unknown or other
  misc_feature (509)..(511): n is a, c, g, or t
  modified_base (513)..(513): a, c, t, g, unknown or other
  misc_feature (513)..(513): n is a, c, g, or t
  modified_base (516)..(519): a, c, t, g, unknown or other
  misc_feature (516)..(519): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaaactcatgatttatgatgtcagtaatcggccctcgaggggtttctaatcgcttctctggctccaagtctggcaacacggcctccctgaccatcctcgtgggctccaggctggaggacgagctgattattactgcagctacatatacaagcaccagcactctctatgtctcggaactggaccagtccacgtctaggtcacgcccaagcccaacccactcgccactcctcgttccccacccttcctcctacttacctcgtactcgacggtccgggctcgggacgaacggccgacaagtgnnncngannnn

SEQ ID NO: 92703 - DNA, 174 bp, Homo sapiens
  misc_feature: GYAE6OF01EN7P5.18.78.H01.1.454.CMB.1.raw
  modified_base (174)..(174): a, c, t, g, unknown or other
  misc_feature (174)..(174): n is a, c, g, or t
tcagtacgagtatgcacgaccggtgctcgatttagtgtgagtagtttgggtttgggggaagaggaagactgacggtccccccaggagttcaggtgctgggcacagcggccctgggctgcctggtcaaggactacttcccatactcgtactgagcgggctggcaaggcgcatagn

SEQ ID NO: 92704 - DNA, 687 bp, Homo sapiens
  misc_feature: GYAE6OF01C581D.18.78.H01.1.454.CMB.1.raw
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtgttataactatgtctctaggtaccaacagccaccaggacaaacgacccccaaactcatgtaatttatgatgtactaactaacgtccggcccttcgtaggggttttctaaagtccgtctttctcgttcggcttaccgaaagttccgtacggaccaaaccgaccggtcccttccccgtacggaaccctaacttccgttcgtcgggtaccttcccgagggtccgtaggaacgggaccggaggtactacggtaatttaacgtttacgtacgactacgacttacgtaattaacgtaacgaaacgtcccaaccgaacgtcctaaccttcttacctaagttcgttaccgttacggaaccgttacgggaacccgtaacggtacccgtacccggtaccgttaacggtccgtaaaccggacccgaaccggacccctaaccccacgttccgtaccc

SEQ ID NO: 92705 - DNA, 640 bp, Homo sapiens
  misc_feature: GYAE6OF01C4BYO.18.78.H01.1.454.CMB.1.raw
  modified_base (356)..(356): a, c, t, g, unknown or other
  misc_feature (356)..(356): n is a, c, g, or t
  modified_base (624)..(624): a, c, t, g, unknown or other
  misc_feature (624)..(624): n is a, c, g, or t
  modified_base (627)..(627): a, c, t, g, unknown or other
  misc_feature (627)..(627): n is a, c, g, or t
  modified_base (631)..(631): a, c, t, g, unknown or other
  misc_feature (631)..(631): n is a, c, g, or t
  modified_base (635)..(636): a, c, t, g, unknown or other
  misc_feature (635)..(636): n is a, c, g, or t
  modified_base (638)..(640): a, c, t, g, unknown or other
  misc_feature (638)..(640): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagccaccaggacaaacgcccccaaactcatgatttatgatgtcagtaatccggccctcgtaggggtttctaatcgtcttctctggcctcaagtctggacaacgacggcctccctgaccatcctcgtcgggcctccgaggcgtggaggacgaggctagtattattacngcagctacaatataacaagcagacagccactacaacgttcgtacgggaactcgggaacctaacgggtccaacccggttcgtaacggtaccgaaccgaccccgaaaccggacccctaaacccctacgtcgttacccacctttaccgttaccccgtttacccccaccccttacccttacccgtaactttaaccccgtaccggttaccgtacgggtaccggtccgggtaccttacggggaccgtaaacggggccgaaccggtaatacgggnacncgancacnncnnn

SEQ ID NO: 92706 - DNA, 750 bp, Homo sapiens
  misc_feature: GYAE6OF01B93L0.18.78.H01.1.454.CMB.1.raw
  modified_base (169)..(169): a, c, t, g, unknown or other
  misc_feature (169)..(169): n is a, c, g, or t
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagcttgggttttccttnttggggtcttaattttaaaaggtgtccagtgtgaggtgcagctgggtggaggtccgggggaggcgttgggtccaggccggtcggggggtccctaggaaacctctcctgtcgcagcctcgtgggttccaccttcagtggctctgctatcgcacgtcgggtccgccgaggtccgttaccggggaaagggcgtgggacggttggggttcggccgttaagttaggaacgacgaaagtactaaacgtacgttacgacgaacagactaatacgtgcgtggtcggtcggtaggaacgggcgtacggttaccgaccgttacctaccgaaagtaaacgtacgtaacgtttaacgaaacgaaacgacggtacgtaatacgtacgactaaagtacgtaaaccgaacgtaaccgtaaacggaaaacccggtaacgggaacccgtaaccggggtaccgtaacggtttaacttaacgttacgttaaccgtaacggtacggtaagggttacggtaacgttaccgttaagggtttagggggtaacgtttacggtaccgggtaacgggggttaaaccgggggggtacttaaacccggg

SEQ ID NO: 92707 - DNA, 648 bp, Homo sapiens
  misc_feature: GYAE6OF01CQCFB.18.78.H01.1.454.CMB.1.raw
  modified_base (214)..(214): a, c, t, g, unknown or other
  misc_feature (214)..(214): n is a, c, g, or t
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (311)..(311): a, c, t, g, unknown or other
  misc_feature (311)..(311): n is a, c, g, or t
tcagtacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctcgccctgactcaacctgcctccgtgtctgggtcctcctggacagtcgatcaccatcnctgcactggaaccngcagtgtacgttggtgttataactntcgtctcctggtacaacagccaccaggacaaacgaccccaaactcatgtattatgatnacactaactcggcctacgtagggtttctaagtctcttctcgtcggctacgtaacgtctcggaacaaccgacggtcccttacccgacgtacccacttcctcgttacgggcctccggaaggtccgagggaacggaacgaggtacgttaggtaatttaagttacccgtgaccgtagtctactaacttaacgtaacgaacgaccaacccgagtaccaacttcctacttacgttgtacgtttaccggaaacgggttaccgaaaccgttaaccggtactaccccggttacgttaccggacgtaacccgacccgaaacggcccccaaaccctcgtacgttaccc

SEQ ID NO: 92708 - DNA, 891 bp, Homo sapiens
  misc_feature: GYAE6OF01D0KXS.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagcgttgggttttccttgttgctattttaaaggtgtcagtgtgaggtgcagcgtggtgggaggtccggggggagtcgttggtccagccgtggggggtccctagaaacctctcctgtcgcagcctcgtcgggttcaccctttcgaggttcggccttcgtgtctaagtcgacctacggttcggggtccccgaccgacgggtaccggtttaccgggggaaacgggtcgtagggtagggttggggttcgggaccgttaagttaaggaaacgtaccgaaaacgtactaaacgtaacggtttaaccggacgaacacggactaattagtcgcgttggacggttacgggtaaggaaacgggtcgtaacggtttaccgtaacccgttccgtaccgaaacggtaaagttacgtaacttaaacgaaaaccggtaaaccgtaacgggttacgtaacgttaccgtacgtaacgtaaacgtaacgaaacgtaaccgtaacccggtaaaccggaaaaacccgggaacggtaaacccggtaaccggggttaacccggttaaggtttaaaccgtttaaccggttaacgttaaaccggtaaacggtaaccgggtaaggggttaagggtttaacgtttaaacgggttaacggggtttttaggggggttaaacgggtttaacgggttaacccgggggttaaaccgggggttaaaaacccggggggggtttaaacccgttaaccgggtttaaaaccccggg

SEQ ID NO: 92709 - DNA, 851 bp, Homo sapiens
  misc_feature: GYAE6OF01EQNLC.18.78.H01.1.454.CMB.1.raw
  modified_base (195)..(195): a, c, t, g, unknown or other
  misc_feature (195)..(195): n is a, c, g, or t
  modified_base (227)..(227): a, c, t, g, unknown or other
  misc_feature (227)..(227): n is a, c, g, or t
  modified_base (406)..(406): a, c, t, g, unknown or other
  misc_feature (406)..(406): n is a, c, g, or t
tcagtacgagtatgcacgaccggtgctcgatttagtgtgagtagtttgggtttgggggctttgcctgggcccagtctgccctgactcaacctgcctccgtggtctgggtctcctggacagtcgatcaccatctcctgcactgggaaccagcaggtgacgttggtggttaataactagtgtctcctggtaccaacngcaccaggcaaacgccccaaatcatgatttangatgtcactaatccggcctcgtagggttcgtaactcgcttctcgtcggctctaacgtcgtcgacgaaacctacggccctcccctagtaccgtaactccgttacgtacgggggtaccttacccgagggtccgtaggtaccggggtaacgaagggtcctacgttaaagtttactttaccgngtccgaacgtcctacgtaacttaacttaacaaacgaccaaacccggtataccgtaacctttaccttaccgtttaacgttacggtttacccggtttaacggggtaaacccggttgggggtaaaccccgtaaacgggttacccgtaacccccgggttaaccggtttaacgggtaccgtaacccggtaccccggtaaaacccgggtacccctaaaccccccgttaacgttaccgtttaccctaacccgttccctttaacccgggtttacccccctaacccccggttcccctttaaccccgttaaagtttaccccgttaccggtttaaccggtacggggttaccgggggttacccggggtaccgggttcgggggaaacccggtaacggggtaccccgggtaaactacgggttaacgcgtagtacccgtcgtactacgacgcgtacggac

SEQ ID NO: 92710 - DNA, 684 bp, Homo sapiens
  misc_feature: GYAE6OF01CEI0Y.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagccgtgggggtccctgaaactctcctgtgcacgcctcgtgggttcaccttcgagtggcctctgtctatgcacgtgggtcccgccgacggtccgttaccggggaaaggcgtggaggtgggttcggccgtagttagaagacgaaagctaaagagttacgcgacagacatatgctgcgtcggtagaaggcgtaggttcaccgtctaccgaagaagtagaattaacaaagtaaccgaacggtcgtaacgtctagaacaaatacgaaacacgacctaacggaaaaccggtacggaaccgaacgggtaccgttagttaaccgttacgttacgtaaccgtaaggaaccgtaagggttaggttaaacgtttacggttaagggttttagggggtaagtttaacgggtaaccgggtaaccgggggttaaaccgggggggttaacctaaacgggttaacccggg

SEQ ID NO: 92711 - DNA, 821 bp, Homo sapiens
  misc_feature: GYAE6OF01C85NG.18.78.H01.1.454.CMB.1.raw
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagcttgggttttccttgttgctattttaaaaggtgtccagtgtgaggtgcagctgggtggaggtccggggggaggcttggtccgagccgtcgggggtccctggaaactcgtcctgtcgcacgcctcgtgggttcctaccttcagtggctctgtctatgcacgtcggggtcccgccgacgggtccgttaccggggaaagggtccggtagggagggtttggggttcgggtacccggttaagtttaaggaaacggacgtaaaacggtaccgttaaaacgtaacggtttaaccgaccggaacaacggacctaagtaagtcggtcgttacggccgggttaacgggttagggaaacggggtaccgtaaccgggtttaccgtaacccggttaccgtaacccgtaaacggtaaaacgttaacggtaacgtttaaacgaaaacggaaaccgtaaccgggttaccgttaacgtaccgttaacggaactaaacgttaacgaaaccgtaacggtaaccgtaaaccggaaaaccggaaccgggaaaccgtaccgggtaccgttacgttaacgttacgtacgttaacgtaacgaacggtaaggttaggtaacgtttaacggtaggtttaggggttaacgttacggttacggaacggggtaaaccggggggtacgttaaacggg

SEQ ID NO: 92712 - DNA, 535 bp, Homo sapiens
  misc_feature: GYAE6OF01BEEKI.18.78.H01.1.454.CMB.1.raw
  modified_base (379)..(379): a, c, t, g, unknown or other
  misc_feature (379)..(379): n is a, c, g, or t
  modified_base (525)..(525): a, c, t, g, unknown or other
  misc_feature (525)..(525): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcaccaggcaaacgcccccaaactcatgatttatgatgtcagtaatccggccctcgaggggtttctaatcgcttctctcggctccaagtctggcaacacggcctcccngaccatctctcgggctccgaggcctggacggacgaggcttgattattactgcagctcaatataacaagcagcagcactcgaagtcgttacggacgtcgggaaccaagggtccaccgtccgtaggtccagcccgaacgcccaacccnctgtctaccg

SEQ ID NO: 92713 - DNA, 687 bp, Homo sapiens
  misc_feature: GYAE6OF01BPBYP.18.78.H01.1.454.CMB.1.raw
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatcctcctgcactggaaccagcagtgacgttggtggttataactatgtctctggtaccaacagcaccaggacaaacgcccccaaactcatgtatttatgatgtcactaactcggccctgtagggtttctaatcgtcttctctgctacagtcgtgacaacgacgccctccctacgacctatctcgtcgggcctccgaggtcgtaggacggacgacggtctagtactttaacttacgtgaccgtacgtccgttactaagttaactaaccgaaacgacctaacccgacgtaccctaaccgtttccttacctttacgttccgtttaccggtttaccgggtaaaccggttacggggaaaccccgttaaacgggttaccccgtaaccccggtttcccggtaaaccgggttacccgaaacccggtaccccccggaaaacccgggtaaccccccaaaacccccgttaccgttaccggttaaccccc

SEQ ID NO: 92714 - DNA, 628 bp, Homo sapiens
  misc_feature: GYAE6OF01AMAJ0.18.78.H01.1.454.CMB.1.raw
  modified_base (227)..(227): a, c, t, g, unknown or other
  misc_feature (227)..(227): n is a, c, g, or t
  modified_base (291)..(291): a, c, t, g, unknown or other
  misc_feature (291)..(291): n is a, c, g, or t
  modified_base (300)..(300): a, c, t, g, unknown or other
  misc_feature (300)..(300): n is a, c, g, or t
  modified_base (321)..(321): a, c, t, g, unknown or other
  misc_feature (321)..(321): n is a, c, g, or t
  modified_base (620)..(620): a, c, t, g, unknown or other
  misc_feature (620)..(620): n is a, c, g, or t
  modified_base (623)..(623): a, c, t, g, unknown or other
  misc_feature (623)..(623): n is a, c, g, or t
tcagtacgagtatgcacgaccggtgctcgatttagtgtgagtagtttgggtttgggggctttgcctgggcccagtctgccctgactcaaacctgcctccgtgtctgggtctcctggacagtcgatcaccatctcctgcactggaaccagcagtgacgttggtggttataacctatcgtctcctggtaccaacagcacccaggcaaacgcccccaaatcatgatttanggatgtcactaatccggccctcgaggggtttctaatcgcttctctggctccaagtctggcaacncggcctccngaccatctcgtcggcctccgnggctggacggacggaggtctagtaactttacttacgtgcagctacatactacaacgcaccacgctactcttctagtcgtacgttaccggaacgtcgggaaccctaagggttcccacccggttaccgtacggtaccaacggtccccgaaacggaccccaaaccccgtcttccggttaccaccttccgttacccgtttacccccaaccccttccccgtacccgtaccttaccttaccgttaccgtaggaccggtccgggtactcgggaccgaacggccgtacgtaactcgcacgtcgcacntcngtgcg

SEQ ID NO: 92715 - DNA, 536 bp, Homo sapiens
  misc_feature: GYAE6OF01EDQPI.18.78.H01.1.454.CMB.1.raw
  modified_base (439)..(439): a, c, t, g, unknown or other
  misc_feature (439)..(439): n is a, c, g, or t
  modified_base (455)..(455): a, c, t, g, unknown or other
  misc_feature (455)..(455): n is a, c, g, or t
  modified_base (495)..(495): a, c, t, g, unknown or other
  misc_feature (495)..(495): n is a, c, g, or t
  modified_base (531)..(531): a, c, t, g, unknown or other
  misc_feature (531)..(531): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatcgtctcctggtaccaacagcacccaggacaaacgcccccaaactcatgatttatgatgtcactaatcggcctcgagggtttctaatcgtcttctctggctcaagtctgcaacacggcctccctgacctatctcgtcgggcctccgaggctaggaggacgaggctagtaatttattactgcagctanatataacaagcacgancactctactatcgtcttcggaacgtcggactaacggtccnccgtaccgtaggtccacggacccaacgcccaacccngtccg

SEQ ID NO: 92716 - DNA, 689 bp, Homo sapiens
  misc_feature: GYAE6OF01DMPVH.18.78.H01.1.454.CMB.1.raw
  modified_base (247)..(247): a, c, t, g, unknown or other
  misc_feature (247)..(247): n is a, c, g, or t
  modified_base (304)..(304): a, c, t, g, unknown or other
  misc_feature (304)..(304): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtgttanaactatgtctcctggtaaccaacagcaccaggacaaacgccccaaatcatgatttangatgtcagtactcggcctgtagggtttactaatcgtcttctcgtcggtcctaccgtaaagtcgtacggaccaaaccgtaccggtccctcccgtagaccctattccgtcgtcggggcctaccgaggtccgtagggaacgggacggtacggtcttaggtaacttttaacgttaacgtcgaccgtagtacctactaattaacgtaacgaaagcgaacgaccgtaacgtacctaacgttaacgtacgtttaccggttaaccggtaaacgtaccggggtaaaccgtaaccgggttacctaaccccgggtttccggtaaacggtacccgaaaccggaacccccgtaaacgggtaccccccaaacccccgtacgtacgttcccgtaaccccg

SEQ ID NO: 92717 - DNA, 545 bp, Homo sapiens
  misc_feature: GYAE6OF01CF1AU.18.78.H01.1.454.CMB.1.raw
  modified_base (373)..(373): a, c, t, g, unknown or other
  misc_feature (373)..(373): n is a, c, g, or t
  modified_base (541)..(545): a, c, t, g, unknown or other
  misc_feature (541)..(545): n is a, c, g, or t
tcagtacgagtatgcacgaccggtgctcgatttagtgtgagtagtttgggtttgggggctttgcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaaactcatgatttatgatgtcactaatccggccctcgtaggggtttctaatcgcttctctggctccaagtctggcaacacggcctcctgaccatctcgtgggctccgaggctggacggacgaggctgtattattactgcagtctacatactacaacgcacancactctctatcgttactcggaactcgggacaaggtcctacgtctaggcacgacccacgacccaaccctctttacacttcctcgtcccctaccctcctacctacttacctcgtaactcgacgggtccggactacgggacaacgggccgactaggtacgctgactgactnnnnn

SEQ ID NO: 92718 - DNA, 695 bp, Homo sapiens
  misc_feature: GYAE6OF01DQZHO.18.78.H01.1.454.CMB.1.raw
  modified_base (679)..(679): a, c, t, g, unknown or other
  misc_feature (679)..(679): n is a, c, g, or t
  modified_base (690)..(690): a, c, t, g, unknown or other
  misc_feature (690)..(690): n is a, c, g, or t
  modified_base (692)..(693): a, c, t, g, unknown or other
  misc_feature (692)..(693): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctctggtaccaacagcacccaggacaaacgcccccaaactcatgtatttatgatgtacagtaatccggccctcgtagggtttctaatcgtcttctctggctccaagtctggacaacgacggccctcctcgaccatctcgtcggctccgaggcgtaggacgggacgacggtctaggtaattacgttaactgacacgtctactaataactaacaaacgcgacgacacgactaacgtacgtaacgttaccgtttaacgggaaccggttacgggaaacccgtaacgggtccctaacccggtttaccggtaacgggtaccaaccggaccccgaaaccgggaccccctaaaccccgtacgtaccgttaccctaccgttcccgttacccgttcccccgtcccccttacctacccgtaacgttacccgttacccggttaacgacggggaaccgggtccggggtaccgttacggggaaaccggaacgggtacccgtacgaaggttacggactnaccgacagcancnngc

SEQ ID NO: 92719 - DNA, 513 bp, Homo sapiens
  misc_feature: GYAE6OF01BL0U5.18.78.H01.1.454.CMB.1.raw
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
  modified_base (434)..(434): a, c, t, g, unknown or other
  misc_feature (434)..(434): n is a, c, g, or t
  modified_base (503)..(503): a, c, t, g, unknown or other
  misc_feature (503)..(503): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctctggtaccaacagcacccaggcaaacgcccccaaactcatgatttatgatgtcagtaatcggccctcgaggggtttctaatcgcttctctggctcaagtctgcaacncgcctcctnaccatctctggctccgaggctgaggacgaggctgattattactgcagctcataatacaancagcagcactcagtcgtcgacgtggaccaggtcaccgtcgtaggcctagacccgaaggaccccaacccnctcgctaccg

SEQ ID NO: 92720 - DNA, 643 bp, Homo sapiens
  misc_feature: GYAE6OF01CCFLC.18.78.H01.1.454.CMB.1.raw
  modified_base (185)..(185): a, c, t, g, unknown or other
  misc_feature (185)..(185): n is a, c, g, or t
  modified_base (191)..(193): a, c, t, g, unknown or other
  misc_feature (191)..(193): n is a, c, g, or t
  modified_base (235)..(235): a, c, t, g, unknown or other
  misc_feature (235)..(235): n is a, c, g, or t
  modified_base (254)..(254): a, c, t, g, unknown or other
  misc_feature (254)..(254): n is a, c, g, or t
  modified_base (264)..(264): a, c, t, g, unknown or other
  misc_feature (264)..(264): n is a, c, g, or t
  modified_base (287)..(287): a, c, t, g, unknown or other
  misc_feature (287)..(287): n is a, c, g, or t
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagcggtgttcgtgtagctattaaagtgtcagtntgagtnnnctgtgagcgggagctggcagccgtggggcctgaactctctgngctgcctgtggtcaccttnagtggcttcntctatcgtctcgtcggtccgcgnggtcggtacgggagtcgtggtggtgggtacgtacgttagtaagaacgacgtaacgtactaacgtaacgtacgacgagacgtactagtagtcgtacgtcggtacggttacggaacggacgtaccggtacggttaccgtaaccgtactaacggaaagtaacgtactaaacgtaaccgaaacggccgtaacgtagtactacgtaacgtaactaacgtaacgaacgtaacgtaccgtaacgtaacggaaccggaacgtacgtacgtacgtacgtacgtacgtacgtacgtacgtaggtacggtacgttacgtaggttacggtacggtacggtacggtaacgggtaacgggtaacggtacg

SEQ ID NO: 92721 - DNA, 527 bp, Homo sapiens
  misc_feature: GYAE6OF01A4QOO.18.78.H01.1.454.CMB.1.raw
  modified_base (497)..(497): a, c, t, g, unknown or other
  misc_feature (497)..(497): n is a, c, g, or t
  modified_base (512)..(512): a, c, t, g, unknown or other
  misc_feature (512)..(512): n is a, c, g, or t
  modified_base (518)..(527): a, c, t, g, unknown or other
  misc_feature (518)..(527): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctcgtgggctccaggctggaggacgaggctgattattactgcagctcatactacaagcagcagcactcaagttcttggatcgtgggacctaaggtccaccgtcctaagtccacgaccccaaggccctaaacccctctcgtctacctccgtccgttccccacccttccctcctaactcctacgtactggcgccgggntcgggcaagggccanagtcgnnnnnnnnnn

SEQ ID NO: 92722 - DNA, 820 bp, Homo sapiens
  misc_feature: GYAE6OF01B761C.18.78.H01.1.454.CMB.1.raw
  modified_base (230)..(230): a, c, t, g, unknown or other
  misc_feature (230)..(230): n is a, c, g, or t
  modified_base (251)..(251): a, c, t, g, unknown or other
  misc_feature (251)..(251): n is a, c, g, or t
  modified_base (323)..(323): a, c, t, g, unknown or other
  misc_feature (323)..(323): n is a, c, g, or t
tcagtacgagtatgcacgaccggtgctcgatttagtgtgagtagtttgggtttgggggctttgaccgtgggcccagtctgccctgactcaacctgcctccgtgtcctgggtctcctggacagtcgatcaccatctcctgcactggaaccagcagtgacgttggtggtatactatgtctcctggtaccaacagcacccaggcaaacggcccccaaaagtcactgactttangatgtacagtaatccgccctnagggttttcaaatcgtcttcgttctcggtctaccgaagtctaggacaacgaccgcctccctgaccatctcgnggcctccgaggctaggaggacgacgcgttagtactttaagttactcggacgacggtcttacgtaataataacgaaaggtccgtaacggacgaagccgaaacgttaaccgaaacggtttccgtttaccgggaaaacctttcggggaaacccctaaacgggtccctaaacccgggtacccgttaacgggttacccgaaaccggacccccgtaaaacgggtccccctaaaaaccccccggtttagtttaccccgggttaaccttaaacccgttttacccggttacccggtttttacccccccgggacccccgttttaaccccccttaaaccgttaaacccggtttaacccgtttaaaccgggttaacccgttccgggtaacccgggtaccggggtaccgtttaacgggaaacccgggtaaaaagggggtcccggtaacccgtaaaaggttaaccggttacgacccgtaggttacctagacggtagccgtaacgtcgtcgg

SEQ ID NO: 92723 - DNA, 511 bp, Homo sapiens
  misc_feature: GYAE6OF01DRF98.18.78.H01.1.454.CMB.1.raw
  modified_base (223)..(223): a, c, t, g, unknown or other
  misc_feature (223)..(223): n is a, c, g, or t
  modified_base (336)..(336): a, c, t, g, unknown or other
  misc_feature (336)..(336): n is a, c, g, or t
  modified_base (502)..(511): a, c, t, g, unknown or other
  misc_feature (502)..(511): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaccagcagtgacgttggtggttataactatgtctcctggtaccaacagcacccaggcaaagcccccaaactcatgatttangatgtcactaatcggccctcaggggtttctaatcgcttctctggctccaagtctggcaacacggcctcctgaccatctctgggctccaggctgaggcgaggctgattattacngcagctcatatacaagcaccagcactctactatgtcttcggaactcgggaaccaaggtcacccgtccaggtcagcccaaggcccaaccccactcgtcactctcgttccccgcctacccgtcctactacctcgtactgcggccgggctcgggcaacggccgacatgnnnnnnnnnn

SEQ ID NO: 92724 - DNA, 857 bp, Homo sapiens
  misc_feature: GYAE6OF01D9C3S.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgcttattttaaaggtgtccagtgtgaggtgcagctgggtggaggtccgggggaggtcttggtccaggccgtggggggtccctagaaacctctcctgtgcacgtcctcgtgggttcctaccttcaggtggccttctgctatcgctacgtcgggtcccgccgagggtccggtttaccggggaaaaggggtccgtaggggtagggtttcggggtttcgggtacccggttaagtttaaggaaacggtacgtaaaaacggaccgttaaaacgaacggtttaaacccgggaccgtaaccgaacggacccgtaaagttaacgttcggaccgtttagggaccgggtttacggggtaacggaaaaacgggtccgtaacgggtttacccgtaaccccggttaccgttacccgtaaacgtaaaacgttacggtaaacgtttaaccgaaaaacggtaacccgtaaccgggtaaccggttaacgttcgtacgaacgtaaacgtacgaaacgaacgacccgtaaacggaaaacccggtacgggaaccgaccgggtaccggttacgtaacgttacgttacggtaaccgtaacggtacggtaacgggttaggtaaacgttacggttaacggtttagggggtaacggttacggttaaccgggtaacggggttaaaccgggggggttaacctaacggttaaccggg

SEQ ID NO: 92725 - DNA, 712 bp, Homo sapiens
  misc_feature: GYAE6OF01CG3Y6.18.78.H01.1.454.CMB.1.raw
  modified_base (258)..(258): a, c, t, g, unknown or other
  misc_feature (258)..(258): n is a, c, g, or t
  modified_base (276)..(276): a, c, t, g, unknown or other
  misc_feature (276)..(276): n is a, c, g, or t
  modified_base (310)..(310): a, c, t, g, unknown or other
  misc_feature (310)..(310): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatcctcctgccacgtcggaaccagcagtgacggttggtggttataactntgtcctctggtaccaacngcaccaggacaaacgccccaaactcatgatttangatcgtacactaagtccgtcctagtagggtttactaactcgtcttctcgtcgtctcagtcgtgacacgtaccgcctcctagacctactcgtccgtacgggcctaccgacggtcgtaggtacgggacgtacggtcgttagtaacgtttacttaccgtacggaccctacggttaccttaacgacgttaacctaacgttaacttacctacggtacgggttcggttaccggggttcgggggttaccggttccggggaccggggtaaccggggtaaccggtaggggtccggttaaccgggaccgggttttaccgggtacggggttcccgaaaccggtacccccgtaacggggttccccttccccgggtacccccccggtttcgggtaccccttccggtttcccccgg

SEQ ID NO: 92726 - DNA, 711 bp, Homo sapiens
  misc_feature: GYAE6OF01BDMLU.18.78.H01.1.454.CMB.1.raw
  modified_base (297)..(297): a, c, t, g, unknown or other
  misc_feature (297)..(297): n is a, c, g, or t
  modified_base (703)..(703): a, c, t, g, unknown or other
  misc_feature (703)..(703): n is a, c, g, or t
  modified_base (706)..(711): a, c, t, g, unknown or other
  misc_feature (706)..(711): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaaactcatgtatttatgatgtcaagtaatccggccctcgtaggggtttctaatcgtcttctctggcctccaagtctggaccaaacnccggcctccctagaccactcctcgtcgggcctccgaggctggacgggacgaggtctagtactttattacgtgaccgagtcctacgaattaacgtaacgaacgcaacggcaaacgtcctaacgtaaccgtaaacggttccgttaaccggggaaccggttaacggggaaacccgttaaacggggttccctaaaccccggggtttacccgtaacggtacccgaaccggaccccgtaaaccgggaacccccctaaaaccccgtcgttccgtaaccctaccgtttacccgttacccgttacccccctaccccgttaccccttacccgtaacgtttaccccgttaccggttaacgtcgggaccgggtccgggtacgttacgggaaccgacgggtccacgttaagcgcagtcntcnnnnnn

SEQ ID NO: 92727 - DNA, 708 bp, Homo sapiens
  misc_feature: GYAE6OF01EFSWH.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctggttttcctgttgctattttaaaggtgtccagtgtgaggtgcagctggtgggaggtccgggggaggcgttgggtccaggccgtggggggtccctagaactctcctgtgcagcctcgtgggttcaccttcagtcggctctgctatcgctacgtcgggtccgccgacggtccgttaccggggaaagggtcgtgggtagggtggggtttcggaccggttagttaaggaaggtacgaaaacgtcctaaacgacggttaacgcgaacgagcatacgtgcgtgtcgtcggtaggaaaggtcgacggttctaccgtctacgaagtaatacgtattaacgaaacgaacgtaacggtacgtagtacgtacgactaaagacgaacgacgaccgtaacggtaaaccgaacgggaccgtaaccggtaccgtagttaacgttacgtacgttaccgtaacgtaacggtacggttacggtaactttaacggtacgggtttagggggtaacgtttacggaccgggtaaccggggtaaacgggggggttaaccgtaacggttaacccggg

SEQ ID NO: 92728 - DNA, 584 bp, Homo sapiens
  misc_feature: GYAE6OF01EI38I.18.78.H01.1.454.CMB.1.raw
  modified_base (297)..(297): a, c, t, g, unknown or other
  misc_feature (297)..(297): n is a, c, g, or t
  modified_base (327)..(327): a, c, t, g, unknown or other
  misc_feature (327)..(327): n is a, c, g, or t
  modified_base (574)..(575): a, c, t, g, unknown or other
  misc_feature (574)..(575): n is a, c, g, or t
  modified_base (577)..(577): a, c, t, g, unknown or other
  misc_feature (577)..(577): n is a, c, g, or t
  modified_base (579)..(580): a, c, t, g, unknown or other
  misc_feature (579)..(580): n is a, c, g, or t
  modified_base (582)..(584): a, c, t, g, unknown or other
  misc_feature (582)..(584): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcaccaggcaaacgcccccaaaactcatgatttatgatgtcagttaactccggccctcgaggggtttctaatcgcttctctggctcaagtctggcaacacgcctccngaccatctcgtggctcgagctagaggacgnggctagtatttatactgcagctacatactacagcagcagcactactagtcttacgggaacgtcgggaaccctaaggtccaacccgttcgtacggtcaacgaccccgaacggacccccaaccctacgttcgtaccctaaccttccgttacccgttccccgccccttacccgtacctaaccgttacccttacggtacgtcgggacggccgggtactcgggaccgtaacgggccgtacgtagtaggctanncnanncnnn

SEQ ID NO: 92729 - DNA, 654 bp, Homo sapiens
  misc_feature: GYAE6OF01BEGW7.18.78.H01.1.454.CMB.1.raw
  modified_base (311)..(311): a, c, t, g, unknown or other
  misc_feature (311)..(311): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacaggagactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcgagtggcgactacatggagtcgtcggggtccnccgaggcctccgaggggaggcctgggagtggatctctactttatttagtaggtggtcggtaccactattaccacacagacctcggtagaacgggccattccacctactctacaagaacaacaacttccgaaaggaacactagtttagtactacttaacaaattacgaaactaacccgtagaacggaacgacccggtaaggaaccgaccggaccctaagttacggttacttacgtgggtacggtggggtaccttacgttttaccgtacccgggtacccccggttcggggggtaaccccggggtaaccccgttgggtccctaacccccggtccctaccccccccg

SEQ ID NO: 92730 - DNA, 662 bp, Homo sapiens
  misc_feature: GYAE6OF01BF3SG.18.78.H01.1.454.CMB.1.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (271)..(271): a, c, t, g, unknown or other
  misc_feature (271)..(271): n is a, c, g, or t
  modified_base (308)..(308): a, c, t, g, unknown or other
  misc_feature (308)..(308): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgcctgactcaacctgcctccgtgtctgggtctccgtggacngtcgatcaccntctctgcactggaaccngcagtgacgttggtgttataactntgtactcgtgtacaacacncaccgaggacaaacgaccccaaatcatacgtatttancgatcgtacagtactcggcctgtacgggtttactacgtcgtcttctcgtcgtctacgacgtcgtacgacaacgccgtcctacccgtgacctatccgtacgtcgggtacctccgaggtcgtacggaacggtacggtacgggtacttaggttaacgtttacttacggttacggcctacggtactttaccgtaattaacgttaacgaaaccgcgaacgtcaacggtcctaacgttacgtaacgtttccggtaacggtaaccggtacgggaaacccgttacgtacccgtaccggttaccgttacgggacccgtacgtaaccccggaacgacccctaaaccgtcgttacgcccttaccg

SEQ ID NO: 92731 - DNA, 297 bp, Homo sapiens
  misc_feature: GYAE6OF01BEY9S.18.78.H01.1.454.CMB.1.raw
  modified_base (228)..(228): a, c, t, g, unknown or other
  misc_feature (228)..(228): n is a, c, g, or t
  modified_base (284)..(284): a, c, t, g, unknown or other
  misc_feature (284)..(284): n is a, c, g, or t
  modified_base (290)..(297): a, c, t, g, unknown or other
  misc_feature (290)..(297): n is a, c, g, or t
tcagtacgagtatgcacgaccggtgctcgatttagtgtgagtagtttgggtttggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagccaagcccaacccnctgtcactctcgtcccaccctcctccatactcgtactgacgcgggctggcaaggcncatagnnnnnnnn

SEQ ID NO: 92732 - DNA, 638 bp, Homo sapiens
  misc_feature: GYAE6OF01DMRH1.18.78.H01.1.454.CMB.1.raw
  modified_base (491)..(491): a, c, t, g, unknown or other
  misc_feature (491)..(491): n is a, c, g, or t
  modified_base (627)..(627): a, c, t, g, unknown or other
  misc_feature (627)..(627): n is a, c, g, or t
  modified_base (632)..(633): a, c, t, g, unknown or other
  misc_feature (632)..(633): n is a, c, g, or t
  modified_base (635)..(637): a, c, t, g, unknown or other
  misc_feature (635)..(637): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaactccggcctcgtaggggtttcaatcgtcttctctcggctccgaagtctggacaaccaccggcctccctcgaccactctcgtcgggcctccgaggcgtggacggacgaggctgtaattagttacgtgacagtcctactaactaactaacgaagtcaagtcacgcactacgtaacgttcgttacggaacgtcgggaaaccgtacggtaccacccggttacgtacggtccaacgtacccgaacgccccaaaccccgtnttaccggtaccctaacgttcccgttacccgttacccccgacccttacccacccgttaactacccgttaccgttaaccgtcgggaccgggtccgggtacttacgggacccgaagggtcccacggtattacgcgactnctcanncnnnc

SEQ ID NO: 92733 - DNA, 691 bp, Homo sapiens
  misc_feature: GYAE6OF01DGONX.18.78.H01.1.454.CMB.1.raw
  modified_base (230)..(230): a, c, t, g, unknown or other
  misc_feature (230)..(230): n is a, c, g, or t
  modified_base (314)..(314): a, c, t, g, unknown or other
  misc_feature (314)..(314): n is a, c, g, or t
  modified_base (393)..(393): a, c, t, g, unknown or other
  misc_feature (393)..(393): n is a, c, g, or t
  modified_base (677)..(677): a, c, t, g, unknown or other
  misc_feature (677)..(677): n is a, c, g, or t
  modified_base (679)..(679): a, c, t, g, unknown or other
  misc_feature (679)..(679): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
  modified_base (685)..(687): a, c, t, g, unknown or other
  misc_feature (685)..(687): n is a, c, g, or t
  modified_base (689)..(691): a, c, t, g, unknown or other
  misc_feature (689)..(691): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttaataactatgtctcctggtaccaacagccacccaggaccaaaacgcccccaaactcatgatttangatgtcagtaactccggccctgtaggggtttactaatcgtctttctcgtcggctccaagtctaggacaacgaccggccctcccngacctatccgtcgtcgggcctccgaggcgtaggacgggacgaggtcgtagtaactttaagttaccgtggacaagcctanataactaacaagcagctaacgcaacttacgtaacggtcgttacgggaaccgtacgggtaacgaaccggtcccgtacccgttaccggtacggtacccgaaccggtaccccgaaaccgggtacccctaaacccgtccttacggtccctaaacccgtttccgtttccccgtacccccctaaccccttaccctacccgtaacctttacccggtaccggttaacgtcgggtaacccgggtccgggtaccgtcgggaaccggaaccgggtcccgtaaacgaggtacgccncncncncnnncnnn

SEQ ID NO: 92734 - DNA, 294 bp, Homo sapiens
  misc_feature: GYAE6OF01C40UU.18.78.H01.1.454.CMB.1.raw
  modified_base (146)..(146): a, c, t, g, unknown or other
  misc_feature (146)..(146): n is a, c, g, or t
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
  modified_base (287)..(294): a, c, t, g, unknown or other
  misc_feature (287)..(294): n is a, c, g, or t
tcagtacgagtatgcacgaccggtgctcgatttagtgtgagtagtttgggtttgggtttctaatcgcttctctggctccaagtctggcaacacggcctccctgaccatctctgggctccaggctgaggacgaggctgattattacngcagctcatatacaagcagcagcactcaagtcttcggaactgggaccaaggtcaccgtctaggcacgccaagccaacccatcgtcactctcgttcccaccctctccagtactcgtactgagccggntgcaaggcncatagnnnnnnnn

SEQ ID NO: 92735 - DNA, 711 bp, Homo sapiens
  misc_feature: GYAE6OF01A5Q0K.18.78.H01.1.454.CMB.1.raw
  modified_base (699)..(699): a, c, t, g, unknown or other
  misc_feature (699)..(699): n is a, c, g, or t
  modified_base (703)..(704): a, c, t, g, unknown or other
  misc_feature (703)..(704): n is a, c, g, or t
  modified_base (706)..(706): a, c, t, g, unknown or other
  misc_feature (706)..(706): n is a, c, g, or t
  modified_base (708)..(708): a, c, t, g, unknown or other
  misc_feature (708)..(708): n is a, c, g, or t
  modified_base (710)..(711): a, c, t, g, unknown or other
  misc_feature (710)..(711): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtacaactaatccggccctgtagggtttctaatcgtcttctctggcctacgaagtcgtggtaccaacgaccggcctccctagacctagtcctcgtcgggcctccgaggtcctggaacgggacgaggctagtattacttacgtgcgtacgctacaattaactaacgaaacgccaaccgagtaccctaaccttacgttaccttacttcgggttcccttaacggggaaaccggttaccggggtaaacccggtaaccgggttacccgtaaccccggtttaccgtaacgggtacccgaaccgtaaccccggaaacccggaacccccaaccccctaacgtccgttaacccaaccctttcccgtttaccgtacccccctaccccgttaccctacccttaaccgttaccgttacccgttacgtaccgggacggtacgggtaccttacgggacggtacggaccggtaccaaggtgactcncgannancngnn

SEQ ID NO: 92736 - DNA, 705 bp, Homo sapiens
  misc_feature: GYAE6OF01C5HJ8.18.78.H01.1.454.CMB.1.raw
  modified_base (253)..(253): a, c, t, g, unknown or other
  misc_feature (253)..(253): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcacgtggaaccagcagtgacgttggtgttataactntgtctctgtaccacagcaccaggacaaacgaccccaaactcatgtatttatgatgtactaagtaacgtccggccttacgtagggtttactaactccgtcctttctccgtcggtcctaccgtaaacgtcgtggaccaaccgaccggtccctcccgtacgacctacttctcgtcgggtcctaccgcggtccgtggaacgggacggtacggtcttaggtaacttttacgtttactcgtacctacgtccttaacgtaatttaacgtaaacgaaacgtaccgaacgacctaaggtaccctacttacccgttacttaacgttccgttaccgttaaccgggtaacgtaccggggtaaaccccgtaagggttaccccgtaacccgggttacccgttaacgggacccgtaacccgggaaccccctaacgggaaccccccaaaccccgtacccgttacccgg

SEQ ID NO: 92737 - DNA, 499 bp, Homo sapiens
  misc_feature: GYAE6OF01AMAYT.18.78.H01.1.454.CMB.1.raw
  modified_base (223)..(223): a, c, t, g, unknown or other
  misc_feature (223)..(223): n is a, c, g, or t
  modified_base (424)..(424): a, c, t, g, unknown or other
  misc_feature (424)..(424): n is a, c, g, or t
  modified_base (443)..(443): a, c, t, g, unknown or other
  misc_feature (443)..(443): n is a, c, g, or t
  modified_base (459)..(459): a, c, t, g, unknown or other
  misc_feature (459)..(459): n is a, c, g, or t
  modified_base (489)..(493): a, c, t, g, unknown or other
  misc_feature (489)..(493): n is a, c, g, or t
  modified_base (495)..(499): a, c, t, g, unknown or other
  misc_feature (495)..(499): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaatcatgatttangatgtcagtaatcggccctcaggggtttctaatcgcttctctggctccaagtctggccaacacggcctccctgaccatctctgggctccaggctgaggacgaggctgattatactgcagctcatatacaagcagcagcatcaagtcttcggaactgggaccaaggtcaccgtcctaggtcacgcccaacggcccaaccccntcgtcacttctcgtacccnccctcctccattaccncgtactgacgcgggctggcaggcgcatagnnnnncnnnnn

SEQ ID NO: 92738 - DNA, 703 bp, Homo sapiens
  misc_feature: GYAE6OF01DKUVE.18.78.H01.1.454.CMB.1.raw
  modified_base (252)..(252): a, c, t, g, unknown or other
  misc_feature (252)..(252): n is a, c, g, or t
  modified_base (494)..(494): a, c, t, g, unknown or other
  misc_feature (494)..(494): n is a, c, g, or t
tcagtacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctcgtgtctgggtctcctggacagtcgatcaccatctcctgcactcggaaccagcagtgacgttggtagttataactnttcgtctcctcggtaaccaacacgccaacccgaggacaaaccgacccccaaactcatgtaattttatgattgtactaagtaacgtccggtccctacgtaggggtttactaagtccgtctttctcgtcggtcctaccgtaacgttcgtagggaccaaccgaccggtccctcccgtacgaccctactctcgtcgggcctaccgacggctaggacggacgtaggacttgtaactttacgttacgnggacctaggtaccttacgtaacttaacgtaacgaacgtaccaagacctagacctaaccttacgtaacgttaccggttaaccggtaaaccggtacgggaaaccccgtaaacgggttaccccgtaacccggttacccggttaacggtacccgtaaccgacccccggtaaaccggtacccccaaaccccgtaccgttcggtccttaaccccg

SEQ ID NO: 92739 - DNA, 728 bp, Homo sapiens
  misc_feature: GYAE6OF01CYS92.18.78.H01.1.454.CMB.1.raw
  modified_base (229)..(229): a, c, t, g, unknown or other
  misc_feature (229)..(229): n is a, c, g, or t
  modified_base (323)..(323): a, c, t, g, unknown or other
  misc_feature (323)..(323): n is a, c, g, or t
tcagtacgagtatgcacgaccggtgctcgatttagtgtgagtagtttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgtacggtttggtgttaatacttagtcgtcttccgtaggtaccaacacgccaaccgaggaccaaacgacccccaaatcatgtaattttcngtatcgtactactaacgtccggtcccttacggtacgggtttctaacgtcgtcttctcgtcgccttacgaagttcgtacggaccaacgtacccggcccttcccgtacgacctactctcgtcggtcctcccgagggtctacgggacggtaacggagtcgtacgttacgtttaacgttaccgtcgacgtacgtacctaacgtaacttaacgttaaccaacggacctaaccgacgtaccctaccggttaccttacgttaaacgttccggttaacgtttaaccgggtaaccggttaccggggaacccggttaaaccggttacccgtaacccgggttacccggttaacgggtaccgtaaccccggtaaccccgaacccgggtaacccccaaaccccgttcccgttacccgg

SEQ ID NO: 92740 - DNA, 998 bp, Homo sapiens
  misc_feature: GYAE6OF01DFS63.18.78.H01.1.454.CMB.1.raw
tcagtacgagtatgcacgaccggtgctcgatttagtgtgagtagtttgggtttggggagctctgggagaggagctccagccttgggattcccagctgtctcccactcggtgatcggcactgaatacaggagactcaccatggagtttgggctgagtcgttggttttccttgttgtcttaagttttaaaaggtgtcagtgtgtaggtgcgagcgtggtgggagggtccggggaggtcgttcggtccgacggtccggtcgggggtcccgtacggtaaacctcgtcctcggtcgcgtacgtcccgtcgttcggggttcctaaccgttcgtacggtcggtccgttccttggtaccttacgtcgtccgtaccggtttcggggtccccgacccggtacgggttacccgggtttaacccggggaaaacggggtccggttaaggggtacgggtttcgggggttacgggtaaccgggtttaaacgttaaggaaacgaacgtaaaacggtaaccttaaaacgtaacggttaaccgaaccggaaccgtacggaacctaagttaagtacggtcggtacggtcgggtaccgggtaaggtaaaccgggtcggttaacccggttaccggtaaccccggttaccgttaacccgtaaaacggttaaaccgttaagtaaaaccgtttaaacgaaaaaccgggtaaacgtaaccgggttaaccgttaacttaaccgtaacggtaaacgtaaaacgttaacgaaacccggaaacgtaaccccggtaaaacggtaaaaaccccgggtaacgggaacccggttaacccgggtaacccggtttagttaaaccgtttaacggttaacgttaaaccggttaaacggtaaaccggtaaggggttaaacggttaaaccggttttaagggttaacggggtttaaccggggttaacgggttttaacggtaaccccggggtaaaccgggggttaaaacccggggggttaaccgtttaaaaccccgggg

SEQ ID NO: 92741 - DNA, 751 bp, Homo sapiens
  misc_feature: GYAE6OF01CTZV7.18.78.H01.1.454.CMB.1.raw
  modified_base (255)..(255): a, c, t, g, unknown or other
  misc_feature (255)..(255): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcacgtcggaaccagcagtgacgttggtgttaataactntgtctcctggtaaccaacagccaccaggaccaaacgacccccaaactcatgtatttatgatgtacaagtaacgtccggcccttagtacggggtttactaacgtcgtcttacgtcgtggccttacctaagtcgtacggacaaaccgaccggaccctcccgtaggaaccctacttccgttcgtcgggtccttacccggaggtaccggttaggaaaccggggaacggtacgggtacgtttaagtaacgtttttaacgttacgtccgggttaacacggttaccttaacctaaacgttaaacctttaaccggaaaaccgtaccaaaccccgtaaaccggaccttaactttacccgttaactttacgttacggtttaccgttaaccgggtaaaccgttcggggaaacccgtaaccgggtaccgttaacccggtccggttaaacgcccgtaaacccgtacccgaaaccggtacccctaaacccttcccgtttcccgtaacccg

SEQ ID NO: 92742 - DNA, 635 bp, Homo sapiens
  misc_feature: GYAE6OF01CD81Q.18.78.H01.1.454.CMB.1.raw
  modified_base (188)..(188): a, c, t, g, unknown or other
  misc_feature (188)..(188): n is a, c, g, or t
  modified_base (223)..(223): a, c, t, g, unknown or other
  misc_feature (223)..(223): n is a, c, g, or t
  modified_base (586)..(586): a, c, t, g, unknown or other
  misc_feature (586)..(586): n is a, c, g, or t
  modified_base (623)..(623): a, c, t, g, unknown or other
  misc_feature (623)..(623): n is a, c, g, or t
  modified_base (626)..(635): a, c, t, g, unknown or other
  misc_feature (626)..(635): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctctggtaccaanagcacccaggcaaaagcccccaaatcatgatttangattgtcagtaactcggcccttgtaggggtttctaatcgtcttctctggctccaagtctggacaacgacggccctcctgacctatcctctcggggacctcccgaggtcgtaggacgggacgagggtcttaggtaattttacgttaacgtcgaccctacgtttaccctaagttacgaacctaaactttaaactcgttcctaagggttcggttcgggttcgggggtttacgttcggggacgggtaacgggacccgtggacgtcggaccggttcggtacgggtcgacgcccgaacggctcccgtccccgtcggtcctacctccgttcccgtccctaccctcctacctacgttaccgttacggtacncggaacggcggtacgcggtacgacggtcacgtatagntcnnnnnnnnnn

SEQ ID NO: 92743 - DNA, 795 bp, Homo sapiens
  misc_feature: GYAE6OF01BNZ0W.18.78.H01.1.454.CMB.1.raw
  modified_base (238)..(238): a, c, t, g, unknown or other
  misc_feature (238)..(238): n is a, c, g, or t
  modified_base (266)..(266): a, c, t, g, unknown or other
  misc_feature (266)..(266): n is a, c, g, or t
  modified_base (331)..(331): a, c, t, g, unknown or other
  misc_feature (331)..(331): n is a, c, g, or t
tcagtacgagtatgcacgaccggtgctcgatttagtgtgagtagtttggggtttggggggggtctcaggaggcagcgctctcgggacgtctccaccatggccctgggctctgctattcctcaccctctcactcagggcacagggtcctgggcccaggtctgccctgacctcaaccgtgccctccgtgtcgtgggtcctccgtggacagtcgatcgaccatctcctgcactgggaaccngcagtgtacgttggtagttaataacgtnttgtcctactggtaaccaacacgccaacccgtaggacaaaacgacccccaaatcgatgtatttangtactgtactaagtaacgtccggtacctggtagggtttacaacgttccgtcttacctcgtcggtacctaccgaacggttctacggaccgtaaaccgaccggtccccttacccggtacgtaacccgtaagttcccggttacggtacggggtacccttaccgggaaacgggttccggttaacgggaaccggggtaaccggtacgggttacccgttaagttaaccgttttaaacgttaccgtacggaccgtaacgttaccgtacgtaaagttaaaccgtaacgaaacgcccctaaaccggacgtacccttaacgttacgttacttaggttaccggttaccgttaacggggaaccgttaaaccggggtaaccgtaacggttacccggtaaccccgtttacggtacggtaacccgaaccggtaaccccggaaaccggtaacccccaaccccctaggttcccgtaacccg

SEQ ID NO: 92744 - DNA, 835 bp, Homo sapiens
  misc_feature: GYAE6OF01A382D.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagtcgttgggtttttccttggttgtcttaagttttaaaaggtgtccagtgtgaggtgcagcgtggtggacggtccgggggagtcgttcggtccgaggtccggtcggggggtaccctagtaaaccttccgtaccgtggtcgccgacgtcccgttcgttcgggttacctacccgtttcgaggttcggtccttcgtcgtactaagttcggaccgtacggtccggggtcccgacccggtacgggttcccgggttaaccggggaaacggggtcggttaacggggtaggggttacggggttcgggtacccgtttaaggttaacggaacggtaaccgaaaagtaccgtaaacggtaacgttaccggacgaacgacgtacgtaatagtcgtacgtggtaccggtacggtaggaaacggtcgtacggttccgtaccggtcgtaacgaagtaaagtcgttaaactaacgaaacgaaccgtacggtacgtaagtacgtagaacgtaacgtaacgaacgtacgtaaccgtaacggaaaccggacggtaaccggacggtacgttaagtacgttaacgtacgtaacgtacgtaacggtacgggttagttacgttaacggttacggtttaacggggtaacgttacgggttaaccgggtaaggggttaaaccgggggttaacgttaaccggttaaccggg

SEQ ID NO: 92745 - DNA, 776 bp, Homo sapiens
  misc_feature: GYAE6OF01C2QR9.18.78.H01.1.454.CMB.1.raw
  modified_base (769)..(770): a, c, t, g, unknown or other
  misc_feature (769)..(770): n is a, c, g, or t
  modified_base (772)..(774): a, c, t, g, unknown or other
  misc_feature (772)..(774): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgtacgttggtaggttaataactatgtcctccgtggtaaccaacacgccaacccgaggaccaaaaccgacccccaaaatcatgtaatttatgatgtactaagtacgtcccggtacctacggtacgggtttactaacgtcgtcttcgttccgtcggtacctaccgaagttccgtacggaccaaccgtaccggtcccctccgtacgacctctccgtcgtacgggtcctaccggaggtacggtacggaacgggacggtacggtaccttagttaacttttaacgttaccgcggaccgtacgtacctttaacaaacttaactaaacgaacggcaacgtacacggtacctaaccgttacgtaacggttacccggttaaccggggaacggttacccgggaaaccgttaaccgggttaccccgtaaccgggttacgtaacggtaccgaaacccggacccggaaacccgaccccctaaacccgtcgttaccgtacccttaccgtttccgtccccgttcccccgtcccttacctaacccggtaccttaccggttacgtacgtccgggacggtccgggccgtacggaaccggttacggccgttagaacgttcgagctacgaccgtcacnncnnncg

SEQ ID NO: 92746 - DNA, 618 bp, Homo sapiens
  misc_feature: GYAE6OF01B18CW.18.78.H01.1.454.CMB.1.raw
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
  modified_base (615)..(615): a, c, t, g, unknown or other
  misc_feature (615)..(615): n is a, c, g, or t
  modified_base (617)..(617): a, c, t, g, unknown or other
  misc_feature (617)..(617): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatccggccctcgtaggggtttctaatcgtcttctcgtgctccaagtctggcaacacggcctcctcgaccatctcgtcgggcctccgaggctggacggacggagctagtattactactgcagctcaatatacgaacgcaccagcactctactatcgtcgtacggacgtacgggaccaaggtccacccggttcgtaaggtccaacgaccccgaacgccccctaacccgttcgtaccgttacctacttacccgttcccgttaccccccaaccctttccccgtaccctaaacgttacccttaccggttaacgtcgggacgggtcccgggtaccgtacgggaccgaacgggtccgtaacgacggttacgcgtacagacctnancngnc

SEQ ID NO: 92747 - DNA, 930 bp, Homo sapiens
  misc_feature: GYAE6OF01BTXDP.18.78.H01.1.454.CMB.1.raw
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagcttgggttttccttgttgcttattttaaaaggtgtccagtgtgaggtgcagcgtggtggacgggtccgggggaggtcgttggtccgacggccgttggggggtcccctaggtaaaccttccgtccgtgtcgcgtacgtccgttcgttcgggttcctacccttcgtacggtcggtccttcgtcgtacttacgtcgtccgtaccggttccggggtcccggacccggtacgggtacccggttaccggggggaaacgggtccggttagggtacggggtttcgggggtttcgggtacccggtttaagtttaacggaaaacggtaaccgtaaaacggtaacccgttaaaaccgttaaacgggtttaacccggaaccggtaaccgaacggtaccgtaaagtttaacgtccggttccgttacggggtcccgggtttaaaccgggggtaaggtaaaacggggtaccggttaaccgggtttaccccgtaaccccggtttaccccgtaaccggtaaaacggttaaaacgttacggttaaactttaaacccggaaaacggtaaacccggtaccggtaccgttacgtaccgtacgtaactaaacgtaacgaaacgaccgtaaccgaaaccggtaaaaccggacgggaacccgacggtaccggtaacgttaacgttaaccgttagtaaacgtacggtaacggtaagggttaggtaacgttacggttagggtttacggggtacgttacgggtaacgggtaaaccggggtaaacgggggttactaaacccggg

SEQ ID NO: 92748 - DNA, 549 bp, Homo sapiens
  misc_feature: GYAE6OF01CPIZ2.18.78.H01.1.454.CMB.1.raw
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
  modified_base (534)..(534): a, c, t, g, unknown or other
  misc_feature (534)..(534): n is a, c, g, or t
  modified_base (541)..(541): a, c, t, g, unknown or other
  misc_feature (541)..(541): n is a, c, g, or t
  modified_base (543)..(549): a, c, t, g, unknown or other
  misc_feature (543)..(549): n is a, c, g, or t
tcagtacgagtatgcacgaccggtgctcgatttagtgtgagtagtttgggtttgggggctttgcctgggcccagtctgccctgactcagcctgcctccgtgtctgggtctcctggacagtcgatcaccatctcctgcactggaaccagcagtgacgttggtggttataactatgtctcctggtaccaacagccacccaggcaaaacgcccccaaactcatgatttangatgtcactaatcggccctntaggggtttctaatcgcttctcgtaggcctccaagtctaggcaacacggcctccctgacctatctcgtgggcctcgagcgtggaggacgaggctgtaagttacttactacgcagctcattaanacgaacgcaacngcactctactatcgtcgttacgacgtcgggaacacggtccaccgtacgagtccacgacccaacggccccaacccatcgtacctacttccgttccgtaccccgtcccctcctaccgacttactcgtactgacggcggctcggacgaacggcanagtacgncnnnnnnn

SEQ ID NO: 92749 - DNA, 810 bp, Homo sapiens
  misc_feature: GYAE6OF01AOVG2.18.78.H01.1.454.CMB.1.raw
  modified_base (272)..(272): a, c, t, g, unknown or other
  misc_feature (272)..(272): n is a, c, g, or t
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagctgggttttccttgttgctattttaaaaggtgtccagtgtgaggtgcagctgggtggaggtccgggggaggcgttggtccagccgtgggggtccctaggaactctcctgtgcagcctntcgggttcaccttcgagtcggctctgctatgcacgtcgggtccgccgaggccgttccggggaagggccgtgggaggttcggggttcggacccggttaagttaggaacggtacgaaaacgtacgtaaacgtacgttaacggcgaacgagactagtagtcgcttggccggttacgggtaggtaaaggcgtacggttaccgtaccggttctaccgtaagtaaacgtacgtaacgttaacgaaacgtaaccggtaacggaccgttacgtaccgtagaacctaaacgtaacgaaaccgtaaccgtacccggtaaacggtaaaacccgggaaccggaaccgtaacccgggttacccggttaacgtttaaaccgtttaaccggtaaccgttaaccggtaaacggtaaaccgggttaacggggttacgggttaaacggtttaacccggttaaaggggtttttaacggggggtaaccggtttaacgggttaacccgggtaaaccgggggttaaaacccggggggggttaaaccctttaaaaccgggg

SEQ ID NO: 92750 - DNA, 667 bp, Homo sapiens
  misc_feature: GYAE6OF01CPTPT.18.78.H01.1.454.CMB.1.raw
  modified_base (187)..(187): a, c, t, g, unknown or other
  misc_feature (187)..(187): n is a, c, g, or t
  modified_base (223)..(223): a, c, t, g, unknown or other
  misc_feature (223)..(223): n is a, c, g, or t
  modified_base (396)..(396): a, c, t, g, unknown or other
  misc_feature (396)..(396): n is a, c, g, or t
  modified_base (550)..(550): a, c, t, g, unknown or other
  misc_feature (550)..(550): n is a, c, g, or t
  modified_base (653)..(653): a, c, t, g, unknown or other
  misc_feature (653)..(653): n is a, c, g, or t
  modified_base (658)..(659): a, c, t, g, unknown or other
  misc_feature (658)..(659): n is a, c, g, or t
  modified_base (661)..(667): a, c, t, g, unknown or other
  misc_feature (661)..(667): n is a, c, g, or t
tcagtacgagtatgcacgaccggtgctcgatttagtgtgagtagtttgggtttgggggctttgcctgggcccagtctgccctgactcaacctgcctccgtgtctggtctcctggacagtcgatcaccatctcctgcacgtggaaccagcagtgtacggttggtgttataactatgtctctgtacaanagcaccgagacaaacgaccccaaatcatgtatttangtatgtacaagtaacgtccggtccgtacgtagggtttactaagtccgtcttctcgtacggtccttaccgaaggttcgtacggaccaaccgacccggtccctacccgttagacctactccgtcggtcggtcctccgaggccgtaggacggtacggagtctagtacttacgtacngactacgtctaactaataactaacaacgaccaacctcgactaacgttctacgttacgtacgttccgtaacggaacgtacgggtaacctaacggtcgtaccccgtttacgaacggtaccgaaccgtaacccgaaccgtaaccccaacccgttacnccgtaccttacgttcccgtaccgtaccccctacctccgtaccacgtttaccgtccgtaacgtcggtaccggacggttcacggtaacgaacgggcctaagtacngacgnngnnnnnnn

SEQ ID NO: 92751 - DNA, 741 bp, Homo sapiens
  misc_feature: GYAE6OF01BNC8I.18.78.H01.1.454.CMB.1.raw
  modified_base (238)..(238): a, c, t, g, unknown or other
  misc_feature (238)..(238): n is a, c, g, or t
  modified_base (340)..(340): a, c, t, g, unknown or other
  misc_feature (340)..(340): n is a, c, g, or t
tcagtacgagtatgcacgaccggtgctcgatttagtgtgagtagtttggggtttggggggggtctcaggaggcagcgctcgtcgggacgtctccaccatggcctgggctctgctattcctcaccctcctcactcgagggcacgagggtcctgggcccagtctgccctgactcagcctgcctcgtgtcgtggtcctccgtggacagtcgatcacctatcctcctgacacgtacggaacngctaggtgtacggttgggtagtttaataactgtcgtctacgtacggtaccaacagaccaccgacggaccaaaccgaccccaaacgtactatagtacttagtntatcgtcaacgtacgtccggtccgttacgttaacgggtttctaacgtcgtcttcgtcgtcgcctacgtacgtccgtacgaccgtaaccgccggtaccctaccgtacgtaacctcgttccgtcgttaccggggtactaccgggtaacggtcgtaacggggaacggtacgggtacggtcgtttaaggtactttaaccggttacgtacgtaccgttaacgtaccttactaaattaaccgtaaccgaaccggaccctaaccggtactaccgtaaccttcgttacgttaacggtcctttaaccgggaccggtttaaccggacgggtaaacccgtaggtacccggtacccgttacgcgggtaaaccctaccggtacccccgaaaccacccgtaccccgtacgtcccg

SEQ ID NO: 92752 - DNA, 790 bp, Homo sapiens
  misc_feature: GYAE6OF01C0JFG.18.78.H01.1.454.CMB.1.raw
  modified_base (782)..(782): a, c, t, g, unknown or other
  misc_feature (782)..(782): n is a, c, g, or t
  modified_base (785)..(788): a, c, t, g, unknown or other
  misc_feature (785)..(788): n is a, c, g, or t
  modified_base (790)..(790): a, c, t, g, unknown or other
  misc_feature (790)..(790): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctctgtaccacagcacccaggacaaacgaccccaaactcatgtatttatgattgtacaggttaactccggtccgtcgtaggggttttactaagtccgtctttcgtcgtcggccttaccgaagttcgtcggacaaaccgccggtaccccttcccccgtagaacccctacttcccgtccggttcggggtcccttaccggacggtaccgtaggggaacgggaccggtaagggtaccgtttaggttaacttttaacgtttaccgtgacccgtagtacctactaatactaaacgaacgccgaacgcaacgacctaactacgttaaacggttacccgtttaccggggaaacggtaccggggtaaacccgtaacgggttacccgtaaccccgggttacgttaaccgggtcccggaaacccgaacccccggtaacccggaaccccctaaacccccgttacttacccggttaccctacccgtttacccgttccccggtttacccccccgcccccttacccgtttaccccaaccgtttcccgtaacggttaccctagggcccgggtccggtacggtacgggaccgtaacggggccgttcaaaggtcgcgactcacgnacnnnngn

SEQ ID NO: 92753 - DNA, 723 bp, Homo sapiens
  misc_feature: GYAE6OF01DJT92.18.78.H01.1.454.CMB.1.raw
  modified_base (712)..(712): a, c, t, g, unknown or other
  misc_feature (712)..(712): n is a, c, g, or t
  modified_base (714)..(715): a, c, t, g, unknown or other
  misc_feature (714)..(715): n is a, c, g, or t
  modified_base (717)..(723): a, c, t, g, unknown or other
  misc_feature (717)..(723): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaaccaacagcacccaggacaaacgccccaaactcatgtatttatgatgtacaagtaactccggcctacgtaggggtttactaatcgtcttctcgtcggtcctacgaagttctagggaccaaaccgaccgggtccctaccccgtacgaaccctacgttccgttccggtcggggacctcccgaaggtccgtaggaacgggacggacggtcttagtaattttacttaacgtgaccgacgtcctaacaattaacaacgaacgacaacggactagacctaacgtactaacgttccggttaaccgggaacgttacgggaaacctaacgggtcccgtaaccgttaccgttaacggacccgaacccggaacccggaaacccggaccccctaaaaccccgtccgttaccgttaccctaacccgtttaccgttaccccgttacccccttaaccccgttaccctaccctaacgttaccgttacccgttaacggtcggaccgggccggtccgtaggaccggtaaccggccgacgtatagcncnncnnnnnnn

SEQ ID NO: 92754 - DNA, 615 bp, Homo sapiens
  misc_feature: GYAE6OF01BKEZH.18.78.H01.1.454.CMB.1.raw
  modified_base (67)..(67): a, c, t, g, unknown or other
  misc_feature (67)..(67): n is a, c, g, or t
  modified_base (272)..(272): a, c, t, g, unknown or other
  misc_feature (272)..(272): n is a, c, g, or t
  modified_base (329)..(329): a, c, t, g, unknown or other
  misc_feature (329)..(329): n is a, c, g, or t
  modified_base (592)..(594): a, c, t, g, unknown or other
  misc_feature (592)..(594): n is a, c, g, or t
  modified_base (597)..(600): a, c, t, g, unknown or other
  misc_feature (597)..(600): n is a, c, g, or t
  modified_base (602)..(615): a, c, t, g, unknown or other
  misc_feature (602)..(615): n is a, c, g, or t
tcagtacgagtatgcacgaccggtgctcgatttagtgtgagtagtttgggtttggggggcttttccngggtggctgttggtaccaggagacatagttataaccaccatctcctgcactggaaccagcagtgacgttggtggttataactatgtctcctggtaccaacagcacccaggcaaacgaccccccaaactcatgatttatgatgtcagtaactccggccctcgtaggggtttctaatcgcttctcgtggcctccaagtctggcaacnccggcctccctgaccatctctgggcctccaggctgagggacgaggctgtattattcngcagctcatatacaagcagcagcctaactcaaggttccgttacggaacgtcggggaaccctaaggtccctacccggtactaggggtccaaccgacccccggtaaacggcccccaaccccctagttccgtaccctacccgttccgttcccggttaccccccgcccccttaccccctaccgtaacccttacccgttacccggttaccttcgggaccgggtccggggtacccgtgggaacccgaagggtccccgattacggtagcnnncgnnnngnnnnnnnnnnnnnn

SEQ ID NO: 92755 - DNA, 770 bp, Homo sapiens
  misc_feature: GYAE6OF01C6SEZ.18.78.H01.1.454.CMB.1.raw
  modified_base (94)..(94): a, c, t, g, unknown or other
  misc_feature (94)..(94): n is a, c, g, or t
  modified_base (566)..(566): a, c, t, g, unknown or other
  misc_feature (566)..(566): n is a, c, g, or t
tcagtacgagtatgcacgaccggtgctcgatttagtgtgagtagtttggggtttggggggggtctcaggaggcagcgctcgtcgggacgtttcnccaccatggcctgggctctgctattcctcaccctcctcactcgagggcacgagggtccgtcgggcccagtctcgccctgactcaacctcgcctccgtgtcgtgggtctccgtggacagtcgatcacctatcctcctgcacgtacggaaccagcgaggttcggtacggtttgggttacggttaataacttgttcgttcctaccgttacggtaacccaacgaggacccaacccgaacggaacccaaaacccgacccccctaaaactcctaaggttacgttaatttttagtacggtagttacgtaaccgtaacgtaaccggttcccggacccgttaacgggtttacgggtttaacctaagttccgttccttctcggttccggaccttaaccgtagtccgtacggaaccaaccggtcccggtccctacctcgacctcgttcgtcggtccggctaccggaggtccgtaggaacgggngaacgtctaggttaacttcgtaacgtcgactacgttctaactaaggttaacaaccgagaaccgactacggtacaccgtaacgtacgttacggttacggtaaccgtaccggaacgggtaccctaacgggtctaaccccgggttagtaccggacccaaccggtaccccgtaaaccgacccaaacccgtcgtaccgtacccgtcccg

SEQ ID NO: 92756 - DNA, 748 bp, Homo sapiens
  misc_feature: GYAE6OF01AT5GH.18.78.H01.1.454.CMB.1.raw
  modified_base (747)..(747): a, c, t, g, unknown or other
  misc_feature (747)..(747): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaaacgcccccaaaactcatgtattttatgatgtacaactaacgtccggccctcgtaggggttttctaactcgtcttctcgtcggcctaccaagtctaggacaaccgaccggcccttccctgacctacttccgtacgtcgggcctccgaggtccgtaggacgggaccggaggtaccttaggtaactttacgttacgtcgacacgtctactaataactaacgaacgcctaaccgacgtacctaacgttccttacgttacgttcgttaccgtttacgggaaccggttaccgggaaccgtaacggtttcccgtaaccccgttaccggtaccggtaccgaaccggtacccccgaaaccggtacccccaaacccgtacgttcccgtaacccgttacccttccccggtttacccgttcccccccgaccctttaccccggtacccttaacgttaccccgttaaccggttaccgtcggaaccggggtcccgggtacgttaccggggaacccgaacgggggtcctaacgtacggtcgcgtcaggctacagtcagcnc

SEQ ID NO: 92757 - DNA, 558 bp, Homo sapiens
  misc_feature: GYAE6OF01DUIR9.18.78.H01.1.454.CMB.1.raw
  modified_base (548)..(548): a, c, t, g, unknown or other
  misc_feature (548)..(548): n is a, c, g, or t
tcagtacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcagtaatcggccctgtagggtttctaatcgtcttctcgtcggcctaccgtaagttccgtgggaccaaacgaccggtcccctcccgtacgaccctagttcctcgttcggggcctccgaggcgtggacggacggaggtctagtatttacttacgtgcagtcctacataacacaagcagcagcactcagtcgtacggaactggacaggtccacgtctagccacgacccgaacgacccaacccnctcgctaccg

SEQ ID NO: 92758 - DNA, 636 bp, Homo sapiens
  misc_feature: GYAE6OF01EI1AW.18.78.H01.1.454.CMB.1.raw
  modified_base (188)..(188): a, c, t, g, unknown or other
  misc_feature (188)..(188): n is a, c, g, or t
  modified_base (196)..(197): a, c, t, g, unknown or other
  misc_feature (196)..(197): n is a, c, g, or t
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (221)..(221): a, c, t, g, unknown or other
  misc_feature (221)..(221): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (398)..(398): a, c, t, g, unknown or other
  misc_feature (398)..(398): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacaggagactcaccatggagttttgggctgagcgtggttcgtctaggtcgcttaaagttagctagngtgagtgnngcngtggagtgggnggcgtgtcgngcgtcgggtcgtcgtaacgccttctcgtgcagcctccgtggttcgtcctccgtgtggtctctgcattgcgactcggtcgccgacgtcgtcggttaaacggtcggtcgtaggtgggttggaccgttgtaaggctaaaaagggcttaaaaccngttaacncgttaacacggccaagtcngtactgtcgtcggtcgtacggtcgtaacggtacgacggtcgtaccgtacgtacgtacgaaagtacgtaacgtaacgtaacgaacgaacgtacgtacgtactacgtacgaacaacgaacgaacgaaccgaacgaacgaacgacgtacgtacgtacgtagtacgtagtacgtagtcgtagtaggtcgttacggtagttaggtacggtacggtaacgggtacggtaacgggtaacggtacg

SEQ ID NO: 92759 - DNA, 789 bp, Homo sapiens
  misc_feature: GYAE6OF01DE660.18.78.H01.1.454.CMB.1.raw
  modified_base (528)..(528): a, c, t, g, unknown or other
  misc_feature (528)..(528): n is a, c, g, or t
  modified_base (765)..(765): a, c, t, g, unknown or other
  misc_feature (765)..(765): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcgagggcacgacgggtcctcgggcccagtctcgccctgacctacaacctgccctccgtgtcgtcgggtctccgtggacaggtcactccaacctatcctccgtgccacgtacggaaccagacgaggtgtacggtttgggttacgttaactaaacgttgttcggttcctccgttacggtaaccaacgacgacccgaaccgacggaaccaaaacccgaccccctaaaactacaagttaggtaattttagagtactacgtaactaacggtaccgtcccggtacccgtttacggttaacgggtttactaaccgttcgtccttactcggtcgtacctaccgtagtccgacgaaccacgtaccggtccctccgtacacctcgtcctcggtaccggccgttacgngggtccgaggacggtacgtcggtactaagttacttacgttacgtcgacgtaactactaactaagtaccgtaacgacgtaccgacgacgtaaccggtctaaccgttaacggtaccttaccgggttaaaccggtaaccgggtaccgggaacctaccgggttaaccccgtaggttaacccggacgttaaccccgggaacccgaacccccgtaaaccggtaacccccttaaaccccgggtnttaacccggttccccttaaccccg

SEQ ID NO: 92760 - DNA, 519 bp, Homo sapiens
  misc_feature: GYAE6OF01CYTV1.18.78.H01.1.454.CMB.1.raw
  modified_base (355)..(355): a, c, t, g, unknown or other
  misc_feature (355)..(355): n is a, c, g, or t
  modified_base (358)..(358): a, c, t, g, unknown or other
  misc_feature (358)..(358): n is a, c, g, or t
  modified_base (506)..(506): a, c, t, g, unknown or other
  misc_feature (506)..(506): n is a, c, g, or t
  modified_base (511)..(511): a, c, t, g, unknown or other
  misc_feature (511)..(511): n is a, c, g, or t
  modified_base (514)..(519): a, c, t, g, unknown or other
  misc_feature (514)..(519): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaaagcccccaaaactcatgatttatgatgtcagtaatcggccctcaggggtttctaatcgcttctctggctccaagtctggcaacacggcctcctgaccatctctgggctcaggctgaggacgaggctagattatactgcagctcatatacaancancagcactcagtcttcgaactgggaccagtcacgtctaggcacgcccaacggcccaacccatcgtaccactccttcgttccccaaccccttcctacccaatacctcgttaactcgagccgggtctcgggacagggccgtacacgtaggntagcngannnnnn

SEQ ID NO: 92761 - DNA, 610 bp, Homo sapiens
  misc_feature: GYAE6OF01EKHUU.18.78.H01.1.454.CMB.1.raw
  modified_base (224)..(224): a, c, t, g, unknown or other
  misc_feature (224)..(224): n is a, c, g, or t
  modified_base (347)..(347): a, c, t, g, unknown or other
  misc_feature (347)..(347): n is a, c, g, or t
  modified_base (606)..(606): a, c, t, g, unknown or other
  misc_feature (606)..(606): n is a, c, g, or t
  modified_base (608)..(610): a, c, t, g, unknown or other
  misc_feature (608)..(610): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcaccaggcaaacgcccccaaactcatgatttangatgtcagtaatccggccctcgtacggggtttctaatcgcttctctggctcaagtctggcaacacgtcctccctgacctatctcgtgggtcctccgaggctgaggacgagctgtattattacngcacgtctcatacacaagcagcagcactcgtaagtcgttacggaacgtcggaacccaaggtccaaccgtcgtaacgcacgtaccccgaacggaccccaacccctagtcctacctaccgttcccgttaccgtcccctaccccgttaccctacccgtaccgttacccttaccggttaaccgtgggaacccggcggggtacccgtacgggtaccgaaaccggggccccgtaaagtacgtaacgtcacgtcgactcacgtccncnnn

SEQ ID NO: 92762 - DNA, 574 bp, Homo sapiens
  misc_feature: GYAE6OF01BXCO2.18.78.H01.1.454.CMB.1.raw
  modified_base (226)..(226): a, c, t, g, unknown or other
  misc_feature (226)..(226): n is a, c, g, or t
  modified_base (461)..(461): a, c, t, g, unknown or other
  misc_feature (461)..(461): n is a, c, g, or t
  modified_base (562)..(562): a, c, t, g, unknown or other
  misc_feature (562)..(562): n is a, c, g, or t
  modified_base (565)..(567): a, c, t, g, unknown or other
  misc_feature (565)..(567): n is a, c, g, or t
  modified_base (569)..(574): a, c, t, g, unknown or other
  misc_feature (569)..(574): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaaagcccccaaactcaatgatttangatgtcagtaatccggccctcgtaggggtttctaatcgcttctctggctaccaagtctggcaacaccggcctccctgaccatctcgtgggcctccgaggctggaaggacgagtctgtattatactgcagctacatatacaagcagcagcactcgaaacgttcgttacggaacgtcgggaacccaaggtccaacccgttcgtaaggtcaacgcccgaaacggtcccaaaccccgtntcgtacaccgttcttaccgttccccgaccttcccctcgtaacttaccgtacgtacgtcggacgcggggtactcgggaacctaacgggcgactaagtacggnacnnncnnnnnn

SEQ ID NO: 92763 - DNA, 730 bp, Homo sapiens
  misc_feature: GYAE6OF01A7Q6Z.18.78.H01.1.454.CMB.1.raw
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (311)..(311): a, c, t, g, unknown or other
  misc_feature (311)..(311): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcactgcctcgtgtctgggtctccgtggacagtcgatcaccntcctctgcactggaaccngcagtgacgttggtagtaatactatgtctcgtagtaccaacagccaccgaggacaaaccgacccccaaactcagtagtatttagngtatcgtacaacgttaacgtccggtacccttcggtagggttttacctaagtccgttccttcgttcgtcggtcttaccgaagttcgtcggacaaccgtaccggcccttaccgtacgtaacctacttccgttccgtacggggtccctaccggacgggttacgtacgggaaacggggtacccggtagggtcttaacggttaactttaacgtttaccgtcggaccgtaggttccttacgtaacttaacctaacgaaccgaacctacccgaacgtaccttaacccggtcctttacgtaacggtttccgttacggttaaccggtaaccggttaaccgggtaaccgtacgggttacccgtaacccgggttacgtacggtacccacggaccccgtaacggtaccccaacccgtacgttccggtaccc

SEQ ID NO: 92764 - DNA, 1156 bp, Homo sapiens
  misc_feature: GYAE6OF01EB3GL.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggtagtttgggctgagtcgttgggtttttccttgttgtacttaattttaaaaggtgtccagtgtggaggtgcagcgtgggtggagtcggtggggggaggtacgttaggggtaaacggggtcccgggggggttcccttaacggacccgttcccccgttaggtaccacgtcccgttcgtaggtacttacctaaccgttttacgaacggttaacgggtcccgtaggggtaacttacggaaaccggttcggggtaccccggacccggtacgggccccgttacccgggaaacgggggggtaaacggggggtccgtttaggggggtaacggggtttacggggggtttaccgggtaacccggtttaaaaacgtttaaaaaaacccgtaaaaaacgttgggtaaaggttacgggggttaaacggggtaaaccgaaaaccggtaacgggtaaacccgttaacccgggtaccgttacgggaccccggtaaacccccgggttaaagggaaaaaccgggtaccgtaaacgggtaaacctttacccgaaaccccgttaaacttaacccgtaaaccgtaaaacgggtaacgtaaagtttaaaccggttaaaacgtttaaaaacccgaaaaaaacggtcccgtaaaacccgtaccgtttaaggttaaacccgttacccgttaaaggtaaaaccgttaaaaaaccgttaacgggtaaaacccgaaccggttaaccccgggtaaacggaaaaccggggtaaaacccgggaaccgggaaaaccctaaccgggtaacggttaccccgggtttaacggtttaaccttaaccggttaaccccgtttaaacccaaacccgttaacccggttaaccccccgtttaaaacgggaaaaacccggtttaacccggttaaaccccttaaaaccccgtttaaacccgtttaaacccggttaaaccccgggtttaaacggggttaaccggtttaaccgggtaaaccccccgggttttacgggaaccccgggggggtaaaaccccggg

SEQ ID NO: 92765 - DNA, 621 bp, Homo sapiens
  misc_feature: GYAE6OF01AGA8P.18.78.H01.1.454.CMB.1.raw
  modified_base (320)..(320): a, c, t, g, unknown or other
  misc_feature (320)..(320): n is a, c, g, or t
  modified_base (462)..(462): a, c, t, g, unknown or other
  misc_feature (462)..(462): n is a, c, g, or t
tcagtacgagtatgcacgaccggtgctcgatttagtgtgagtagtttggggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcacgtggaaccagcagtgacgtttggtagttataactagtgtcctccgtacggtaccaacacgccaccaggaccaaacgccccaaactcatgtatttatgatntcactaacgtcgcctgtagggtttactaactcgtcttctcgtgctcaagtctggacaacgaccggtccctcctcgaccacttcgtcgtcgggtcctccgagggtcctagggaacggacgtaggtacttagtatttacttacncgacagcttacataactaacgaacgaccaccgtagacctacttcctacttacgttcgttaccgttacggaaccgttccgggaacccgtaagggtacccgtacccgttccgtaacggttaccgaccgaccccgtaaacggcccccaaacccgtcgtaccg

SEQ ID NO: 92766 - DNA, 506 bp, Homo sapiens
  misc_feature: GYAE6OF01C9448.18.78.H01.1.454.CMB.1.raw
  modified_base (369)..(369): a, c, t, g, unknown or other
  misc_feature (369)..(369): n is a, c, g, or t
  modified_base (421)..(421): a, c, t, g, unknown or other
  misc_feature (421)..(421): n is a, c, g, or t
  modified_base (439)..(439): a, c, t, g, unknown or other
  misc_feature (439)..(439): n is a, c, g, or t
  modified_base (498)..(506): a, c, t, g, unknown or other
  misc_feature (498)..(506): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggcctcaggggtttctatcgtcttctctggctccaagtctggcaacacggcctcctgaccatctctgggcctccgaggctgaggacgaggtctgattattactgcagtctcatatacaagcagcagcactnaagtctcggaactcgggaaccagtcaccgtctagtcagcccagcccaacccntcgtcactctcgttcccnccctctaccctatactcgtactcgacgcgggctagggccaaggccgcgtatacggcagnnnnnnnnn

SEQ ID NO: 92767 - DNA, 580 bp, Homo sapiens
  misc_feature: GYAE6OF01D7VBO.18.78.H01.1.454.CMB.1.raw
  modified_base (454)..(454): a, c, t, g, unknown or other
  misc_feature (454)..(454): n is a, c, g, or t
  modified_base (562)..(562): a, c, t, g, unknown or other
  misc_feature (562)..(562): n is a, c, g, or t
  modified_base (568)..(569): a, c, t, g, unknown or other
  misc_feature (568)..(569): n is a, c, g, or t
  modified_base (571)..(571): a, c, t, g, unknown or other
  misc_feature (571)..(571): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (579)..(580): a, c, t, g, unknown or other
  misc_feature (579)..(580): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagccccaaactcatgatttatgatgtcagtaatcggcctcagggtttctaatcgcttctcgtggctcaagtctggacaacacggcctccctgacctatctcgtgggcctccgaggctggacggacgaggctagactttagtactgcagctacatactacaagcagcagctactacgaagttcgtacgggaactacgggacctaagggtcctaaccggtctaggtaccacggacccaacggcccaaccccgtntcgtacctacttccttccgttaccccacccgttccctaccctaacgttacccgtacctggaccggtccgggtccttacggggacaaccggggtcaccggtaagtagcncgtacnncncnancngnn

SEQ ID NO: 92768 - DNA, 856 bp, Homo sapiens
  misc_feature: GYAE6OF01DQK7A.18.78.H01.1.454.CMB.1.raw
  modified_base (200)..(200): a, c, t, g, unknown or other
  misc_feature (200)..(200): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagcttgggttttccttgttgcttaatttaaaggtgtccagtgtgaggtncagctgggtggaggtccggggagtcgttggtccaggccggtggggggtccctacggaaacctctaccgtgtgtacacgtccttcgttcgggttccaaccgtttcaggtacggtccttacgtacgtcgtacgtacgtcctaccggttcggggttcccgaccgtaacggggtacccgttaaccggggggaaacggggtaccgtggggtaacggggttcggggtttacgggtaccgttaaagttaaacggaaacgtacgaaaacggtaccttaaacgtaacggtttaaccggacgaaccgacggtactaaacgttaacgttcgaccggttacggtaccggttaccgggttaaagggaaaaccgggttcgtaaaccgggtttacccgaaccccggtttaaccgtaccggtaaaagtaaaacgttacgttaaacgttaaaccgaaacggtaaccgtaacgggttacgttacgttaccgtacgtaactaaacgttacgaaacgtaaccggtaaccgaaacggtaaaaccggacggtaaccggaccgggtacgttagttaacgttacgtacgtacgtaaacggtacgtagggtacgtaagttacgtagggtttagggtaacgttacggtacggtaaggggtaaacccggggtatccggtaacg

SEQ ID NO: 92769 - DNA, 765 bp, Homo sapiens
  misc_feature: GYAE6OF01C4LL0.18.78.H01.1.454.CMB.1.raw
  modified_base (613)..(613): a, c, t, g, unknown or other
  misc_feature (613)..(613): n is a, c, g, or t
  modified_base (660)..(660): a, c, t, g, unknown or other
  misc_feature (660)..(660): n is a, c, g, or t
tcagtacgagtatgcacgaccggtgctcgatttagtgtgagtagtttgggtttgggggctctggggagaggagctccagccttgggattcccagctgtctccactcggtgatcggcactgaatacaggagactcaccatgggagtttgggctggagtcgttggggtttttccttgttgtactttaagtttttaaaagggtcgtccagtgtagaggtgcagcgtggggtgggacggtccggggggaggtcgttcggccgtacgggtccggtcgggggggttccctaggaaaccttcgtccgtggtcggccacggtcccgtcggttccgggttacctaaccgtttcgaggttcggtccttactcggtctacgttcgaccgtccggttcggggtaccccggtccgacgggtccgggttaaccgggggaaacgggtcggttcgggggtaggttcggggttcgggtaccgttaagttaaggaacggtaacgaaacgacttaaacgtaagttaccgacgacagtactatagtcgctaggcgggtacgtaaggaacggtcgtaacggttccgaccttactacgaaagtaagtataacgtaacgaaagtacgcggtatacncgtagaactaagacaagtacgaacgaacggaacgacgacggtaccgngttacgtaacttgtaacgtacgtaagagtacgggttagtaacgttacgtagggttagggtactacgggttaacgacgggggttaaacgggtctaaacggttacgg

SEQ ID NO: 92770 - DNA, 607 bp, Homo sapiens
  misc_feature: GYAE6OF01B5PUP.18.78.H01.1.454.CMB.1.raw
  modified_base (326)..(326): a, c, t, g, unknown or other
  misc_feature (326)..(326): n is a, c, g, or t
  modified_base (543)..(543): a, c, t, g, unknown or other
  misc_feature (543)..(543): n is a, c, g, or t
  modified_base (595)..(595): a, c, t, g, unknown or other
  misc_feature (595)..(595): n is a, c, g, or t
  modified_base (598)..(607): a, c, t, g, unknown or other
  misc_feature (598)..(607): n is a, c, g, or t
tcagtacgagtatgcacgaccggtgctcgatttagtgtgagtagtttgggtttggggctttgcctgggcccagtctgccctgactcaacctgcctccgtgtctgggtctcctggacagtcgatcaccatctcctgcactggaaccagcagtgacgtttggtggttataactatgtctcctaggtaccaacagccacccaggacaaacgcccccaaaactcattgattttatgatggtcagtaactccggcctcgtaggggtttctaatcgtccttctcgtggtcctaccgaagttcgtggaccaacgaccggtcccttccccgtanacccagttcctccgtcgggaccttcccgaggtcctaggaggacgagggtcctagtatttattacgtggcagtactacaagtaataacgaaacgtcagacagaccacctagtaacgttctaacgggaactcgggaaccacggtccaacccgtcgtaaggaccacgcccaaccggaccccaacgtacgtcaccgtacctgtccccttcccacccttccncgtactaccgtctacgtacgacgccggctaggaccgtaacgcgtacagtacncgnnnnnnnnnn

SEQ ID NO: 92771 - DNA, 748 bp, Homo sapiens
  misc_feature: GYAE6OF01BRAB4.18.78.H01.1.454.CMB.1.raw
  modified_base (203)..(203): a, c, t, g, unknown or other
  misc_feature (203)..(203): n is a, c, g, or t
  modified_base (685)..(685): a, c, t, g, unknown or other
  misc_feature (685)..(685): n is a, c, g, or t
tcagtacgagtatgcacgaccggtgctcgatttagtgtgagtagtttgggtttgggggctttgcctgggtgctgttggtaccaggagacatagttataaccaccatctcctgcactggaaccagcagtgacgttggtgttataactatgtctcctggtaccaacagccacccaggccaaacgccccccaaatcatgtatttangatgtcagtaactccggccctgtagggttttcaatcgcttcgtcgtcggcctaccaagtctcggacctaacgccggtccctcccgtagaccctagtccgtcgtgggcccttccgaggtcctggaaccggtcgaggtcctaggtactttactaccgtgacctagcccttataacgtaactaacgacggaccaggtacccacgtaaccgttaccccgttacggaaaacggtttcccggttaaacgggaaccggttacgggggaaccccttaaggggtaccccctacccgggtttaccgtaacgggtcccaaccggacccccgtaacccggacccctaaacccccgtacgttaccggtacctacccgttaccggttccccgttcccccgtaccccctttaccccgtaccttaaccgttaccgttaccgtaacggtcggaccggtccgggtacgtacggacgtaaccggaccgtacgtaacgtcgntacgcgtacgcgtcgacgcgtacgtcctacggtctcgacgtcgacgtacgacttgctacgtcg

SEQ ID NO: 92772 - DNA, 769 bp, Homo sapiens
  misc_feature: GYAE6OF01BMDV7.18.78.H01.1.454.CMB.1.raw
  modified_base (763)..(763): a, c, t, g, unknown or other
  misc_feature (763)..(763): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactcggaaccagcagtgacgttggtggttaataactatgtctcctggtaccaacagccaccaggacaaaccgacccccaaactcatgtatttatgatgtcagtaactccggccctcgtagggtttactaactcgtcttctcgtggcctaccgaagtctggaccaaccgaccggtccctccctgacctactctcgtggcctaccgaggcgtagaggacggaggtctagtattacttactcgacacgtcctacaatactaacgaacgtcgaacgacgagacctaactaaccgtaacgttaccggttaaccgggtaacgtaaccggggtaacccgtaacgggtaccccgtaaaccccggttcccgtaaaccgggttacccgaaccggtaacccccggtaaacccggacccccgtaaaaccccccgtacgttacccgttacccgtaacccgtttaccccgtttccccggtttaaccccccctaacccccgttacccccttaacccctaaaccgttaccccgtttaacgttacccgttacgggtaccgggtacccgggtaccggtaccgggaaaccgtaacggggacccgtaccgtaagttacggcgtacacggacgtacgacgtacgacncgcgcg

SEQ ID NO: 92773 - DNA, 662 bp, Homo sapiens
  misc_feature: GYAE6OF01DF9HA.18.78.H01.1.454.CMB.1.raw
  modified_base (228)..(228): a, c, t, g, unknown or other
  misc_feature (228)..(228): n is a, c, g, or t
  modified_base (299)..(299): a, c, t, g, unknown or other
  misc_feature (299)..(299): n is a, c, g, or t
  modified_base (639)..(639): a, c, t, g, unknown or other
  misc_feature (639)..(639): n is a, c, g, or t
  modified_base (653)..(653): a, c, t, g, unknown or other
  misc_feature (653)..(653): n is a, c, g, or t
  modified_base (657)..(662): a, c, t, g, unknown or other
  misc_feature (657)..(662): n is a, c, g, or t
tcagtacgagtatgcacgaccggtgctcgatttagtgtgagtagtttgggtttggggtctttgcctgggcccagtctgccctgactcaacctgcctccgtgtctgggtctcctggacagtcgatcaccatctcctgcactggaaccagcagtgacgttggtggttataactatgtctcctggtaccaacacgcacccaggccaaacgcccccaaaactcatgatttangatgtcagtaatccggcctcgtagggtttctaatcgtcttcctcgtggtctccgaagtcctggacctaacnccggcccttccctcgacctacttccgtcgtcgggcctccgaggctaggacggtacgaggtctgtactttatccgtagcagtctacgtataacgtacgaaagcaagcgtaagacccgtaacttacgtaaggttcctttaaccgggaaacgttcggggaaaccaacgggttcccaaccggttacccgtagggtaccaaccgggacccaaaaccgggcccctaaaccccctgttacccgttacccgacccttccgttccccgttcccccgacccttcccctaacctccttaacccgtcgttaacgtcggtacggccggtaccgtcggaccgaacggcccgtanaacgttacgcacgncgcnnnnnn

SEQ ID NO: 92774 - DNA, 533 bp, Homo sapiens
  misc_feature: GYAE6OF01E4LMV.18.78.H01.1.454.CMB.1.raw
  modified_base (430)..(430): a, c, t, g, unknown or other
  misc_feature (430)..(430): n is a, c, g, or t
  modified_base (523)..(526): a, c, t, g, unknown or other
  misc_feature (523)..(526): n is a, c, g, or t
  modified_base (528)..(533): a, c, t, g, unknown or other
  misc_feature (528)..(533): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggttttctaatcgcttctctggctccaagtctggcaacacggcctccctgaccatctctgggctccaggctggaggacgaggctgattattactgcagctcatataacaagcagcagcactcaagttcttcggaactgggaccaaggtccaccgtcctaggtcagccccaaggcccaaccccnctcgtccaccttctaccgttccccaccccttccctccacttaccttccgtaacttcggacggtcgggctcgggccgaagggccgcaattacgnnnncnnnnnn

SEQ ID NO: 92775 - DNA, 628 bp, Homo sapiens
  misc_feature: GYAE6OF01EE4OS.18.78.H01.1.454.CMB.1.raw
  modified_base (242)..(242): a, c, t, g, unknown or other
  misc_feature (242)..(242): n is a, c, g, or t
  modified_base (304)..(304): a, c, t, g, unknown or other
  misc_feature (304)..(304): n is a, c, g, or t
  modified_base (390)..(390): a, c, t, g, unknown or other
  misc_feature (390)..(390): n is a, c, g, or t
tcagtacgagtatgcacgaccggtgctcgatttagtgtgagtagtttgggtttgggggctttgcctgggcccagtctcgcctcgactcacgcctgtcctccgtggtctggtctctggacagtacgatcaccatcctcctgcgtacgttgggaaccagcgaggttggttacgtttgggtaggttataacttatagtctcctggtaccacagcaccaggcaacgcccctaagtcgatgtattangatgtacagtatccggcctgtagggtttctagtcgtcgttctcgtcggtacctaccagtcgnggtacaacgccgtcctcctagacctatctcgtcggtcctcggaggcgagaggccgagggctgtacgttgtacgtcacgtagtctanaacgttatacgaacgtcaacgtacgactacacgtacgtacgttcgttacggacgtaacgggaacgtacgtaccgtaccgtacgtacgtacgaccgaccgaaacccgaccctaccgtattccgtctaccgttactcccgtcccaaccgttcctacgacttaaccggtcctaggtcggacggaccggggctacgggaaccgtacggctacgtggtacgctacacgtcagactagtcatcg

SEQ ID NO: 92776 - DNA, 302 bp, Homo sapiens
  misc_feature: GYAE6OF01B2RH1.18.78.H01.1.454.CMB.1.raw
  modified_base (262)..(262): a, c, t, g, unknown or other
  misc_feature (262)..(262): n is a, c, g, or t
  modified_base (292)..(292): a, c, t, g, unknown or other
  misc_feature (292)..(292): n is a, c, g, or t
  modified_base (297)..(302): a, c, t, g, unknown or other
  misc_feature (297)..(302): n is a, c, g, or t
tcagtacgagtatgcacgaccggtgctcgatttagtgtgagtagtttgggtttgggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaaggcccaaccccactgtccactctcgttccccaccctccnccatactcgtactgagcggctggcaaggcncatgnnnnnn

SEQ ID NO: 92777 - DNA, 962 bp, Homo sapiens
  misc_feature: GYAE6OF01EE6YR.18.78.H01.1.454.CMB.1.raw
  modified_base (236)..(236): a, c, t, g, unknown or other
  misc_feature (236)..(236): n is a, c, g, or t
tcagtacgagtatgcacgaccggtgctcgatttagtgtgagtagtttgggtttggggagctctgggagaggagctccagccttgggacttcccagctgtctccactcggtgagtcgcactgatacaggagactcacagtggtagtttggctgagtcgttcggttttccgttgttgtacttaagttttaaaggtcgtccgaggtgtgaggtgcgagtcgtggtggacgggtcggggnggtcgttcggtccgacggtccggtcggggtccctacgaactcgtcgtgtcgactacgtccgtcgttcggttacctccgttacgcgtcggtcctcgtacgtacgtacgtccgtacgtaccggttccgggtacccgtaccggtacgggtacccggttaaccggggtaaacgggtccggttacggggttacggtttaccgggggttaccgggtttaaccggttaacggtttaaaacggaacggtaaaccgtaaaacggttaacccgttaaaccggttaaccggtaacccggtaaccgaaccgtaacgtaacgttaacgttaacgtcggtacggttacggtaccgggttacggtaaacggtaaccgggtccgttaaccggtccccgtaacgttaaccggaacgttaaagtagttaacgtaacgggtttaaaacaaaccgggtttaaccgaacggttaccgttttaacgacccgttaaggaaaccttaaacgggtaaccaaaccggtaccggttaaaccgaaacccgggaaaacgggtccgggttacgtaacccccggttaggtttaacgtaaacggttttaacccgtaaacggttaaccgggtaccggtaaagggtacgggttttaaaccgtaaacggtttcgggttaaggggggttttaaacgggtaccttaacggggttaaccccggggaaaaccggggggttttaacgggttccctaaaacccgggg

SEQ ID NO: 92778 - DNA, 488 bp, Homo sapiens
  misc_feature: GYAE6OF01D6Y9J.18.78.H01.1.454.CMB.1.raw
  modified_base (285)..(285): a, c, t, g, unknown or other
  misc_feature (285)..(285): n is a, c, g, or t
  modified_base (427)..(427): a, c, t, g, unknown or other
  misc_feature (427)..(427): n is a, c, g, or t
  modified_base (443)..(443): a, c, t, g, unknown or other
  misc_feature (443)..(443): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (466)..(466): a, c, t, g, unknown or other
  misc_feature (466)..(466): n is a, c, g, or t
  modified_base (476)..(476): a, c, t, g, unknown or other
  misc_feature (476)..(476): n is a, c, g, or t
  modified_base (481)..(488): a, c, t, g, unknown or other
  misc_feature (481)..(488): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaaactcatgatttatgatgtcactaatcggccctcaggggtttctaatcgcttctctggctcaagtctggcaacncggcctcctgaccatctctgggctccgaggctggaggacgagctgattattactgcagctacatatacaacgcaccagcactctctatgttctcggactcgggaccaggtcaccgtcaggtcacgcccaaggcccaaccctntgtcactctcgtcccncctctcatctcgtcngngcggcnggacaggcanatgcnnnnnnnn

SEQ ID NO: 92779 - DNA, 738 bp, Homo sapiens
  misc_feature: GYAE6OF01AFMI6.18.78.H01.1.454.CMB.1.raw
  modified_base (332)..(332): a, c, t, g, unknown or other
  misc_feature (332)..(332): n is a, c, g, or t
  modified_base (734)..(734): a, c, t, g, unknown or other
  misc_feature (734)..(734): n is a, c, g, or t
  modified_base (736)..(738): a, c, t, g, unknown or other
  misc_feature (736)..(738): n is a, c, g, or t
tcagtacgagtatgcacgaccggtgctcgatttagtgtgagtagtttgggtttgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaatcatgtatttatgatcgtacactaactccggccctcgtagggggttttctaagtcgtccttctcgtcggctaccgtaagtcctggacaaccgaccggccctccctgaacctntctcgtgggcctccgaggctagacggacgtaggcttagatttactactcgacacgtctacaacttaacaacgaacgaccaccaagtccctaacttccttaaccgttagttccggttaccgtttaaccggggaaaccgtttaccgggggaaaccccgtaaacgggttcccccgtaacccgggtttacccggtttaaccgggtaccgaaacccggacccccgtaaaaccgggaccccccctaaaccccgtacgttaccggttacccctaccgtttacccctttacccggtttacccccccaacccccgtttaccctaacccgttacgttaacccgttaccggtaaccgttcggaacccgggtccggtaccgtacgggaccgaacgggtccagtaactggcacancnnn

SEQ ID NO: 92780 - DNA, 720 bp, Homo sapiens
  misc_feature: GYAE6OF01BWF66.18.78.H01.1.454.CMB.1.raw
  modified_base (228)..(228): a, c, t, g, unknown or other
  misc_feature (228)..(228): n is a, c, g, or t
  modified_base (257)..(257): a, c, t, g, unknown or other
  misc_feature (257)..(257): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatccaccatctcctgcacgtgggacnccacctccaacaggtcgggggtcggttangatgtacacgtcggtaccagcgacgtcgttaccagggaccaccgccccccaaactcctctatcgtttggacacaacacgtccggccctcgacggggtccctcgcccgtatttctcgtcgctaccgtaagtcgtacggcctaccgtcaccgtccctcctcggaccctagtccgacgtcgggtcctcccggagtcctaggtacgtaggacgtcgggtaacggtccgttaaggttaacttttaacgttacgtccgttacccgtaacgttacccgtttaagtaaccgttaaacctaccgtttaattaccgttcgtaaggtttcgggtacgggttcggggttccgggttacgggccggggtaacgggcccggtacgggttacgttacccggtacccgggttacgggtcgggtacccgtaccggtaaccccgggtacgggtaccccgttcccggtaccccccgttccgg

SEQ ID NO: 92781 - DNA, 612 bp, Homo sapiens
  misc_feature: GYAE6OF01A9PG9.18.78.H01.1.454.CMB.1.raw
  modified_base (304)..(304): a, c, t, g, unknown or other
  misc_feature (304)..(304): n is a, c, g, or t
  modified_base (354)..(354): a, c, t, g, unknown or other
  misc_feature (354)..(354): n is a, c, g, or t
  modified_base (370)..(370): a, c, t, g, unknown or other
  misc_feature (370)..(370): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcaccaggcaaacgcccccaaatcatgatttangatgtcagtaatcggcctgagggtttctaatcgcttctctgctccagtcngcaacacggcctcccngaccatctcgtgggctccgaggctgacggacgaggctgtaatttattacgtgcaggtcctacgtattaactaacgaacgcaaggcaacgcctaacctacgaacgttccgtttaaccgggaaccgtacggggtaaacccgtaaacggggttccctaaccccgggttcccgttaacgggttacccaaaccggtacccccgaaacgggacccccctaaacccccgcttccgtacccttaaccccg

SEQ ID NO: 92782 - DNA, 498 bp, Homo sapiens
  misc_feature: GYAE6OF01CES8O.18.78.H01.1.454.CMB.1.raw
  modified_base (492)..(498): a, c, t, g, unknown or other
  misc_feature (492)..(498): n is a, c, g, or t
tcagtacgagtatgcacgaccggtgctcgatttagtgtgagtagtttgggtttgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcacagcactctctatgtcttcgaactgggacaaggtcacgtctaggtcagcccaaggcccaacccactcgtcactctcgtcccgccctcctccatactcgactgagcgggctggcaaggcacgatacgnnnnnnn

SEQ ID NO: 92783 - DNA, 750 bp, Homo sapiens
  misc_feature: GYAE6OF01CZD9K.18.78.H01.1.454.CMB.1.raw
  modified_base (244)..(244): a, c, t, g, unknown or other
  misc_feature (244)..(244): n is a, c, g, or t
  modified_base (362)..(362): a, c, t, g, unknown or other
  misc_feature (362)..(362): n is a, c, g, or t
  modified_base (576)..(576): a, c, t, g, unknown or other
  misc_feature (576)..(576): n is a, c, g, or t
tcagtacgagtatgcacgaccggtgctcgatttagtgtgagtagtttggggtttgggggggggtctcgaggaggcagcgctctcgggacgtctccaccatggcctgggctctgctattcctcaccctcctcactcgagggcacgagggtcctgggccctaggtctcgccctgacctcaacctgcctcgtgtcgtggtcctcctggactagtcgatccacctatcctctagctacgtcggaaccngcaggtggtacggttggtaggttaataacgtagtcgtctccgtacggtaaccaacgacgaccaacccgaaggaaccaaaaccgtaccccctaaataccagttaacggtacttttaacnggttaactcgtaacctaacgtaacgttcccggcccgttagggttaacgggttacctaacgttccgtcttacgtactcggtcctaacgtacggtcgtacgtaccgtaaaccgcccgtccctaccgtacaacctccgtccgtcggtaccggtccgtacggacgtacgacgggaacgggtcgtaacggtacgttggttaacttagttacgcggtacncgtaaccttagaactaacgaacgtaacggactacgaaccgtaccgtactaacggtacttaacggtaccggttaaccggacggtacccggtaacgaccggttaacgacccggttacggtacgacgaacccgggacctaaacccgcccgtaaacccgtcgtacgtacccgttcccg

SEQ ID NO: 92784 - DNA, 727 bp, Homo sapiens
  misc_feature: GYAE6OF01B7HI5.18.78.H01.1.454.CMB.1.raw
  modified_base (232)..(232): a, c, t, g, unknown or other
  misc_feature (232)..(232): n is a, c, g, or t
  modified_base (458)..(458): a, c, t, g, unknown or other
  misc_feature (458)..(458): n is a, c, g, or t
  modified_base (467)..(467): a, c, t, g, unknown or other
  misc_feature (467)..(467): n is a, c, g, or t
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttggctgagcgttggttttccttgttgtcttaattttaaaaggtgtccagtgtgaggtgcgtagcgtgggtggagggtacccgggggnggtccgttcgggtcccaggccggttcggggggtaccctacggtaaacctccgttccgtggtcgccgtacgccgttcgttcgggtttacctaccttcgaggttcggtctcgtgtctagtcgcgtccggttcggcccgcgacggtccggttaccggggaaggcgttgggaggttgggttacggtaccgttaagtagaacgacgaagtactaagtacgtacgacgacgngactatagngccgtggtccggtaggtacggaacgtcgtaccgttaccgtaccgtaccgtacgaagtaaagtgaaacttaacgaaacgtaccggaacgtcgttaatcgtaagaacctaaatacgaaccacggaaccgaacggtaaaccgacggaacgacggtacctaagttaacttacgtagtaaccgagtacggtagtaggttaacgtaagttagggttacggtaacgttacggaccgggttaacggggaaaccggggttataaaccgg

SEQ ID NO: 92785 - DNA, 718 bp, Homo sapiens
  misc_feature: GYAE6OF01CKTI1.18.78.H01.1.454.CMB.1.raw
  modified_base (226)..(226): a, c, t, g, unknown or other
  misc_feature (226)..(226): n is a, c, g, or t
  modified_base (711)..(713): a, c, t, g, unknown or other
  misc_feature (711)..(713): n is a, c, g, or t
  modified_base (715)..(717): a, c, t, g, unknown or other
  misc_feature (715)..(717): n is a, c, g, or t
tcagtacgagtatgcacgaccggtgctcgatttagtgtgagtagtttgggtttgggggctttgcctgggcccagtctgccctgactcaacctgcctccgtgtctggtctcctggacagtcgatcaccatctcctgcactggaaccagcagtgtacgttggtggttataactatgtctcctggtaccaacagcacccaggacaaacgccccaaactcatgtatttangatgtacaagtaacgtccggtcctcgtaggggtttctaagttccgtctttctctcggtacctaccgtaagtctcggaccaaccgaccggcccttcccgtagacctacgttcctccgttcgggcctacccgaggtaccgtacggacggtacggaggtccgttagtaagtttacttaaccgtgacgtacgtccttaactacttaaacgaacgaacggaccctaaccgaacgtacctacctttacctacgttaagtttccggttaccgttaacgggtaacggtacgggaacctaacgggtaccctaacccggttaccgttaacgacccgaacgtaccccgaaccggtaccctacccctcgtaccgtaccctaccgttcccgttaccccgttcccctaccccgttccctacccgtatttaccccttacgtaacggtcggccggacgggtaccgtccgggaacgaccggtcgtacgaagtcgcagtcacnnncnnnc

SEQ ID NO: 92786 - DNA, 476 bp, Homo sapiens
  misc_feature: GYAE6OF01DOMZC.18.78.H01.1.454.CMB.1.raw
  modified_base (408)..(408): a, c, t, g, unknown or other
  misc_feature (408)..(408): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
  modified_base (457)..(457): a, c, t, g, unknown or other
  misc_feature (457)..(457): n is a, c, g, or t
  modified_base (465)..(474): a, c, t, g, unknown or other
  misc_feature (465)..(474): n is a, c, g, or t
  modified_base (476)..(476): a, c, t, g, unknown or other
  misc_feature (476)..(476): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctcctgaccatctctgggctcaggctgaggacgaggctgattactactgcagctcatatacaagtcagcagcactacagtcttcgaactggacaacgtcacgtcagtcagccagcacccntctcactctgtcccncctccncatctcgtactgacgcggctggcaggcncgatacgnnnnnnnnnngn

SEQ ID NO: 92787 - DNA, 654 bp, Homo sapiens
  misc_feature: GYAE6OF01AH13M.18.78.H01.1.454.CMB.1.raw
  modified_base (162)..(162): a, c, t, g, unknown or other
  misc_feature (162)..(162): n is a, c, g, or t
  modified_base (238)..(238): a, c, t, g, unknown or other
  misc_feature (238)..(238): n is a, c, g, or t
  modified_base (590)..(590): a, c, t, g, unknown or other
  misc_feature (590)..(590): n is a, c, g, or t
  modified_base (594)..(595): a, c, t, g, unknown or other
  misc_feature (594)..(595): n is a, c, g, or t
  modified_base (597)..(599): a, c, t, g, unknown or other
  misc_feature (597)..(599): n is a, c, g, or t
  modified_base (601)..(609): a, c, t, g, unknown or other
  misc_feature (601)..(609): n is a, c, g, or t
  modified_base (611)..(620): a, c, t, g, unknown or other
  misc_feature (611)..(620): n is a, c, g, or t
  modified_base (622)..(654): a, c, t, g, unknown or other
  misc_feature (622)..(654): n is a, c, g, or t
tcagtacgagtatgcacgaccggtgctcgatttagtgtgagtagtttgggtttgggggagagagaccccctcccctgggatcctgcagctccaggctcccggtggggtggggttagagttagggaacctatgaactatttctggtaggggccactgtcttcnccacggcctccctgaccatctcgtgggcctccgaggctaggaggacgaggctagtaatttatactgacagtcctanaattaactaacgaaaggcaaggaccaaggcctaaccgtactaaacggtttccgtttaacgggaaaaccggttacgggggaaaccctaaaacgggttccctaaaccccggttaccgttaaggggtacccaaaccggaacccccgtaaaaaccgggaccccccaaaaacccccgttagttccggttaacccctaaccccgtttcccggtttacccccggttttacccccccgcccccctttaccctaaccccgtaaacgtttaccccgtttaaccggttaaaccggttcgggaaccggggtcccggggtacgttaccggggaaccgaaaccggggccctaaactaaggtagcanagcnncnnncnnnnnnnnncnnnnnnnnnnannnnnnnnnnnnnnnnnnnnnnnnnnnnnnnnn

SEQ ID NO: 92788 - DNA, 625 bp, Homo sapiens
  misc_feature: GYAE6OF01BY13N.18.78.H01.1.454.CMB.1.raw
  modified_base (202)..(202): a, c, t, g, unknown or other
  misc_feature (202)..(202): n is a, c, g, or t
  modified_base (271)..(271): a, c, t, g, unknown or other
  misc_feature (271)..(271): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (302)..(302): a, c, t, g, unknown or other
  misc_feature (302)..(302): n is a, c, g, or t
  modified_base (333)..(333): a, c, t, g, unknown or other
  misc_feature (333)..(333): n is a, c, g, or t
  modified_base (353)..(353): a, c, t, g, unknown or other
  misc_feature (353)..(353): n is a, c, g, or t
tcagtacgagtatgcacgaccggtgctcgatttagtgtgagtagtttgggtttgggggctctgggagaggagctccagccttgggattcccagctgtctccactcggtgatcggcactgaaatacaggagactcaccagtggtagtttgggctgagcggtggtttcgtgtagtctagttaaagtgtcagtgtgagtcgcagngtggcgaggtccggggagtcttaggccgaggccgttcgggggtaccctagtaaccgtcgtcgtgtgccncgtcctcgtcgtctcctgngtgactnctgtntcgctcgtcgtcacgtcggacggtacggagngtagtggtggtcgacgttanagagacgaagaccgttaagagtaccgagtagatacgatactgacgttcggacggtagtaagaccggtcgtacgtaccgtacgtctaacgtaaggtatagtaacgtaacgaaacggtaccgtaacgcgtacgttacgaagacgtaagacgaacgacgtacgaaacgacgtaccggaacgtgtacgtacgtattacgtatacgtaacgtaggtcgtaggtacttaggtaacggttaggtacgtaggtacggtaacgggtaagtacgtagtaacg

SEQ ID NO: 92789 - DNA, 901 bp, Homo sapiens
  misc_feature: GYAE6OF01C1ICW.18.78.H01.1.454.CMB.1.raw
  modified_base (286)..(286): a, c, t, g, unknown or other
  misc_feature (286)..(286): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacaggagactcaccagtggtagtttgggctgagtcgttgggtttttccttgttgtacttaagtttttaaaaggtgtcagtgtgaggtgcagtcgtgggtgggagggtccgggggagtcgttggtccgaggtccggtcgggggtcctagaacctctcgtgtcgcncgtccgtcgttcgggttcctaccgttcgaggtcggtctcgtcgtactagtcgtaccgtacggttccgggtcccggaccgtacgggttcccgggttaaccgggggaaacgggtccgggttaggggtacggggtttcggggtttaccgggtaaccggttaaaggttaacggaacgtaacgtaaacggtaaccgttaaacggtacggttaaccggaccgtaacgaacgtactaagttacgtcggtacgttcgggtaccgggttacgggtaaacggaaacgggttccggttaccggttacccgaccgttacctaaccgaagttaaagtacgtaaagttaaaccggaaaacgtaccggttacggtaacttacgttacggtaacgtaaacaaggttaaccgaacggtaacccggaaaccggtaaaaccggaaaaccggggaccggtaaaccgggtaaccgggttacccgttaaggttaaccgtttaacggttaaccggaaacgtaggtaacgggttaaggggtaagttacggttaagggtttaacggggttaagggttaacggttacgggtaaacccggggtaacgggggttaaacggggttactaaccgggttaaccggg

SEQ ID NO: 92790 - DNA, 604 bp, Homo sapiens
  misc_feature: GYAE6OF01A540A.18.78.H01.1.454.CMB.1.raw
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
  modified_base (561)..(561): a, c, t, g, unknown or other
  misc_feature (561)..(561): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcaggtgacgtttggtgttataactatgtcctcctggtaccaacagcacccaggaccaaacgcccccaaactcatgatttangatntcataatcggccctcgtagggtttctaatcgtcttctctcggctctaagtctggaccacgacggtccctccctcgaccctagtcctcgtcgggccttccgaggtctaggacgggacggtaggcgtgtaactttacttacgtgaccgagtctactaactactacaagtacacgcacgtcctaactcgtaacgtcgttaccgggaacgtacgggtaaccgaacggtcctacccgtacgttacgggaccnccggacccgtaacggaccctaaccccgactccgtacctacccg

SEQ ID NO: 92791 - DNA, 858 bp, Homo sapiens
  misc_feature: GYAE6OF01EUOVR.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgctatttaaaggtgtccagtgtgaggtgcagctggtggaggtccgggggaggcttggtccaggccgtgggggtccctgaactctcctgtgcacgcctcgtgggttccaccgttcaggtggctctgctatgcacgtcgggtccgccgagggtccgttaccggggaaagggccgtggggaggttggggttcggccgttagttaaggaagacaaagctaaacgagttacgcgacagcatatgcgtggcgtgggagaaaggcgtaggtcctaccgtctaccgaagtaaacgtaggtaacttacgaaaacggaaccgtaccgggtaacgttaacgtacgttacgaaaccgtaaaacgtacggaaaaccgtaacggtaaccccgtaaacggaaaaaacccccggggtaacgggtaaacccgggtaaaccccgggggttacccggtttaacggttaaaaccgtttttaaacccgtttaaaccggggtttaaaaccgttaaacccggtaaaacccggggttaaggggtttaaaggggttaaacggtttttaaacccgggttaaaggggggtttttttacggggggggtaaaacggtttttaaaccggggttaacccgggggttaaaacccccggggggggttaaaaacccgggggggggtttttaaaccccgttaaaacccgggtttaaacccgggg

SEQ ID NO: 92792 - DNA, 658 bp, Homo sapiens
  misc_feature: GYAE6OF01CZJHD.18.78.H01.1.454.CMB.1.raw
  modified_base (253)..(253): a, c, t, g, unknown or other
  misc_feature (253)..(253): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (290)..(290): a, c, t, g, unknown or other
  misc_feature (290)..(290): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatcctcctgcactggaaccagcagtgacgttggtagttatactntgtctctgtacaanancaccagacaacgccccaaacncatgtatttatgatgtacaagtaactccggccctagtacggggtttactaactccgtcttctcgtggtcctacgtaagtcgtaggaccaacgaccggtcccctcctacgacctatccgtcgtcgggcctccgaggtcgtaggagggatggaaggtctagtacttaacttacgtcgtacctacgttacctaagtacgaactagtcgggtacggtcgttaggtcgggtttacggtttacgtagttcggttaccgtttacgggtcttacccgggtacgggtaaccgtaacgggttacccgtaacccggttaccgttaaacgtcccgtaaccgacccccggtaaccggacccccctaacccgttcgtacccg

SEQ ID NO: 92793 - DNA, 689 bp, Homo sapiens
  misc_feature: GYAE6OF01D2HHW.18.78.H01.1.454.CMB.1.raw
  modified_base (679)..(679): a, c, t, g, unknown or other
  misc_feature (679)..(679): n is a, c, g, or t
  modified_base (682)..(682): a, c, t, g, unknown or other
  misc_feature (682)..(682): n is a, c, g, or t
  modified_base (684)..(684): a, c, t, g, unknown or other
  misc_feature (684)..(684): n is a, c, g, or t
  modified_base (686)..(686): a, c, t, g, unknown or other
  misc_feature (686)..(686): n is a, c, g, or t
  modified_base (688)..(689): a, c, t, g, unknown or other
  misc_feature (688)..(689): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtgttataactatgtctctggtaccaacagcaccaggcaaacgccccaaactcatgatttatgatgtcactaactccggccctcgtagggtttctaatcgtcttctcgtcggcctaccaagttctcggacaaccgaccggccccttaccctacgaccccattcctcggtcgggtcctacccgaggcctaggaacgggaccggaggtcttaggtaactttacgttacgtgacacgctacaaactactaacgaacgtccaaccgagtccaccttcttacttagttacgttaccgtacggaaccgtacgggaaccgtaacggtccgtaacccgttccgtacggtacctaaccggacccgaccgggaaccccaaccccgtacgttacgttacccgactttcccgtacccgttcccccgtacccttcccctacccgtaaccttacccggttaccgttaccgtacgggacccgggtaccgggtccgacgggtaacccgaacgggtccgtacgtagtaacggctgcncgnancngnn

SEQ ID NO: 92794 - DNA, 320 bp, Homo sapiens
  misc_feature: GYAE6OF01EIF43.18.78.H01.1.454.CMB.1.raw
  modified_base (234)..(234): a, c, t, g, unknown or other
  misc_feature (234)..(234): n is a, c, g, or t
  modified_base (237)..(237): a, c, t, g, unknown or other
  misc_feature (237)..(237): n is a, c, g, or t
  modified_base (273)..(273): a, c, t, g, unknown or other
  misc_feature (273)..(273): n is a, c, g, or t
  modified_base (301)..(304): a, c, t, g, unknown or other
  misc_feature (301)..(304): n is a, c, g, or t
  modified_base (306)..(320): a, c, t, g, unknown or other
  misc_feature (306)..(320): n is a, c, g, or t
tcagtacgagtatgcacgaccggtgctcgatttagtgtgagtagtttgggtttggggtttctaatcgcttctctggctccaagtctggcaacacggcctccctgaccatctctgggctccaggctgaggacgaggctgatttattactgcagctcatatacaagcagcagcactcaagtcttacggaactgggaccaaggtccaccgtctaggtcacgcccaacgcccaacccntcncactcgtcgtccccgcccttcctacatactcgtacngacggcggtctggcaacggcgacatagnnnncnnnnnnnnnnnnnnn

SEQ ID NO: 92795 - DNA, 806 bp, Homo sapiens
  misc_feature: GYAE6OF01BRBLE.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggtagtttgggctgagtcgttgggttttccttgttgtcttaattttaaaaggtgtccagtgtgaggtgcagcgtggtggacggtccgggggagtcgttcggtccgaggtccggtcggggggtccctagtaaaccgtccgtccgtgtcgcacgtccgttcgtcgggttcctacctttcgaggtcggtcttcgtcgtcttagtcgccgtacggtccgggtcccgccgtacgggtccggttaccggggaaaggtccggttagggtagggttcgggttacggaccgttaagttaaggaacgtaacgaaagtacgtaaacgtacgttaacggaccgaacgaagtactaagttaacgtacgtcgtgggtaccggtacggggtaacggaaacgggtcccgtaacgggtttccctaacccggttccgtaaccgaaagtaaacgtacgtaacttaaacgaaaacgtacgtacggacttaagtcgtaacgaactaaagtacgaacgaccgtaacgtaacggaaaccgtaggaaccgtacgggtaccgttagtaaccgttacgttacgtacgtaaggtaccggtaggttaggttaacttaagggttaagggttaggggttaacgttaaccggacggggttaaaccggggttaacggggttaactaacgggttaaccggg

SEQ ID NO: 92796 - DNA, 333 bp, Homo sapiens
  misc_feature: GYAE6OF01AMTMC.18.78.H01.1.454.CMB.1.raw
  modified_base (233)..(233): a, c, t, g, unknown or other
  misc_feature (233)..(233): n is a, c, g, or t
  modified_base (301)..(302): a, c, t, g, unknown or other
  misc_feature (301)..(302): n is a, c, g, or t
  modified_base (304)..(306): a, c, t, g, unknown or other
  misc_feature (304)..(306): n is a, c, g, or t
  modified_base (308)..(308): a, c, t, g, unknown or other
  misc_feature (308)..(308): n is a, c, g, or t
  modified_base (310)..(333): a, c, t, g, unknown or other
  misc_feature (310)..(333): n is a, c, g, or t
tcagtacgagtatgcacgaccggtgctcgatttagtgtgagtagtttgggtttgggtttctaatcgcttctctggctccaagtctggcaacacggccctccctgaccatctctgggctccaggctgaggacgaggctgattattactgcagctcatatacaagcagcagcactcaagtcttcggaactcgggaccaaggtccaccgtctaggtcacgcccaagcccaaccccntgccactctcgttcccgcctcctccatacctcggtactgacgcgggctggacctagggccgctatagnncnnncntnnnnnnnnnnnnnnnnnnnnnnnn

SEQ ID NO: 92797 - DNA, 716 bp, Homo sapiens
  misc_feature: GYAE6OF01AQRSP.18.78.H01.1.454.CMB.1.raw
  modified_base (251)..(251): a, c, t, g, unknown or other
  misc_feature (251)..(251): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctcgtgtctgggtctcctggacagtcgatcaccatctcctgcactggaaccagcagtgacgttggtgttataactntgtcctctggtaccaacagcacccgaggacaaacgcccccaaactcatgatttatgatgtacagtaactccggccctgtaggggtttctaactcgtcttctcgtcggtcctaccgtaagttcgtacggacctaaaccgtaccggtccccttcccctacgtaacccctaagttcccttccgtacggggtccctacccgaagggtccgtaggacggggtaacggtacgggtcgttaggttaacttttaacgtttaaccgtcgtaccgtaacgtcccttaactaacttaacgtaaaccaaggaccgaaccgacgtaaacctacgtaaccttaccgtaaacggttccgttaaccgggaacgtaccggggaaccctaaccgggttaccgaaccccggttaccggtaacggtacccgtaccgaaccccgtaaaccggacccccaaccccgtacgttccgtccctaaccccg

SEQ ID NO: 92798 - DNA, 729 bp, Homo sapiens
  misc_feature: GYAE6OF01C5V70.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagtcgttgggttttccttgttgcttaattttaaaggtgtccagtgtgaggtgcagcgtggtggaggtccgggggagtcttggtccgaggtccggtcggggggtccctaggaacctcgtccgtgtcgcgtacgtcctcgtcgggttcctaccttcgagttcggcttcgtcgtctagtcgcgtacgtcgggtcccgcgtacggtccggttacggggaaggtcgtaggtggttgggtcggtacgttagtagaacgacgaaagtctaaacgtaggtacgcgaacgagacgatagtgtcgtgccggtaggtaggaacggtctacggtccacgttaccgacgaagtaaagtagtaactaagaaacgaacgtacggtctacgtcgaacgtacgaagtacgaacgaacgtacgtaacggaaaccggaaggaacccgacggttacgtacgttaacgttacgtacgtaacgtaacggtacggtacggttaggttaacttaacgggtaagggttttaggggaaacgtttcgggtaacccgggtaaaccggggggttaaccggggttaaacgttaacccggttaaacggg

SEQ ID NO: 92799 - DNA, 639 bp, Homo sapiens
  misc_feature: GYAE6OF01AWVCP.18.78.H01.1.454.CMB.1.raw
  modified_base (618)..(618): a, c, t, g, unknown or other
  misc_feature (618)..(618): n is a, c, g, or t
  modified_base (623)..(623): a, c, t, g, unknown or other
  misc_feature (623)..(623): n is a, c, g, or t
  modified_base (629)..(629): a, c, t, g, unknown or other
  misc_feature (629)..(629): n is a, c, g, or t
  modified_base (632)..(632): a, c, t, g, unknown or other
  misc_feature (632)..(632): n is a, c, g, or t
  modified_base (636)..(637): a, c, t, g, unknown or other
  misc_feature (636)..(637): n is a, c, g, or t
  modified_base (639)..(639): a, c, t, g, unknown or other
  misc_feature (639)..(639): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtgttataactatgtctctggtaccaacagcaccaggacaaacgccccaaactcatgatttatagatgtacagtaactccggcctacgtaggggttactaatcgtcttactctcggctaccgtaagtctaggacaaccgaccgcctcccgtgaccactctcgtcggctaccgaggtctaggacggacgagtctagtaattacttactcggacacgtactactaataacacaaacgtcaccagactaccgtctactagtacgttacgttaccggaacgttcgggaactaacggtccaacccgttcgtacgtaccaaccgtacccgaacggtaccccaaaccctagtccgttaacctacttacccgttaccttacccccgtacccttaccgtaccctaacgtacctacgtaaccgtgggactccggggtactcggaacgaccgggtactacgaacggttancgtanacgtcncgnacgnngn

SEQ ID NO: 92800 - DNA, 662 bp, Homo sapiens
  misc_feature: GYAE6OF01AV35U.18.78.H01.1.454.CMB.1.raw
  modified_base (359)..(359): a, c, t, g, unknown or other
  misc_feature (359)..(359): n is a, c, g, or t
  modified_base (652)..(652): a, c, t, g, unknown or other
  misc_feature (652)..(652): n is a, c, g, or t
  modified_base (656)..(656): a, c, t, g, unknown or other
  misc_feature (656)..(656): n is a, c, g, or t
  modified_base (658)..(658): a, c, t, g, unknown or other
  misc_feature (658)..(658): n is a, c, g, or t
  modified_base (660)..(660): a, c, t, g, unknown or other
  misc_feature (660)..(660): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaaacgcccccaaactcatgatttatgatgtcacctaatccggccttcgtaggggtttctaatcgcttctctggctaccagtctggacaacaccggcctccctgaccatcttcgtcgggcctccgaggctggagggcggaggcttaggattacttacgngacacgtcttacaactaactaacgaagccaacgaacgcacttccttacttacgtcgttacgttaccggtaacgtcggggaacctaacggtccctaaccccggttacgtacgggtcctaaccgaccccgtaaaccggaaccccaaccccctagtaccgtaccctaccgtctttaccccgtaacccccaccccttccctaacctaccgttaacccgttacgtaccggttaccggccgggtaccgggtacgtacggggacccggtagggacccgtactacggtagtccgagctacncgancngngc

SEQ ID NO: 92801 - DNA, 701 bp, Homo sapiens
  misc_feature: GYAE6OF01CLFNK.18.78.H01.1.454.CMB.1.raw
  modified_base (427)..(427): a, c, t, g, unknown or other
  misc_feature (427)..(427): n is a, c, g, or t
  modified_base (452)..(452): a, c, t, g, unknown or other
  misc_feature (452)..(452): n is a, c, g, or t
  modified_base (679)..(679): a, c, t, g, unknown or other
  misc_feature (679)..(679): n is a, c, g, or t
  modified_base (684)..(684): a, c, t, g, unknown or other
  misc_feature (684)..(684): n is a, c, g, or t
  modified_base (690)..(690): a, c, t, g, unknown or other
  misc_feature (690)..(690): n is a, c, g, or t
  modified_base (693)..(693): a, c, t, g, unknown or other
  misc_feature (693)..(693): n is a, c, g, or t
  modified_base (695)..(701): a, c, t, g, unknown or other
  misc_feature (695)..(701): n is a, c, g, or t
tcagtacgagtatgcacgaccggtgctcgatttagtgtgagtagtttgggtttgggggctttgcctgggcccagtctgccctgactcaacctgcctccgtgtcgtggtctcctggacagtcgatcaccatcctccgtgcacgtacggaaccagacaaggtcggtacggtttggttaggttaaacttaaactgttcgtccttaccgtacggtaaccaaacgacgacccaacccgaacggaaccaaaacccgtacccccctaaatacattagttaatttagataagtcgtaactaacgtaaccgtccggtaccgtacggttacgggtttctaactcgtaccttcgtcgtggtacctacgtagtcgtacgaccaaccggccgtcctccgacactacgtcgtcgacgcgtacgacgtcggaggacggacgnggtacttagtaacttactaccggtnacgtacgcttaactataaacgaaccgacgtacaccgactactacttcgttagtacgtaccgttccggaacggaaccgtaccggtaccgtaaccggtcccgttaacgtccgtaccggccgaaacccgacccgtaacccacccgtaaccctcgtaccgtcccttacgcccttaccctcccctaaccgtccctaactaccgtacgttcgacgtcgcggacgtcgacgganaccgnactgcncgncnnnnnnn

SEQ ID NO: 92802 - DNA, 714 bp, Homo sapiens
  misc_feature: GYAE6OF01ESWNE.18.78.H01.1.454.CMB.1.raw
  modified_base (215)..(215): a, c, t, g, unknown or other
  misc_feature (215)..(215): n is a, c, g, or t
  modified_base (400)..(400): a, c, t, g, unknown or other
  misc_feature (400)..(400): n is a, c, g, or t
  modified_base (428)..(428): a, c, t, g, unknown or other
  misc_feature (428)..(428): n is a, c, g, or t
tcagtacgagtatgcacgaccggtgctcgatttagtgtgagtagtttgggtttggggggggtctcaggaggcagcgctcgtcgggacgtctccaccatggcctgggctctgctattcctcaccctcctcactcagggcacagggtcctgggcccagtctcgccctgactcaacctgcctcgtgtcgtcggtctacgtgagtcgtcactccaactntccctctgaccacgtacgaaccagtacgtaggtgtacggttggtagttaacttatagttcgtcgtaccgttacgaaccaacgcaaccaccgacggaaccaaacccgtaaccccctaaatcctagttacgttaatttagacgtacgttcgaacttaactaccggccggtccttagggttcggttanacgttccgtcttcgtcgtccgtacctanaggttcaccgacgaacccgtcctccctaccggataaccgttcgtcggttacgcggtcctaacggtcgtagaggaccggtagtacgtagtagtttaacttagtactacgtatacgtactataacgttacgaacgacaacctaacggactactaccttattaccgtacttccggttaccggtaaccggtacgtaaccgggtaaccgtaaccggtacccgttaccgacggtttaccgacccgttaaccggaccccgtaacccaccccgtaaccgtccgtacttaccccg

SEQ ID NO: 92803 - DNA, 811 bp, Homo sapiens
  misc_feature: GYAE6OF01EEKH1.18.78.H01.1.454.CMB.1.raw
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatccaccatctcctgcactggaaccagcaggtgtacggtttggtggttaataactagtcgttctcctggtaccaacagccaacccaggaccaaaacgcccccaaacgtcatgtatttatagatcgtacaacttactccggtcccttcgtaacggggtttacttaacgtcggtctttacgtccgttaggtcctacccgtaaaggttcctacggtaccaaacccgtaacccgggtccccttacccccgtacggaccccgtaaacgttccgtccggttcgggtcccttacccggacggggtccggttagggaacgggtaaccgggtaacgggtccttaaggttaagttttaacgtttaacgtacggtcctacgtaccctacgtaattaaacgttaaccgaaacgaccgaacccgtaacgtacccttaaccttaccctttacgttaccgttaggttaccccgtttaaccgggtaaaccggtttaccgggggaaacccttaaacggggttacccctaacccgggttaccccggttaaacgggtacccgtaaacccggtaacccccgtaaaaccgggaccccccctaaaaccccggttacccgttaaccccgg

SEQ ID NO: 92804 - DNA, 638 bp, Homo sapiens
  misc_feature: GYAE6OF01EZBA8.18.78.H01.1.454.CMB.1.raw
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (437)..(437): a, c, t, g, unknown or other
  misc_feature (437)..(437): n is a, c, g, or t
  modified_base (577)..(577): a, c, t, g, unknown or other
  misc_feature (577)..(577): n is a, c, g, or t
  modified_base (585)..(585): a, c, t, g, unknown or other
  misc_feature (585)..(585): n is a, c, g, or t
  modified_base (600)..(600): a, c, t, g, unknown or other
  misc_feature (600)..(600): n is a, c, g, or t
  modified_base (622)..(622): a, c, t, g, unknown or other
  misc_feature (622)..(622): n is a, c, g, or t
  modified_base (625)..(626): a, c, t, g, unknown or other
  misc_feature (625)..(626): n is a, c, g, or t
  modified_base (628)..(628): a, c, t, g, unknown or other
  misc_feature (628)..(628): n is a, c, g, or t
  modified_base (631)..(632): a, c, t, g, unknown or other
  misc_feature (631)..(632): n is a, c, g, or t
  modified_base (634)..(638): a, c, t, g, unknown or other
  misc_feature (634)..(638): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtagttataactatgtctccgtggtaaccaacagaccacccgaggaccaaaccgacccccaaaatcattgatttangatgtacagtacnccgcctgtagggttctaagtcgtcttctctcggctaccgtaagtcgtacggacaaaccgtccgggtccccttaccccgtacgtaaccctacgttccgttaaccggtcgggtacccttacccgagggtccgttaggaacgggaccgaggtccgttagtaaacttttacgttaactcgacgacgacttaanaacttaagaaaccgaacggaccctaacgacgtactaccttcgttactattccggtacgttacgaacggttggaaccgacggtcctaccgtacgtacgtcaaccgacccaacgtacccacccgtcttacactctcctcccnccttaccncctatacctcgtacngcggcgacgtggaccaggcacntannancannannnnn

SEQ ID NO: 92805 - DNA, 666 bp, Homo sapiens
  misc_feature: GYAE6OF01C84H7.18.78.H01.1.454.CMB.1.raw
  modified_base (254)..(254): a, c, t, g, unknown or other
  misc_feature (254)..(254): n is a, c, g, or t
  modified_base (525)..(525): a, c, t, g, unknown or other
  misc_feature (525)..(525): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgtacgttggtgttaataactntcgtctcgtgtaccaacagccacccgaggaccaaacgaccccctaaactcattacgtaatttacgtagtagtcgtcgtaagtaacgtccggtcccttacggtacgggtttacaacgttccgtcttctacgtcggtacctaccgaagttcctacgggaccaaccgtacccggtccctacccgtacgacctacttccgtcggtggtccctacggcgtacgtcggaaacgggtcgagtcttaagtacttttatacgtcgaccgtagtccttaanaacttactaacgaagtcaaacggtccgaactcgtaaccgtacgtacggttacccggttaggaaaccgtccgggtaaccgacgttccgacccttacggacgtacaccgggaacccacggacccctaaccgctcgtcctaccg

SEQ ID NO: 92806 - DNA, 908 bp, Homo sapiens
  misc_feature: GYAE6OF01D5AJK.18.78.H01.1.454.CMB.1.raw
  modified_base (130)..(130): a, c, t, g, unknown or other
  misc_feature (130)..(130): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacgagganactcaccagtggtaggtttggctgagtcgttgggtttttccttgttgtactttaaagttttaaaaggtgtaccgaggttggtggaggtgacgagtcggttgggtgggacggggtccgggggaggtcgttcggtccgacggtccggtcgggggtaccctacgtaacttccgtcgtgtcgcgtacgtccgttcgttcggttacctaccttcgtaggtcgtcttcgtgtactagtcgtaccgtacggttccgggtcccgtaccggtacgggttacccgggttaaaccggggtaaaggggtcggtaggggttacgggttcggggttacggtaaccggtttaaggtaaaggaaacgaaccgtaaaacgtaaccgtaaaccggtacggttaaccgaccgaacgtacgacgtaaggttacgcggtacgtacgggtacgggttaagggtaaacggtaacgggtaccgtaccggttacccgtaacccgttaccgtaaacggtaaagtaacgttaagtaaacctaaacggaaaaccggtaacgtaccggtaagttaccgttaagtaaccgtaaactaaaggtaaccaaacggtaaccctaaacggtaaaacggaaaccgggaccgtaccggtaaccgtagttaacgttaacgttaacgtaacgtaaacgtaaggtaacggttaacggtaggtttaacggttaacggttacggggtttaagggttaacggttaacggggacccggggttaaaaacgggggttaaccggggttacctaaccgggtaacgg

SEQ ID NO: 92807 - DNA, 588 bp, Homo sapiens
  misc_feature: GYAE6OF01CJBGN.18.78.H01.1.454.CMB.1.raw
  modified_base (473)..(473): a, c, t, g, unknown or other
  misc_feature (473)..(473): n is a, c, g, or t
  modified_base (568)..(588): a, c, t, g, unknown or other
  misc_feature (568)..(588): n is a, c, g, or t
tcagtacgagtatgcacgaccggtgctcgatttagtgtgagtagtttgggtttgggggctttgcctgggtgctgttggtaccaggagacatagttataaccaccatctcctgcactggaaccagcagtgacgttggtggttataactatgtctcctggtaccaacagcacccaggcaaacgcccccaaactcatgtatttatgatgtacagtaacgtcggccctacgtacgggggtttctaatcgtcttctcgtggctaccaagtctcggacaacgacggccctccctgacctatctcgtgggcctccgaggctggaggacgaggtctagtatttatactgacgagctactaataacgtaacaagccaagtccaacgctaacctacgaacgttccggttacggaacgtacgggaacctaaagggtcctacccggttacgtacgaccgaccgacccaacggccctaaaccccgntcgtacctacctccttaccgttaccccaccctccctaccattaccgtcgtaacgtggacggccgggtctagggaccaacggcgtacaagttcgannnnnnnnnnnnnnnnnnnnn

SEQ ID NO: 92808 - DNA, 573 bp, Homo sapiens
  misc_feature: GYAE6OF01EY57V.18.78.H01.1.454.CMB.1.raw
  modified_base (244)..(244): a, c, t, g, unknown or other
  misc_feature (244)..(244): n is a, c, g, or t
  modified_base (564)..(573): a, c, t, g, unknown or other
  misc_feature (564)..(573): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaaatcatgatttatgatgtcagtaatcggccctntaggggtttctaatcgcttctctggctcaagtctggacaacacgcctccctgaccatctcgtcgggctccgaggctaggaggacgaggtctagtatttacttactgcagctacatatacaagcagcagcactacaagtcgttacggaacgtacgggaaccaacggtcctaccgtacgtacggtacaacgacccgaacggaccctaaacccccgtactacgtacctaaccttcccttaccggttccccgaccccttcccttaccctaccgttaccttcgtactggtacggccggcgtcggacgaacggtcgacacgtagcnnnnnnnnnn

SEQ ID NO: 92809 - DNA, 754 bp, Homo sapiens
  misc_feature: GYAE6OF01DM02U.18.78.H01.1.454.CMB.1.raw
  modified_base (745)..(745): a, c, t, g, unknown or other
  misc_feature (745)..(745): n is a, c, g, or t
  modified_base (750)..(750): a, c, t, g, unknown or other
  misc_feature (750)..(750): n is a, c, g, or t
  modified_base (753)..(753): a, c, t, g, unknown or other
  misc_feature (753)..(753): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatcctcctgcactggaaccagcagtgacgttggtgttatactatgtctcctggtaccaacacgcacccaggaccaaaccgcccccaaactcatgtatttatgatgtctaattaactccggccttcgtaggggtttacaacttcgtcttctctggtcctccgtaagttcgtaggaccaaccgtacggccccttccgtacgaccctaacgttccgtcgtcggggtccctaccgagggtccttacgggacggacggacgggtcttggtaactttacttacgtagcctacgccttactaaatacgtaacaaacggcacggtaccaacgacctacgttacgtaaacggtttccgttaacgggaacggtacgggtaacccgtaacgggttacctaacccgggttacccgttaacggtcccggaaccgtacccccggaaacccgggtaccccctaaaccccgtacgttacccgtaccctaacccgtttccgtttaccccgttacccctacccctaccccgttacctaaccgtttaccgttacccgttacggtccggtacgggtacccgggtcgtaccgggacccggaacggtaccggtactaggtaacgcgtacgcctagaccnatcgntcnc

SEQ ID NO: 92810 - DNA, 725 bp, Homo sapiens
  misc_feature: GYAE6OF01C5KPI.18.78.H01.1.454.CMB.1.raw
  modified_base (189)..(189): a, c, t, g, unknown or other
  misc_feature (189)..(189): n is a, c, g, or t
  modified_base (224)..(224): a, c, t, g, unknown or other
  misc_feature (224)..(224): n is a, c, g, or t
  modified_base (705)..(705): a, c, t, g, unknown or other
  misc_feature (705)..(705): n is a, c, g, or t
  modified_base (719)..(719): a, c, t, g, unknown or other
  misc_feature (719)..(719): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaanagcacccgagcaaacgaccccaaatcatgatttangatgtacaagtaacgtccggcccttcgtacggggttttactaacgtcgtctttcgttcctgggcctaccgtaagtccgtagggaccaaaccgaccggccccttcccgcgaacctacttaccgtcgtgggccttcgacggccgtgaggacgtagctagtattaagtactgacgatcgtactaataagtaaccaaacggaccaaccgaagtcctaccttctactttaagcgtttccgttacgggtaacccgttcgggaaaccgtaacggttccgaacccgtttccggtaacggttaccgaaccgtacccccgaaacggtaccccctaaccccgtacgtaccggttaccaacccgtttcgtttaccccgttacccccggtacccctttcccgtaaccctattaacccgttacccgttaacggtccgaaccggggtacccgggcttacggggacgtaaaccggcgttacccgaagttacccgganctacgacacacgcncgcgac

SEQ ID NO: 92811 - DNA, 612 bp, Homo sapiens
  misc_feature: GYAE6OF01D9SES.18.78.H01.1.454.CMB.1.raw
  modified_base (365)..(365): a, c, t, g, unknown or other
  misc_feature (365)..(365): n is a, c, g, or t
  modified_base (566)..(566): a, c, t, g, unknown or other
  misc_feature (566)..(566): n is a, c, g, or t
  modified_base (600)..(600): a, c, t, g, unknown or other
  misc_feature (600)..(600): n is a, c, g, or t
  modified_base (607)..(612): a, c, t, g, unknown or other
  misc_feature (607)..(612): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggaccaaacgcccccaaactcatgtatttatgatgtcagtaatccggccctcgtaggggtttctaatcgtcttctctcggctaccgaagtctggaccaacgacggccctccctgacctactctcgtcgggctccgaggcgtggacggacgaggctagtatttattacngcacgctactatactaacgaacgacagacgagcctaactacgtaagttccgttacgggtaacgtacgggtaaccaacgggtaccaccggttacccgtagggtaccaccggacccgaacgggaccccaaaccccgtctaccgtacctaaccttccgttcccttacccccgtacccttcctacctacttacccgtcgttaacnggacgccgggctacgggacgacgggctcagtagnagcagcnnnnnn

SEQ ID NO: 92812 - DNA, 680 bp, Homo sapiens
  misc_feature: GYAE6OF01D0KF2.18.78.H01.1.454.CMB.1.raw
  modified_base (254)..(254): a, c, t, g, unknown or other
  misc_feature (254)..(254): n is a, c, g, or t
tcagtacgagtatgcacgaccggtgctcgatttagtgtgagtagtttggggtttggggggggtctcaggaggcagcgctctcgggacgtctccaccatggcctgggctctgctattcctcaccctcctcactcagggcacgagggtcctgggcccagtctgccctgactcaacctgcctccgtgtctgggtctcctggacagtcgatcaccatctcctgcactggaaccagcagtgacgttggtgttataactntgtctctggtaccaacagccaccagacaaacgacccccaaactcatagtatttatgattgtacaaggttaactccggtcccttacgtacgggtttactaagtccgtcttctcgtcggcctactaagtcgtacggacaaccgaccggcctccgtacgacctatcctcgtcggcctaccgaggctaggacggacgacgtcgtagtaattacgttacgtgacgtacgtactaccgtaataacgtaacaagtaccgaacgactaacgacctaaccttacgtaacgggttacccttacgggaaaccggtaccgggaaaacccgttacggtaccccgttaaccccgggttaccgttaaccggtacccgaaccggaacccccggtaaacgggtaaccccccaaccccgtaacggttcctacccgttaaccccg

SEQ ID NO: 92813 - DNA, 757 bp, Homo sapiens
  misc_feature: GYAE6OF01DVM5Q.18.78.H01.1.454.CMB.1.raw
  modified_base (233)..(233): a, c, t, g, unknown or other
  misc_feature (233)..(233): n is a, c, g, or t
  modified_base (321)..(321): a, c, t, g, unknown or other
  misc_feature (321)..(321): n is a, c, g, or t
tcagtacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtccgaatccaccatcctcctgcactggaaccngcagtgtacgttgggtagttataactatgtctccgtagtaccaacagccaaccgagaccaaaccgccccaaatcactagtatttacgngatcgtactaactaagtccgtacccttagtacggggtttactaatcgtaccttctacgtggtacctacgaacgtcgtacggacctaaccgaccggtccctaccgtagaccctatccctcgtacgggccctcggacgtcgtgggaacggtacgaacgggtcttaacgagtttaactacgtcgacgtacgtacttaccaaagttaccgtaacgaaccggtacccaaccgggtactacccgtacgtttaccttaccggtttacttacggggttacccgtttaaacccggggaaccggtttacgggggaaaaccccctttaaggggtacccccggtttaacccggtaaaccccgggtttacggaaaccccgttaaccccgggtaaccccccgaaaacccgggaacccccccctttaaaaccccgccgggtttacccccgg

SEQ ID NO: 92814 - DNA, 783 bp, Homo sapiens
  misc_feature: GYAE6OF01B9YIZ.18.78.H01.1.454.CMB.1.raw
  modified_base (240)..(240): a, c, t, g, unknown or other
  misc_feature (240)..(240): n is a, c, g, or t
  modified_base (278)..(278): a, c, t, g, unknown or other
  misc_feature (278)..(278): n is a, c, g, or t
  modified_base (489)..(489): a, c, t, g, unknown or other
  misc_feature (489)..(489): n is a, c, g, or t
  modified_base (536)..(536): a, c, t, g, unknown or other
  misc_feature (536)..(536): n is a, c, g, or t
tcagtacgagtatgcacgaccggtgctcgatttagtgtgagtagtttggggtttgggggggggtctcaggaggcagcgctcgtcgggacgtctccaccatcggcctgggctctgctattcctcaccctcctcactcgagggcacgagggtcctgggcccagtctcgcctgactcaacctgcctcgtgtcgtgggtctcgtggacagtcgatcaccattcctcctgactacgtaggaaccngctaaggtggtacggtttgggtagtttaactaacgttntcggttaccttccgtacggtaacccaaacgacgacccaacccggaacggaaccaaaaccccgaccccctaaaactctaagtagttaactttagagtattacgtactaagttacgtccggtacccgttggttaacgggtttactacgttcgtctttcgtcgtcgtacctacgacgttcgacgactaaccggccgtacttcccgagtaacctnttccggtcggtcgacccgttcggacggtcgtaagggaacgggtacgnggttacgtagttaacgtttagttaccgcgaacgttctaccgttaaacaaattacctaaacggactacgaacggtacctacggtacctaacgttaacggtacggtttccgtaaaccgggtaaccgggtaacgtaaacccgttaaccggttcccggtaaacccgttaccgtaacggggaccctaaacccgggacccggttaaaaccccggaacccccttacccaaccggttcgtaaccccgttacccgg

SEQ ID NO: 92815 - DNA, 598 bp, Homo sapiens
  misc_feature: GYAE6OF01E3WYH.18.78.H01.1.454.CMB.1.raw
  modified_base (289)..(289): a, c, t, g, unknown or other
  misc_feature (289)..(289): n is a, c, g, or t
  modified_base (365)..(365): a, c, t, g, unknown or other
  misc_feature (365)..(365): n is a, c, g, or t
  modified_base (583)..(583): a, c, t, g, unknown or other
  misc_feature (583)..(583): n is a, c, g, or t
  modified_base (587)..(587): a, c, t, g, unknown or other
  misc_feature (587)..(587): n is a, c, g, or t
  modified_base (592)..(592): a, c, t, g, unknown or other
  misc_feature (592)..(592): n is a, c, g, or t
  modified_base (595)..(595): a, c, t, g, unknown or other
  misc_feature (595)..(595): n is a, c, g, or t
  modified_base (597)..(598): a, c, t, g, unknown or other
  misc_feature (597)..(598): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggccctcgaggggtttctaatcgtcttctctggcctccaagtctggcaacncggcctccctgaccatctctggctccgaggctggaggacgagggctagtattattacgtcgcagtcctcgaattanaacgtaagcaaggcaacgcactacgtaacgttccgttacgggaacttcggggaacctaagggtccaccgtccgtaggtccacgtacccgaaccgcccaaacccctacgtcgtaccctaccttcttcccgttacccccacccgttcccctaccgtacttaacccgtccggttacgtcggacgggtcccggctcgggacaacgggtccgactacgaggtncgantcacngcngnn

SEQ ID NO: 92816 - DNA, 593 bp, Homo sapiens
  misc_feature: GYAE6OF01B9PH0.18.78.H01.1.454.CMB.1.raw
  modified_base (253)..(253): a, c, t, g, unknown or other
  misc_feature (253)..(253): n is a, c, g, or t
  modified_base (387)..(387): a, c, t, g, unknown or other
  misc_feature (387)..(387): n is a, c, g, or t
tcagtacgagtatgcacgaccggtgctcgatttagtgtgagtagtttggggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtgttatactntgtctctgtacaacagcaccagacaaacgacccccaaactcatgtatttatgatgtacagttaagtccggcctagtagggtttactaagtcgtcttctctggctacagtctgacaacacggtcctcctcgaccncgtctcgtcggcctcgacggtcgtacggacgggtagacggtctaggtactttaacttacgtcgactagtcctacgtactaacgtaacaacgtacacgcagacactaacgacgttacgtacggaacgtcggaaaccgtagtccgtaaccgtcgtacggaccgtaccgacccgtaaaccggaccccaacccgctccgtaccttacccg

SEQ ID NO: 92817 - DNA, 842 bp, Homo sapiens
  misc_feature: GYAE6OF01ECOL2.18.78.H01.1.454.CMB.1.raw
  modified_base (188)..(188): a, c, t, g, unknown or other
  misc_feature (188)..(188): n is a, c, g, or t
  modified_base (816)..(816): a, c, t, g, unknown or other
  misc_feature (816)..(816): n is a, c, g, or t
  modified_base (826)..(826): a, c, t, g, unknown or other
  misc_feature (826)..(826): n is a, c, g, or t
tcagtacgagtatgcacgaccggtgctcgatttagtgtgagtagtttgggtttgggggctttgcctgggcccagtctgccctgactcaacctgcctccgtgtctggtctcctggacagtcgatcaccatctcctgcactggaaccagcagtgacgttggtgttatactatgtctcctgtaccaacgancaccaggacaaacgcccccaaatcgactgactttagtgatgtctagtaacgtccggacccttcgtaggggtttcttaacgtccgtactttccgtcgttcggacctaccgtaacgtccgtaggtacccaaccgaccggtacccccttcccgtaccggacccctatttaccgtccggttacggggtaccctaccgggtaacgggtccgttaacgggaacgggaccgtacgggtcttaaggtactttttaacgtaacgtcgtacgtaggtaccttaccgtaaagttactaaccgaaagtaccgagtcctaaacggacctaacgttccaaacggtttcgtaaccgggaccttacggggaaccgtaaacgtccgtaacccgttcgtaacggtaccgtaacccgtaacccggaacccgggtacccctaaaccccgtacgtttacgttaccccgtaaccgttttaccccgtcccggtttaaccccctaccccccgttacccggttaacccttaacccggttacgttaccccggttaagggaccccgggtagggttaccccgtaacggggtaacccgtaaaccgggtaccggttaaccgaacgggtttacgaaccgttcgacgtagtaacccgttnaccggttacnccgaaagcccgttaag

SEQ ID NO: 92818 - DNA, 950 bp, Homo sapiens
  misc_feature: GYAE6OF01ATPXK.18.78.H01.1.454.CMB.1.raw
tcagtacgagtatgcacgaccggtgctcgatttagtgtgagtagtttgggtttgggggctttgcctgggcccagtctgccctgactcaacctgcctccgtgtctgggtctcctggacagtcgactcaccatctcctgcactaggaaccagcagtgacgttggtgttataactatgtctctgtaccaacagcaccagacaacgaccccaaactcatagatttatacgatgtacgaagtaacgtccggaccttacggtacggggtttactaacgtccgtacttccgttcgtcggtctaaccgtaacggtcgtaaccggacaaccgtacccgggtaccctacccgtaccgaaccttacgtccgtcggtcggccgtacgacgggtctacgggaacggtacgaggtacgttaggttaacttaacgttaccgtcgtacggtaccgtacttaacgtaacgttaacgaaaccggaacgtaaccgtaacggacccgtacccgtaacgttaaaccccgttaacggttaaacccgggtttacccgggttaaacccggggtaaccgggttaaccggggtaaaccccggttaaccggggttaccccggttaacccccggttaacccgggttaacgggtaaccccgtaaacccgggaaacccccgggtaaacccggtaacccccgttaaaaccccccgtacgtttaaccccgttacccgtaccccgttttacccgtaccccccgggttttaaccccccgttaccccgtttacccgttaaacccccgtttaccggtaacccggttttaacccgttaaccccgggttagggtacccggggtaacccggggttacccggtaccgggttaaacccggggtaaaacccgggttcccggtaaaacccggtacggtttaaacggtcccggtacgaaaccgtagggttccacggggtaatcgtaccgtgacc

SEQ ID NO: 92819 - DNA, 183 bp, Homo sapiens
  misc_feature: GYAE6OF01BM7BL.18.78.H01.1.454.CMB.1.raw
  modified_base (166)..(166): a, c, t, g, unknown or other
  misc_feature (166)..(166): n is a, c, g, or t
  modified_base (173)..(183): a, c, t, g, unknown or other
  misc_feature (173)..(183): n is a, c, g, or t
tcagtacgagtatgcacgaccggtgctcgatttagtgtgagtagtttgggtttggggctttgcctgggcccagtctgccctgactcaacctgcctccgtgtctgggtctcctggacagtcgatcaccatctcctgcactggaaccagcagtgacgttggtgttaanaactatnnnnnnnnnnn

SEQ ID NO: 92820 - DNA, 687 bp, Homo sapiens
  misc_feature: GYAE6OF01D9YRE.18.78.H01.1.454.CMB.1.raw
  modified_base (269)..(269): a, c, t, g, unknown or other
  misc_feature (269)..(269): n is a, c, g, or t
  modified_base (331)..(331): a, c, t, g, unknown or other
  misc_feature (331)..(331): n is a, c, g, or t
tcagtacgagtatgcacgaccggtgctcgatttagtgtgagtagtttgggtttgggggggtctcaggaggcagcgctcgtcgggacgtctccaccatggcctgggctctgctattcctcaccctcctcactcacgggcacagggtcctgggcccagtctgccctgactcgaacctgcctccgtgtctgggtcctccgtaggactacggtcgatccacctatcctccgtgccacgtggaaccagcaagtgtacgttggtagttataactntcgtctacgtggtaaccaagtacgcctaccgagacaaacgccccaaatcatacgtatttagngtactgtacgacgtactccggtacccttaggtaagggtttactaacgttccgtctttccgtcgtcggtccttacgaacgtcggtacggactaaaccggtccggaccccttaccgtacgaaacctcgttccgtcggtacggggtacctaccggtacggtaccgttagggaaccgggtaacgtagggtacttaggtaacttttacgttacggcgtacgtaacgttctaccggtaattaacgaacgaacggacagaccgtagtacctactacgtaagtcgttacggaacgtccggtaacgacgtccgtacgtacgtacgacccacgacccgtaacgacccctaactcgtcgcctacccg

SEQ ID NO: 92821 - DNA, 843 bp, Homo sapiens
  misc_feature: GYAE6OF01BIPUX.18.78.H01.1.454.CMB.1.raw
  modified_base (203)..(203): a, c, t, g, unknown or other
  misc_feature (203)..(203): n is a, c, g, or t
  modified_base (276)..(276): a, c, t, g, unknown or other
  misc_feature (276)..(276): n is a, c, g, or t
  modified_base (318)..(318): a, c, t, g, unknown or other
  misc_feature (318)..(318): n is a, c, g, or t
tcagtacgagtatgcacgaccggtgctcgatttagtgtgagtagtttggggtttgggggggggtctcaggaggcagcgctctcgggacgtctccaccatggcctgggctctgctattcctcaccctcctcactcagggcacgagggtcctgggcccagtctcgccctgactcaacctgcctccgtgtctgggtctcctggacngtcgatcaccatctcctgcactaggaaccagcagtgacggttggtgttaataactatgtctctaggtaccaangaccaccaggacaaaccgtaccccaaactcatagtaatttangtatacgtactaagttaactccggtaccttacgtaacggggtttttactaaacgttccgtacctttccgtcgttacggtaccttaccgtaaacgttccggtacggaacccgtaaaaccgtccgggtaaccccttttacccgacgtaaacccctacgtttaccgttaccggtcggggttacctaccccggtagggtacccggtaagggaaaccggggaccggtaaacgggtaccttaaggtttaaacgttttaacgtttacgtacggaaccgttacgtaaccgtttaacgttaacgttaaacgtaaaccgaaaaggtaccgaaccggaactaaaccggtaccgtaaactttacccggaaaggttttacccggtaacccgggtaaaacggtaacccggggttaaaccggtaaaacccggtcccgtttaaccccggggtaaccgttaaccgggtacccgtaaacccggaaccccgtaaaccggtaaccccctaaaccccgttcgttaaccggttacccctaaacccgg

SEQ ID NO: 92822 - DNA, 914 bp, Homo sapiens
  misc_feature: GYAE6OF01DQ9JL.18.78.H01.1.454.CMB.1.raw
  modified_base (895)..(895): a, c, t, g, unknown or other
  misc_feature (895)..(895): n is a, c, g, or t
  modified_base (907)..(907): a, c, t, g, unknown or other
  misc_feature (907)..(907): n is a, c, g, or t
  modified_base (910)..(910): a, c, t, g, unknown or other
  misc_feature (910)..(910): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctgtaccaacagccacccaggaccaaaccgacccccaaactcatgtatttatgattgtacagtaacgtccggccctacgtagggtttactaacgtcgtcttctcgtcggtccttaccgaagtccgtacgggaccaaaccgtaccggtcccccttacccgtacgtaaccctacgtttcccgttccggttcggggtacccgttacccggtacgggtccgttaaggggaaccggggtaccggtaagggtacccgtttaaggttaacttttaacgttaaccgtacggacctaggttacccttaactaaacgttaaacttaaacgaaacggaccgtaacgaaccgacggtaacctaaaccgttaacgtaaaccggttttaccggtttaaccggggaaaaccgttacggggtaaacccgtaaacggggtttaccccctaaacccggggtttacccgtaaacggggttaacccccaaaacccgggtaccccccgtaaacccgggtaacccccccttaaaaccccccggttcgttaaccccggtttacccgttaaccccgtttcccccggttttacccccgtttaacccccccggtccccccctttaaacccttaccccgtttaaaccgttacccgtttcccggttaaaccgttcgggacccggggtaccggggtccttaaccggggacccggtaaaggccccgtaagtaacgtacgtacgcgantaccgtgaactncgntacg

SEQ ID NO: 92823 - DNA, 692 bp, Homo sapiens
  misc_feature: GYAE6OF01E0JT6.18.78.H01.1.454.CMB.1.raw
  modified_base (240)..(240): a, c, t, g, unknown or other
  misc_feature (240)..(240): n is a, c, g, or t
  modified_base (676)..(676): a, c, t, g, unknown or other
  misc_feature (676)..(676): n is a, c, g, or t
  modified_base (687)..(689): a, c, t, g, unknown or other
  misc_feature (687)..(689): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacattcgatcaccatctcctgcactggaaccagcagtgacgttggtgttataactatgtctcctggtaccaacacgcaccagaccaaacgacccccaaactcatgtatttatgatgtcagttacnccggccctgtagggttctaatcgtcttctctggctaccagtcgtggaccaacgccgcctcctgacctatctcgcggcctccgaggtcctaggaacgggacgtaggtcgttagttaacttttaacgttaccgtgacgtacgtcctactaataactaagaacgcgtaacgacgtaacgccctaacgtaacgtaaccgttccggttaacgggtaacgtaccggggaaccgtaacgggtaccctaccggttaccgtaacggtccgaaccgaccgaacccggcccctaacccgtaccgtaccgtacctacgttacccgttacccgttaccccctccccttacccttacccgtacgttacccgttacccgttacggtaccggtacggggtccgggtacggtaccgggaccgtaaccgggtccggacgtacgacgtcgctcgngtacctgaccnnngcg

SEQ ID NO: 92824 - DNA, 666 bp, Homo sapiens
  misc_feature: GYAE6OF01BO2CW.18.78.H01.1.454.CMB.1.raw
  modified_base (220)..(220): a, c, t, g, unknown or other
  misc_feature (220)..(220): n is a, c, g, or t
  modified_base (391)..(391): a, c, t, g, unknown or other
  misc_feature (391)..(391): n is a, c, g, or t
  modified_base (656)..(656): a, c, t, g, unknown or other
  misc_feature (656)..(656): n is a, c, g, or t
  modified_base (661)..(661): a, c, t, g, unknown or other
  misc_feature (661)..(661): n is a, c, g, or t
  modified_base (663)..(664): a, c, t, g, unknown or other
  misc_feature (663)..(664): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtgttataactatgtctcctgtaccacacgcaccaggcaaacgccccaaatcatgatttangatgtacagtaactcggccctcgtagggttctaatcgtctttctctcggtctccgtaagtcctggaccaacgaccggcccctcctacgaccacttcctcgtcgggcctccgaggcgtaggacggacgaggtctagtatttatactgactacgtctactaatactaacgacnccgagcgacacctactacgtaacggttcgttaacgggtaacgtacgggtaaccgtaacgtaccgtaacccggttaccgtaacggtacctaacccggaccccgtaaaccgaccccgtaaccccctacgttaccgtaccgttacccgttcccgttaccccgtccccgtaccccttacctacctaccttccgttaccgtacgtacggtaccggtccgggtcgtaccggtacggtaccggaccgtaccgtaagtagacggtactcgagngcacncnngc

SEQ ID NO: 92825 - DNA, 843 bp, Homo sapiens
  misc_feature: GYAE6OF01DTSPX.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggtagtttgggctgagtcgttgggtttttccttgttgtacttaagttttaaaaggtgtctagttgtgaggtgcgagtcgtgggtagggtacgggtccgggggaggtcgttcggtaccgacggtccggtcgggggtccctacgtaaacttcctccgtgtcgcgacgtccgttcgttcgggttaccctaccgtttcgtacggttcggtccttcgtcgtacttagtcggaccgtaccggttccgggtaccccgccggacgggtacccgggttaccggggtaacggggtcggtaggggtgggttacggggtttacggtaccggttaaggttaacggaacggtaacgtaaacgtaccgttaaacgtaacggttacgacgtacgtacgacgtaatacgtacgtcgtacgtaccggtaaggtaacggaacggtccgtacggttaccccgtaaccgtactaacgtaaacgtaagtagtacctaaacggaaacgacggttaccggtattacgtacgtaacgaaaccgaagttaaccggaacgaaccggtaaacccggtaaaaggaaaccggtcggaaaccggtcggttaaccgtagttaacgtcgtaaggttaactacgggaagttcgggttaagttaacggtttagtagggggtttacggaatttaccggggaacgggaaccgggggtttaaaccggtatacccggttaacgg

SEQ ID NO: 92826 - DNA, 645 bp, Homo sapiens
  misc_feature: GYAE6OF01CB42G.18.78.H01.1.454.CMB.1.raw
  modified_base (274)..(274): a, c, t, g, unknown or other
  misc_feature (274)..(274): n is a, c, g, or t
  modified_base (630)..(630): a, c, t, g, unknown or other
  misc_feature (630)..(630): n is a, c, g, or t
  modified_base (636)..(637): a, c, t, g, unknown or other
  misc_feature (636)..(637): n is a, c, g, or t
  modified_base (639)..(645): a, c, t, g, unknown or other
  misc_feature (639)..(645): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagccacccaggacaaaacgacccccaaaactcatgtatttatgatgtcagtaatccgccctcgtagggtttctaacgtcgtcttntactcggtcctcctaagtcgtgaccaacgaccggcctcccgcgaccctactcgtccgtcgggcctaccgtaggccgtgggaacggaacggaggtacctgtaaactttactaacgtgaccacgtctactaaactaactaacaacgaccaaaccgaccgtacaacttccttacgttagttaccgttcgttaaccggaacggttaacgggtaaccgtaaacggtccctaacggttacccgtaggtaccaccggacccgtaaccgaccccgtaaccctacgtcgtacctacgtcccgtttaccgcccctcccgtacccacgtaactccgacgtaatcggacgtccggagtcgacgacgcncatcgnncnnnnnnn

SEQ ID NO: 92827 - DNA, 830 bp, Homo sapiens
  misc_feature: GYAE6OF01BU7NA.18.78.H01.1.454.CMB.1.raw
tcagtacgagtatgcacgaccggtgctcgatttagtgtgagtagtttgggtttggggggggtctcaggaggcagcgctctcgggacgtctccaccatggcctgggctctgctattcctccaccctcctcactcgagggcacgagggtcctgggcccagtctgccctgactcaacctcgcctccgtgtcgtgggtcctccgtggacagtcgactcaccatcctcctgccacgtacggaaccagcgtagtcggtacggttggtagttaataactgtacgtcctcgtacggtaaccaacgacgaccaacccgaggaacctaaaccgaccccctaaaacgttccgtaacgttacgttaattttacgtacgttacgttcgtaacgtaacggtttaaccgtcccggtacccgttacgggttacgggttttacttaacgttcgttacctttcgtaccgtcggtaccttaccgtacggttcgtacggaacccgtaaccgtacccggttccctacccgtaacgtaccctacgtttccggtaccggttcggtacccgttaccggacggtacggtaccgggtaacgggtaaccgggaacggttaccggttagttaaaccgttttacgttaaccggtcgtaaccgtacggtacctaacgtaactaacgtaaaccgacgtaaccctacgtacgtaccttacgtttacctacgtttaccgttaccggttaccgtaaccggtaaccggtacggtaacccgttacggtcccgtacggttacccgtacgtacccgaacccgtaacccgtacccgtaaccctaaccccttacggtttcctaaccccgg

SEQ ID NO: 92828 - DNA, 723 bp, Homo sapiens
  misc_feature: GYAE6OF01COI6E.18.78.H01.1.454.CMB.1.raw
  modified_base (233)..(233): a, c, t, g, unknown or other
  misc_feature (233)..(233): n is a, c, g, or t
  modified_base (706)..(706): a, c, t, g, unknown or other
  misc_feature (706)..(706): n is a, c, g, or t
  modified_base (720)..(720): a, c, t, g, unknown or other
  misc_feature (720)..(720): n is a, c, g, or t
  modified_base (722)..(723): a, c, t, g, unknown or other
  misc_feature (722)..(723): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttaataactatgtctcctacggtaaccaacagcaacccgaggaccaaacgacccccaaatcatgatttangatgtacagtaatccggcctgtaagggttctaatcgtcttctcgtcggcttaccgtaagtccgtagacctaaaccgccggaccctccgtacgacctactccgtaccgtcgggcctcggaaggcctaggaacggacgaacgtctagtaattacgttaacctgacacgtacctagtaataacgtaacgaaggccaaggaccacggacctaaacgtacgaaacggtttacccgtaacgggtaaaccgttaacggggaaacctaaacggggttaccaaaccccgggttacgtacggtaacccgaacgtacccccggtaaaacgcccccgtaaaacccgtaccgtacgtttaaccacccgttacttacccgttacccctaacccttacccgtacccaaacttttccgaaccggttaccgtaggacgggacccgggtacgtaacgggaccgtaaggacccgttaaacgattacggactnacgacacgacagangnn

SEQ ID NO: 92829 - DNA, 943 bp, Homo sapiens
  misc_feature: GYAE6OF01EH5AD.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggaggtttgggctggagtcgttgggtttttcctcgttgtcttacttttaagaggttatccaggtgtcaggttcaacgtgggtggaggtccgggggagcgtggtcctgccgtgggacgtcgcgtgacgtactctcctgtcgcagtcctgtgtacttccaccttacaacttacctatcgttctttcgactacggttcgggtcccgaccgtacggaccctaccggaacgggaccggtaacgggggcctaagggtacgggtcggtccgtttaggttaccgttaagttttaacgtttacgaagtttaacgttaaggtaaacgttaacgggtaaaaccttaaaacgttaccgtaaaacgtttaaacccgacggtaccgtaaaacggaccggtttacccgggtaacgggtaaccggggaaccctttaacttaacccctaaccgttaccgttaccccggtaacccgggtaaaaccgggtaaaccgttaaaacccgtttacccgaaaacggggtaaacccccgtaccggtttaccgttaccgttaacccgttaaccggttaaaaccgtaaacggttccgggaaacctaaccggttaaacccggttaagggaaacccgttaaaccggtaccgggtaacccggtaaccggtaacccgggttccgtttaaacggtttaaaccgttttaaagttttacggggtttacggtacgggttaacgggttaaaaccgggttacggttaaaccccggttttaaaggggtttaccggggttttaaaggtttcgggttaaacgggtttacggttaaaacccggggg

SEQ ID NO: 92830 - DNA, 790 bp, Homo sapiens
  misc_feature: GYAE6OF01ASA3G.18.78.H01.1.454.CMB.1.raw
  modified_base (214)..(214): a, c, t, g, unknown or other
  misc_feature (214)..(214): n is a, c, g, or t
  modified_base (225)..(225): a, c, t, g, unknown or other
  misc_feature (225)..(225): n is a, c, g, or t
  modified_base (627)..(627): a, c, t, g, unknown or other
  misc_feature (627)..(627): n is a, c, g, or t
  modified_base (781)..(781): a, c, t, g, unknown or other
  misc_feature (781)..(781): n is a, c, g, or t
tcagtacgagtatgcacgaccggtgctcgatttagtgtgagtagtttggggtttggggggggggtctcagggaggcagcgctctcgggacgtctccaccatggcctgggctctgctattcctccaccctcctcactcgagggcacgacgggtcctcgggcccagtctcgccctgacctccaacctcgccctcgtgtcgtcgggtcctcgtgacngtcgatccacntcctcctgcctacgtcggaaccagcctaggtggtacggtttggtacgttaatacttacgttcgttccttccgtaacggtaaccaacgacgtacccgaacccggacggaaccaaaaccccggaccccctaaacttacctaagttacgtttaacgttttaacgaggttacgtcggttaactaacgttaaccggtcccggtaacccgtttacgggtttacgggttttaactaacgttccggttccttccgtcggtacgtccttaacggtacgtcgtacggaacctaacccgtccgtcccctaccgacgtacctactccgttcggtcgggaccccttggaccggttcggaacggacggggtactacggttacttaacggttaactttaccgccgttagaccgtacnccttaaaggtataaacgtacgaaccgagacccagtaaccgccttacgtaacgttaacggtccgtaacgggaacgtcccggtaaagtcccgtaccgtaccgtacggtaaccggaccgacccgtaaccgacccggacccctaaacgttcgtacccncgttacccg

SEQ ID NO: 92831 - DNA, 967 bp, Homo sapiens
  misc_feature: GYAE6OF01B89SD.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctggagtcgttgggtttttccttgttgtacttaagtttttaaaaggtgtccgagtgtagaggtgcgagcgtgggtgggacgggtccgggggagtcgttggtccgacggtccggtcggggggtaccctaggtaaacctccgtaccgtggtcgaccgtacgtccgttacggttcgggtttccctaacccgtttacgacgggttcgggtacctttccgtcgtaccgttacgtcggtaccgtaacccgggttccgggggtacccccggtacccgggtaaccgggggttaccccgggttttaacccggggggaaaaacgggggttccgggttaacgggggttacggggtttcggggggtttaccgggtaaccccgggttttaaaggtttaaacgggaaaacggtaaaccgtaaaaacgggtaaaccgtttaaaaccggtaaccgggtttaacccggaaccggaaacgaacgggttaactaaagttaagtccggtacgttacgggtaccgggttacgggtaaacggtaaacgggtaccgttaacgggttacccgtaacccgtaccgtaacgtaaagtaaacgttacggtaaacttaaacggaaaacgtaaccggtaacggttacttacgtacgtagaaacgtaaagtaccgaaacgtaccggtaaccgtaaaccggaaaacgggtaccggaaccgtaccgggttaacgttacgttaacgttaccgttagtaaaccggtaaggaccgtaagggttaggttaactttacgggtagggtttagggtacgtacggtacgggaaacggggtaacgggtattaccggtacg

SEQ ID NO: 92832 - DNA, 732 bp, Homo sapiens
  misc_feature: GYAE6OF01B5CLF.18.78.H01.1.454.CMB.1.raw
  modified_base (188)..(188): a, c, t, g, unknown or other
  misc_feature (188)..(188): n is a, c, g, or t
  modified_base (192)..(192): a, c, t, g, unknown or other
  misc_feature (192)..(192): n is a, c, g, or t
  modified_base (471)..(471): a, c, t, g, unknown or other
  misc_feature (471)..(471): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacgaggagactcaccatggtagtttggctgagcgtggttcgtgtgctatttaaagtgtcagtgtgngtgnagtgtggtggacggtccggggagtcgtcggtccgacgtccggtcggggtcctagtaaccgtctcgtgtgcgtgtccgtcgtcggttacctaccgttacgtcgttcggtacttcgtcgtacgttagtaccgtcgtaccggtccggtacccggaccggtacgggttaccgggtaaccggggtaagggcggttaggtacgggttgggtacggttaacgtaggttaacggaacgtaagtaaaccgacgttaacgaacgtacggacgaacgcgaagtactacgngtacgtcgggtcggttaacggaaggtacggtacgtacggtaccgtaccggtcgtaaccgtaagtaagttacgtaacgtaaccgaaacggtacgtaccggtagtagtacgaaccgtaataacgtacgtaacgaccggtaacgaacggaacgtacgaaccgttcggtaacgtacgttaactacgtagtaacgcggtaagtggttagtacgttaggtagggttacggtgttacggtacgggtaaggtaccgggtactggtacgg

SEQ ID NO: 92833 - DNA, 702 bp, Homo sapiens
  misc_feature: GYAE6OF01EWMLV.18.78.H01.1.454.CMB.1.raw
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
  modified_base (678)..(678): a, c, t, g, unknown or other
  misc_feature (678)..(678): n is a, c, g, or t
  modified_base (691)..(691): a, c, t, g, unknown or other
  misc_feature (691)..(691): n is a, c, g, or t
  modified_base (693)..(693): a, c, t, g, unknown or other
  misc_feature (693)..(693): n is a, c, g, or t
  modified_base (696)..(696): a, c, t, g, unknown or other
  misc_feature (696)..(696): n is a, c, g, or t
  modified_base (699)..(699): a, c, t, g, unknown or other
  misc_feature (699)..(699): n is a, c, g, or t
  modified_base (702)..(702): a, c, t, g, unknown or other
  misc_feature (702)..(702): n is a, c, g, or t
tcagtacgagtatgcacgaccggtgctcgatttagtgtgagtagtttggggtttgggggcgtttgcctgggcccagtctgccctgactcaacctgcctccgtgtctcggtctcctggactagtcgatcaccatctcctgcactggaaccagcagtgacgttggttacggttataactatgtcttccgtacggtaacaacacgtcacccgaaggacaaacgacccccaaaatcagtatatttagngtatntacagttaacnccgtcctagtagggttactaagtcgcttctcgtaggcctacgaagtcgtaggaccaacgaccggcccttaccgactaacctagttcctacggtacgggtcctaccggaggtacgtaggtacggaacggacgtacgttaagtaagtttaactacgtcgtcgtaagtccttaacgaacttaacgtaacgtaacggtccaaccgactacctacgtacttcgttaagtcgttaccgttaggaccggttacggaactacgttacaccgttacgcggtacaccgaccctaacgaccctaacccgtgtcgtacctaccgttcctaccgttccccgtacctcccgtagtaaccttacgaccgttacggtacccgaaggtccgggttaacccgcgggtaaacgaccgggaacggtaactagggtaanacctagactacgnanacncgngtn

SEQ ID NO: 92834 - DNA, 725 bp, Homo sapiens
  misc_feature: GYAE6OF01DQMAJ.18.78.H01.1.454.CMB.1.raw
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacgagggtcctgggcccagtctcgccctgactcaacctgcctcgtgtctgggtctcctggacagtcgatcacatctcctgctactacggacngcagtgtacgttgtagttaactactntgtctctagtaccaagcgacaccacggactaaaccgaccccaactactaatcgtatttagacgtatcgtactaacttaacgtcccgtaccgtacggttaacgggtttaccttaaacgtccgttccttcgtccgtacggtacctaccggtaagccgtcgaacctaaccggtaccgccctaccctacgtacctacgttccgtcgtacgggtccctaccggtaagggtccgttaagggtaaccgggtaacggtacggtaacgttacggttaaactttaacgttaccggttacgacgtaacgtaccgttaactaattaacgaacgttaacaccttaacccgatacccgttacttccgttactacggttcgttaacgtacggtaaccgtaccggtaaaccgtcggttacccacggttcccgtaaggtacccaccggtaacccgaaaccgtccccaaaccgtcgtccttaacccgg

SEQ ID NO: 92835 - DNA, 691 bp, Homo sapiens
  misc_feature: GYAE6OF01BF3F0.18.78.H01.1.454.CMB.1.raw
  modified_base (254)..(255): a, c, t, g, unknown or other
  misc_feature (254)..(255): n is a, c, g, or t
  modified_base (323)..(323): a, c, t, g, unknown or other
  misc_feature (323)..(323): n is a, c, g, or t
  modified_base (379)..(379): a, c, t, g, unknown or other
  misc_feature (379)..(379): n is a, c, g, or t
  modified_base (405)..(405): a, c, t, g, unknown or other
  misc_feature (405)..(405): n is a, c, g, or t
tcagtacgagtatgcacgaccggtgctcgatttagtgtgagtagtttgggttgggggctttgcctgggcccagtctgccctgactcaacctgcctccgtgtctcgggtctcctggacagtcgatcaccatctcctgcactggaaccagctagtggtacggttggtaggttaataacttatcgtctaccgttacggtaaccaacgacgccgaacccgaggaaccaaaaccgacccccaaactacattgtatttannatgtactagtaacgtcgcccgtacgttagggttacacgtcgtcttctctggcctacaagtctacgganaaccgaccgcctaccgactacctactcgtcgtcgacgtccgaggcgtagaggacgngtagtacgtaattatacgtgcacgtntacgtaattaagaacatacggacgactaacgactaaggtaaccgtacttaccggtaacggaacggtaacggtaaccgtaaccggtacctaacgtaccgtacggcaaccgaaccgaaccgaacccgaacccgtactaccgtactacccgttaccacccgttaccctaccgtaccctaccgtaacttaccgtttaacgccgttacggacggtaccgggtactccggtaaccgaacggtaccggaacttaagggactacgcgtaacggagacgagacgtacgtgagtcg

SEQ ID NO: 92836 - DNA, 688 bp, Homo sapiens
  misc_feature: GYAE6OF01D5P75.18.78.H01.1.454.CMB.1.raw
  modified_base (198)..(198): a, c, t, g, unknown or other
  misc_feature (198)..(198): n is a, c, g, or t
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
  modified_base (427)..(427): a, c, t, g, unknown or other
  misc_feature (427)..(427): n is a, c, g, or t
  modified_base (665)..(665): a, c, t, g, unknown or other
  misc_feature (665)..(665): n is a, c, g, or t
  modified_base (682)..(682): a, c, t, g, unknown or other
  misc_feature (682)..(682): n is a, c, g, or t
  modified_base (686)..(686): a, c, t, g, unknown or other
  misc_feature (686)..(686): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatccacctatcctcctgcacgtcggaaccagcagtgtacgttggtggttataactatcgtctccgtaggtaccaanacgccaccgaaggacaaacgaccaaccgtaactnatcgtattantatgtacactacgcgtcctagtaggttcatctcttctctcggactactagtcgtagaccacgccggtccctcgtcgtacctactctacggttcggaccctcggacggcgttacggcgaacggcgtcttattaactttacgtacgcgtactaaccgtcttacgtaactaacgtaacgaactaaccncgtaccgccgttactcttcgttacgttcgttaccggtaacgtaccggtacgggaaccttaacgcccccggtatacccgtacggtaacccgacttaaccccggaaccctaaccccgacccggtaactttccccgtacttaccgtacccgttacccttaaccccctcccgtaccaccgttaacctccgttacgtacgtacggaccggtcgggacaaccggtacgaacgacgtgttaaacncgtaagcttcgacaccngcgngc

SEQ ID NO: 92837 - DNA, 954 bp, Homo sapiens
  misc_feature: GYAE6OF01BE2YO.18.78.H01.1.454.CMB.1.raw
  modified_base (321)..(321): a, c, t, g, unknown or other
  misc_feature (321)..(321): n is a, c, g, or t
tcagtacgagtatgcacgaccggtgctcgatttagtgtgagtagtttgggtttgggggctcctgggagaggagctccagccttgggattcccagctgtctccactcggtgatcggcactgaatacaggagactcaccatggagtttgggctgagcgtggtttccttggtgtcgttaattttaaaggtgtccaggtgtgaggtgcagtcgtggtcggacggtccgggggacgtcgttgggtcccacggccggttcggggggtccctacgtaaaccgttccttccgtcgttcgcgcgccttacgtcggggttccaccgttcgnggtggcttccgtagtcttacgtcggtacctcgtcgggttacccgccgtacggtacggtttaccggggaaacggtccggtaggtagggttcggggttcgggaccgttaagttacggtaacgacgtaaacgtacgtaaacgtacgttaccgacgacgtacggtactacgttatacggtcgtacggtacggttaccggtaaggtaacgggtaccgtacggttacccgacccggtttaccgtaaccgaaacggttaaacgtacggtaacgttaaacccgtaaaacggtaaccggtaaacccgggttacgttaacgttacccggtaagtaaaccgtaaacttaacgggtaaaccgtaccggtaaccccgttaaaacgggtaaaaccccgggacccgggttaacccgggtaacccgggtttaccccggttaggtttaaaccggtttaacccggttaacggttaaaaccgtaaccgggttaaacgggtttaccgggtaacgggttttaacggtttaaaccgggttaacgggggttttaacgggggttaaacgggtttaaacccggggtttaaccggggttaaaacccgggggtttaaaccccgggggggttaaccgtttaaacggggttaaacccccggg

SEQ ID NO: 92838 - DNA, 792 bp, Homo sapiens
  misc_feature: GYAE6OF01BUETV.18.78.H01.1.454.CMB.1.raw
  modified_base (201)..(201): a, c, t, g, unknown or other
  misc_feature (201)..(201): n is a, c, g, or t
  modified_base (395)..(395): a, c, t, g, unknown or other
  misc_feature (395)..(395): n is a, c, g, or t
tcagtacgagtatgcacgaccggtgctcgatttagtgtgagtagtttgggtttgggggctctgggagaggagctccagccttgggattcccagctgtctccactcggtgagtcggcactgaatacaggagactaacagtggtagtttgggctggagcggtcggtttcgtgtagctagttaaagtgtctagtgtggaggtgngtagcgtggtggacgggtcgggggtcggtcgttcggtccgaggcccggttcgggggtacccgttgaaaacctccgttccgtgtcggactccggtccttccggttcggttcctaacctccgtaggttcggtcctgtgtacttgtcgccgtcgtccggtcccgtaccggacggtccggtaccggggtaagggtcgngggtcggtggggtccggttacgtaaagttaacggacgaacgtaaacggtaactaacgtacggttacggactaaacgtggaactacgtacgttcgtacgtacggtaacggttacggaagggtaaagggtccgtttaaccggggtcccttaaacccggtacccttaaggtaaacgttaaacgggttaaacttaaacgtaaaccgtaaaacgggaacccggtaacggttaacgtaccgtacgtaaagaacgttaaacgtacgaaaccgtacgaccgtaaaccggacggaacggtaccggtacgtaccgttagtaaccgttcgataacgtgaacgtgtaacgttatggttaaggttcgggtagtaccgtgggtaaaccggacgggttactagtccgtaggg

SEQ ID NO: 92839 - DNA, 775 bp, Homo sapiens
  misc_feature: GYAE6OF01ALCLO.18.78.H01.1.454.CMB.1.raw
  modified_base (203)..(203): a, c, t, g, unknown or other
  misc_feature (203)..(203): n is a, c, g, or t
  modified_base (649)..(649): a, c, t, g, unknown or other
  misc_feature (649)..(649): n is a, c, g, or t
tcagtacgagtatgcacgaccggtgctcgatttagtgtgagtagtttgggtttgggggggtctcgaggaggcagcgctctcgggacgtctccaccatggcctgggctctgctattcctccaccctcctcactcagggcacgagggtcctgggcccagtctcgccctgactcaacctgcctccgtgtcgtgggtctcctggacngtcgatcaccatctcctgctacgtaggaaacccagcgaaggtggtaccggtttgggttacggtttaacttaacgttagtcgttcccgttcccgttacggtaaccaaaaccgacgacccaaccccgaacgggaccaaaacccggaccccccctaaaacctacctaagttacggttaacttttaagtagtaacgttagtacgtaaggtaacgtacccggtccctttacggttaacggggttttactaaacgttccggtctttcccgttcgttcggtacccttactaacggttcggtacgtaccgaacccggtaccgtcccccgttacccgtcgaccctatcccgttcggtcggccgttaccgacggtcgtcggtaaccgggagtacgggccgttaagttacgttttacgtacgtcgacctcggtcctagtaacgtataacgaaccgtnacggactacgacctacgtaacgtacgttaacgttaccgggacgtaaccggaccgttacggtaccttccggtaaccgtcggtacccgaccgtacccgaccgaaccctacccgccttagccgttaccc

SEQ ID NO: 92840 - DNA, 733 bp, Homo sapiens
  misc_feature: GYAE6OF01A82W1.18.78.H01.1.454.CMB.1.raw
  modified_base (226)..(226): a, c, t, g, unknown or other
  misc_feature (226)..(226): n is a, c, g, or t
  modified_base (731)..(731): a, c, t, g, unknown or other
  misc_feature (731)..(731): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagccacccaggcaaacgcccccaaactcatgatttangatgtcagtaatcgccctcgagggtttcaatcgcttctctggctaccaagtctaggaccaacgaccggcctccctagaccctagtcctacgtcggggtacctaccgaacgggcgtaggaacggggtaccgagggtaccgtaggtactttaacttacgtacggactaaggtcctaccgtaattaacgtaaaccaaaggtcaaacggacctaggaccctaacttacgaaacggtttccgttaaccgggtaacggttaccgggggaaaccctaaacgggttccccgtacccgttaaccccggtagggaccctaaaccgaccccggaaacgtaccccccaaaccccggtacttaccgaccctaacctttacccgtacccgtttacccccaacccccgttccctaccctaacgttaccctacccggttacgtaccgggaccgggtccgggtacgttccgggaaaccgaacgggaccgtacgaaggtacgcgtacacgcgtacacagatcngc

SEQ ID NO: 92841 - DNA, 682 bp, Homo sapiens
  misc_feature: GYAE6OF01BETG9.18.78.H01.1.454.CMB.1.raw
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (667)..(667): a, c, t, g, unknown or other
  misc_feature (667)..(667): n is a, c, g, or t
  modified_base (670)..(670): a, c, t, g, unknown or other
  misc_feature (670)..(670): n is a, c, g, or t
  modified_base (677)..(677): a, c, t, g, unknown or other
  misc_feature (677)..(677): n is a, c, g, or t
  modified_base (680)..(682): a, c, t, g, unknown or other
  misc_feature (680)..(682): n is a, c, g, or t
tcagtacgagtatgcacgaccggtgctcgatttagtgtgagtagtttgggtttgggggctttgcctggggcccagtctgccctgacctcaacctgcctccgtgtctgggtctcctggacagtcgatcaccatctcctgcactggaaccagcagtgacgttggtggttataactattgtctcctggtaccaacagccaccgaggaccaaaacgcccccaaaatcatgatttangatgtcagtaacnccggcctcgtagggttctaatcgtcttctcgtcggctccaagtctggacaacgccggtcctcctgacctatcgtcgtcgggtacctcgaggtctagggacggacggagtcttagtaacgtttactacgtgaccgtacgtcttacaattaaccgtaacgaacgcgaaacggtcaaacgcctaacgtaccgtaaggttccggttaaccgggtaaaccgtcggggtaaacccgtaaagggttccccgtaacccggttacggtaaggtacccgaaccggaccccgtaacccggggaacccccaaccctacgtaccgtaccgtaccttcccgttacccgtttccccgaccccttacttacccgaccgttaccgtaccgtacgcgggtacgtcggacgttcggaaccgacgggtcaacgtacgacggncancacgctnacnnn

SEQ ID NO: 92842 - DNA, 669 bp, Homo sapiens
  misc_feature: GYAE6OF01CQRO6.18.78.H01.1.454.CMB.1.raw
  modified_base (543)..(543): a, c, t, g, unknown or other
  misc_feature (543)..(543): n is a, c, g, or t
  modified_base (642)..(642): a, c, t, g, unknown or other
  misc_feature (642)..(642): n is a, c, g, or t
  modified_base (645)..(646): a, c, t, g, unknown or other
  misc_feature (645)..(646): n is a, c, g, or t
  modified_base (650)..(651): a, c, t, g, unknown or other
  misc_feature (650)..(651): n is a, c, g, or t
  modified_base (653)..(654): a, c, t, g, unknown or other
  misc_feature (653)..(654): n is a, c, g, or t
  modified_base (656)..(669): a, c, t, g, unknown or other
  misc_feature (656)..(669): n is a, c, g, or t
tcagtacgagtatgcacgaccggtgctcgatttagtgtgagtagtttgggtttgggggctttgcctgggtgctgttggtaccaggagacatagttataaccaccatcctcctgcactggaaccagcagtgacgttggtggttataactatcgtctcctggtaccaacagccacccgaggacaaaccgacccccaaactcatagtatttatgatgtacagtaacgtccggccctacgtacggggtttactaacgttctcttccgtcgtcggtcctaccgtaaggttcgacggtaccaaccgtaccccggtccctaccccgttacgaacctacgttcctccggtacgggccctccggaggtccggtaggacgggaacggagggtccgtagttaactttactcgtacgctagtcctactaactataaccgaagacgacacgaccgactaccgtacgtaacgtccgttaaccggaagtacgggaaccgtacgtccgtaccgttaccgtacgtaccgaccgtacccgaacccgcccctaaaccccgtntcctactcccgttaccttccctaaccccctcctccctaacctacctaccgtacgtacgacggtcgggcggtacgtccgggaacgacggtcgaactcgtnacnncgtnncnngnnnnnnnnnnnnnn

SEQ ID NO: 92843 - DNA, 759 bp, Homo sapiens
  misc_feature: GYAE6OF01COQBK.18.78.H01.1.454.CMB.1.raw
tcagtacgagtatgcacgaccggtgctcgatttagtgtgagtagtttggggtttggggggggtctcaggaggcagcgctctcgggacgtctccaccatggcctgggctctgctattcctcaccctcctcactcgagggcacgagggtccgtgggcccagtctgcccctgactcaacctgcctcgtgtcgtgggtctccgtggacaggtcgatcaccatcctcctgcactcggaaccagcaggtgtacggtttgggttagttaactaacgttagtcgttctccgttacggtaaccaacgacgaccaacccgaggaaccaaaccgacccccaaaactcgaatgtaatttactagtattgtacgtaagtaaaccgtccggtaccctaggttacggggtttactaacggtcctctttaccgtcgtcggtacctaccgtaggtccgtacggactaaaccggccggtccctacctacactacttccgtcgtacgggccctacggtacggtcgtagggacggaacggagtacgtagttaagttactacgacgtacgtacgtactacaactaagtaaccgtaaagaccgtacgacgtaccgtaccgtacgtaaccgtaacggttaccggttaaacgggaccgtaaccggggaaccttaaccggtaccggttacccggtaacccggtttacggacccggttaacccgaaacccggtaacccgggtaacccccaaaccccgttaccggttacgtccccggtttaacccg

SEQ ID NO: 92844 - DNA, 576 bp, Homo sapiens
  misc_feature: GYAE6OF01B5N59.18.78.H01.1.454.CMB.1.raw
  modified_base (223)..(223): a, c, t, g, unknown or other
  misc_feature (223)..(223): n is a, c, g, or t
  modified_base (325)..(325): a, c, t, g, unknown or other
  misc_feature (325)..(325): n is a, c, g, or t
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
  modified_base (464)..(464): a, c, t, g, unknown or other
  misc_feature (464)..(464): n is a, c, g, or t
  modified_base (517)..(517): a, c, t, g, unknown or other
  misc_feature (517)..(517): n is a, c, g, or t
  modified_base (545)..(545): a, c, t, g, unknown or other
  misc_feature (545)..(545): n is a, c, g, or t
  modified_base (558)..(558): a, c, t, g, unknown or other
  misc_feature (558)..(558): n is a, c, g, or t
  modified_base (563)..(563): a, c, t, g, unknown or other
  misc_feature (563)..(563): n is a, c, g, or t
  modified_base (566)..(566): a, c, t, g, unknown or other
  misc_feature (566)..(566): n is a, c, g, or t
  modified_base (570)..(571): a, c, t, g, unknown or other
  misc_feature (570)..(571): n is a, c, g, or t
  modified_base (573)..(574): a, c, t, g, unknown or other
  misc_feature (573)..(574): n is a, c, g, or t
  modified_base (576)..(576): a, c, t, g, unknown or other
  misc_feature (576)..(576): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcaccaggcaaacgcccccaaatcatgatttangatgtacagtaactccggccctcgtagggtttctaatcgcttctctgctaccaagtctaggcaaccacggcctccgtgacccatctcgtcggctccaggtcngaggacgagctgtattattacgncagctanatactacgaagcagctagcaactacgtaacgttccgttacggaacgtagggaaccctaacggacctaccgtacgtagtaccgagaaccccgacggaccccaacccgtancgtactcgtccgtcccgtcccgccctcctacccacgttacccgtacgttacgnggtacgccgggacgtcggacaaccgggntaaccgagtacgntacgnacncacnncnngn

SEQ ID NO: 92845 - DNA, 700 bp, Homo sapiens
  misc_feature: GYAE6OF01DUCFE.18.78.H01.1.454.CMB.1.raw
  modified_base (189)..(189): a, c, t, g, unknown or other
  misc_feature (189)..(189): n is a, c, g, or t
  modified_base (234)..(234): a, c, t, g, unknown or other
  misc_feature (234)..(234): n is a, c, g, or t
  modified_base (344)..(344): a, c, t, g, unknown or other
  misc_feature (344)..(344): n is a, c, g, or t
  modified_base (458)..(458): a, c, t, g, unknown or other
  misc_feature (458)..(458): n is a, c, g, or t
  modified_base (690)..(691): a, c, t, g, unknown or other
  misc_feature (690)..(691): n is a, c, g, or t
  modified_base (693)..(698): a, c, t, g, unknown or other
  misc_feature (693)..(698): n is a, c, g, or t
  modified_base (700)..(700): a, c, t, g, unknown or other
  misc_feature (700)..(700): n is a, c, g, or t
tcagtacgagtatgcacgaccggtgctcgatttagtgtgagtagtttgggtttgggggctttgcctgggcccagtctgccctgactcaacctgcctccgtgtctggtctcctggacagtcatcaccatcctcctgcactggaaccagcagtgacgttggtgttataactatgtcctccgtgtaaccaancgaccacccaggaccaaaccgacccccaaatcatgtatttatcgnttagtacgtaagtactccggtccccgtacgttaggggtttactagtccgtccttcgtacgtcggccttacccgagtccgtggaccaacgccgtcccctccgtacgacctnttccgtcgtcggtacctccgacgggtactagggacggtacggaggttcctaagttactttaacgtacgttcgaccgtcactaataaactactaacgaaacgccctaaccgtacnccctacgtttacctactttacgtaccgggtttacggtaccgtaacggtaccggaaccgtaccggtacccgtacccggtactacggactacccgaaccgaacccgacccctaacccgcgtcctaccctccgtaccgtttccccgtcccccgttcctacccctagaacccctttcgtaccgttaccggtcggtacggcggtccggaccgtcggaaacgccggtatcggtaagcnncnnnnnngn

SEQ ID NO: 92846 - DNA, 871 bp, Homo sapiens
  misc_feature: GYAE6OF01CBPMN.18.78.H01.1.454.CMB.1.raw
  modified_base (255)..(255): a, c, t, g, unknown or other
  misc_feature (255)..(255): n is a, c, g, or t
tcagtacgagtatgcacgaccggtgctcgatttagtgtgagtagtttgggtttggggagctctgggagaggagctccagccttgggattcccagctgtctccactcggtgatcggcactagaatacgaggagactcaccagtggtaggtttgggctggtgtcgtttcgggttttccttgttacgtacgttaagttttaaaaggtgtccgtaaggtgtggtaggtgacgagtcgtgggtcgggacgggtccggggnggtcgttcggtaccgtacggtccgggtcgggggtccctacggtaaccttccgtcgttgcgcgacgtccgttcgttcggttacctccgttcgacggtcgtcgtcgtacgtctacgtcgtaccgtccggttccggcccgtcggtaacggttccgggtaacggggaaggtcggttagggtacgggtttcgggttacggtaccgtttaaggtaaacgaacgaacgtaaacgtacgtaacgtaacggttacgacgtaagaccgtatacgtagtcggtacgtcggtacggtacggtaaggttaacggacgttacggtacccgtaccgtcgaacgtaacgtaacgttacgtaaactaaccgaaggtaacccgaagggttactaaccggttacgtacgtaaacgtaagtaaacgaaccgtaaaccgtacggtaaacccggtaaacggaacggttacccggtaaggtttaccgtaaacggtttacttaaccggtaaccggttaagaaacgggttaccgggttaaggttacgggtttaacgttacggggttaacggtttaaggggttaaccggtttaccggggtaaacggtaacccggggggttaaagggtacccggttaaaccgg

SEQ ID NO: 92847 - DNA, 740 bp, Homo sapiens
  misc_feature: GYAE6OF01BZSTQ.18.78.H01.1.454.CMB.1.raw
tcagtacgagtatgcacgaccggtgctcgatttagtgtgagtagtttgggtttgggggctctgggagaggagctccagacttgggattcccagctgtctccactcggtgatcggcactgaatacaggagactcaccatggtagtttggctgagcttgggttttccttgttgcttaattttaaaggtgtcctagttgtggaggtgcagcgtggtggacggtccgggggaggtcttcggtccacggtccggttcgggggtccctagtaaacctccttccgtgtcgaccacgtccttacgtcgggttacctacccgtttacgaggtcggtccttccgtcgtacttagtcgccgtaccggttcgggcccggacgtacgggtaccggttaccggggaacggtcgtacgggtagggttcgggttcggtacgttaagttaacggaagacgtaaaagtaccgtaaacgtaacgttacgacgtaactacgacgtaatacgttgaccgttggaccggttcggtaaggtacggtaccgtacgttaccgacccgtacctaaccgaataaacgtataacgttaacaaacggtaaccgacggtacttaagtccgtacgaacgtaagaccgaacgcgtaacgaacggaaacgtcgaccgacgtcgttatacgttctagtaccgagtccgtaaggtcgttaagtcgttaggttagggtacttcggacggtaacgggaacgggttctaacggtacgg

SEQ ID NO: 92848 - DNA, 832 bp, Homo sapiens
  misc_feature: GYAE6OF01BCEK4.18.78.H01.1.454.CMB.1.raw
tcagtacgagtatgcacgaccggtgctcgatttagtgtgagtagtttgggtttggggctctgggagaggagctccagccttgggattcccagctgtctccactcggtgatcggcactgaatacaggagactcaccatggagtttgggctgagtcgttgggtttttccttgttgtcttaagttttaaaaggtgtcctagtgtggaggtgcagcgtgggtgggagggtccgggggagtcgttcggtccgacggtccggtcgggggtccctagaaacctccgtcctgtcgcgacgtccttcgttcggttcctaccttcgagttcggtcttgtgtcgtagtcgcgtacgtcgggtccgccggtacggtccggttaccggggaaggtcgtagggtggttcggggttcggtacggttaagttacggaagaacgtaaacgtacgtaacgtacggttaccgacggacaggtactaagtgtacgtcgtcggtcggttacgggtaaggaacggtacgtacggttaccgtacccgtaccttaaccgaaagttaaagtaacgtaacgtaaaccggaaaacgtaacggtaccggtaaccgttagttaaccgtacgaaagttaaccgaacggtaaccgtaccgaaacccgggtaaccgtaaaaaccggggcggtaaaccgggaacccgggttaaccgttacgttaaaccgttacgttaacgtaaacggttaaccggtaggtaaacggtttacgggttaaacgttagggttaacgggtttaggggttaacgttacggtaaccggggttaaacggggggtaacgggttaaacccgtaaggtaacccgg

SEQ ID NO: 92849 - DNA, 844 bp, Homo sapiens
  misc_feature: GYAE6OF01AUFUF.18.78.H01.1.454.CMB.1.raw
tcagtacgagtatgcacgaccggtgctcgatttagtgtgagtagtttgggtttgggggctcgtgggagaggagctccagccttgggattcccagctgtctccactcggtgatcggcactgaatacaggagactcaccagtggtagtttgggctgagtcgttggggtttttccttggttgtactttaaagtttttaaaacggtgtacctaggttggtaggaggtgacgaggtcgttggggtggaggtcgggtggggggacggtcgtttaggggtaaacggggtcccgggggggttacccttacggaccctccccgtagtaccacgtcccttcgtcggtactttaccgtactttacgaaggtaacggccgtaggtactaggtaaccgtcgggtcccgaccgtacgggccgtccgggaagggggacggggcgtgggtaggttggggttaccgtaaccgttaaacgtaaaaaccgaaacggtgtaagtgggtaggaacaacgagactacgcgtacgaccgaaccggtagaacggcaagtacctaccgacctacgtcgtaacgtaacgagtaagttaacgtaaaccgttaaaccgaaaacgtccgtaaacgtcttacggtaactcctaaggaaactaaacgtccggaactacgggtaccctaaacgggaacgggaaacccggtaagaccgtaccggtacgggttacgttacggttaaacttacccggtaacggtaccccctaaccgtaaccttaacccggtaaggtaaccccgttactaaaccgtaaccttaccttaacccggttaacgtcggtaacgtaaccggtcggtacgggacccggggtaaacg

SEQ ID NO: 92850 - DNA, 167 bp, Homo sapiens
  misc_feature: GYAE6OF01BFZUA.18.78.H01.1.454.CMB.1.raw
  modified_base (132)..(133): a, c, t, g, unknown or other
  misc_feature (132)..(133): n is a, c, g, or t
  modified_base (135)..(135): a, c, t, g, unknown or other
  misc_feature (135)..(135): n is a, c, g, or t
  modified_base (137)..(167): a, c, t, g, unknown or other
  misc_feature (137)..(167): n is a, c, g, or t
tcagtacgagtatgcacgaccggtgctcgatttagtgtgagtagtttgggtttgggcacagcggccctgggctgcctggtcaaggactacttcccatactcgtactggagcgggctggcaaggcgctatagnncntnnnnnnnnnnnnnnnnnnnnnnnnnnnnnnn

SEQ ID NO: 92851 - DNA, 849 bp, Homo sapiens
  misc_feature: GYAE6OF01C9S8F.18.78.H01.1.454.CMB.1.raw
  modified_base (837)..(837): a, c, t, g, unknown or other
  misc_feature (837)..(837): n is a, c, g, or t
tcagtacgagtatgcacgaccggtgctcgatttagtgtgagtagtttgggtttgggggggggtctcaggaggcagcgctcgtcgggacgtctccaccagtggcctgggctctgctattcctcaccctcctcactcgagggcacgacgggtcctgggcccagtctgcccttagacctacaaccgtcgcctccggtgttacgtggggttcctccgtagggacctaggtccgtaatccgaacctcttccgtccctggacctaacggtacggaaacctaggcgtaacggtcggttaacgggttttgggttaacggttttaaactaaaccgttgtttccggtccttaccggttacgggtaaacccaacgtacgacccaacccggaacggaacctaaacccgaccccctaaaatccgtaattacgttaacgtttagtacgtacgttacgtaacctaaacgttaacccggttcccggtaccgtttaacgggtttaacggggtttaactaaccggttccgtaccttcgttacgtccgtacctaccgtacgtcgtacgaccaccgtacccggtccctaccgtactaccctacttccgtacgtcggacccgtacggtacggtacgtaagggaccggaacgggtacgtacgttaacgttacgtttacgttacgaacgggacctacggtcctttaacaacggttaaccaaccggaactacctaacccgacgttactccgttaacgttcttaggtaccggttaccgttaccggaaaggttccggaaaccgtccgtacccgggtacttacggaccgtacgaccgtaacccgaaacccgtccctaaccggtntccgttaacccg

SEQ ID NO: 92852 - DNA, 835 bp, Homo sapiens
  misc_feature: GYAE6OF01AZJMM.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacgaggagactcaccagtggtaggtttgggctggagtcgttcgggttttccttgttgcttaagttttaaagtgtcctagtgtggagtgccgagcgtgggtggacgggtccgggggacgtcgttacggtccgacggtcccggtcgggggttccctaggtaaaccttccgtccgtggtacgcgtacgtccgtcgttgggttcctaccgttcaggtcgtctcgtcgtctatcgctaccggtcggtcccgcggtcggccggttaccgggaacggtcgtggtggttcgggttcgaccgttaagtaagaacgactaaagtccgtaaacgcggttacgactacgagaacgtgtatggccgtaggtcggtacggtaacggtaacgtccgtaacggtcccgtacccgttacgtaaccgtaaacgttaaacgtacgtaacgtaacgtaaaacggaacgtaccgggtacttaacgtcgtaacgaacggtaaacgtaccgaaacgtacctaaaccggaaaccgtaaaccgggaccggtaaaccggttacccggtaacggttacgttaacggtttaaccggtaccgtttaaaacggagggttacccgttaaggggttaacccgttaggttaaccgggtttagggggttaaccgggttaagttaacccggggtaacggggtaaacccgggggttaaacgggttacccgggttaaaccggttaacggg

SEQ ID NO: 92853 - DNA, 642 bp, Homo sapiens
  misc_feature: GYAE6OF01CNU12.18.78.H01.1.454.CMB.1.raw
  modified_base (234)..(234): a, c, t, g, unknown or other
  misc_feature (234)..(234): n is a, c, g, or t
  modified_base (323)..(323): a, c, t, g, unknown or other
  misc_feature (323)..(323): n is a, c, g, or t
  modified_base (330)..(330): a, c, t, g, unknown or other
  misc_feature (330)..(330): n is a, c, g, or t
  modified_base (439)..(439): a, c, t, g, unknown or other
  misc_feature (439)..(439): n is a, c, g, or t
  modified_base (625)..(625): a, c, t, g, unknown or other
  misc_feature (625)..(625): n is a, c, g, or t
  modified_base (630)..(630): a, c, t, g, unknown or other
  misc_feature (630)..(630): n is a, c, g, or t
  modified_base (634)..(634): a, c, t, g, unknown or other
  misc_feature (634)..(634): n is a, c, g, or t
  modified_base (636)..(637): a, c, t, g, unknown or other
  misc_feature (636)..(637): n is a, c, g, or t
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
tcagtacgagtatgcacgaccggtgctcgatttagtgtgagtagtttgggtttgggggctttgccgtggcccagtctgccctgactcaacctgcctccgtgtctgggtctcctggacagtcgatcaccatctcctgcactaggaccagcagtgacgttggtgttaataactatgtctccgtaggtaccaacacgccacccgaggaccaaaccgacccccaaatcatagtatttnagatgtacactacgtccgccttcggtaggtttctaatccgtcttactcgttacgctaccgaagtctagaccaactccggcccttacccncgaaccncttccgtcgtcggcgtccgacggtcgaggacggagcgtcgttagtattactacgtgtccgacgtactacgtaattacgaaacgacacaccgtactacccttgttacctnttacgttaccggttaccgtaaccgggtacgtacgggtaaccgtacggtacccgtaccgtccggtacacgtaccgacccgaacggtacccctaaccgactcgtacctacttcccgtccgtaccccctcctcctacctcgttaccgtcgtacgacggcgtcggtcgtacggacgtacggccagtaacngtacncgtncnnangnc

SEQ ID NO: 92854 - DNA, 916 bp, Homo sapiens
  misc_feature: GYAE6OF01CQW3T.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcgacactgaatacaggagactcaccagtggtgttgggctggagtcgttgggttttccttgttgcttaagtttaaaggtgtcagtgtgtaggtgcagtcgtgggtagggacggtccgggggagtcgttacggtccgaggtccggtcgggggtaccctagtaaacctcgtaccgtggtcgcgtacgtccgtacggttcggttacctaaccgttcgtaggtcggtcctttaccgtagtccttagtacgtccggtaacggttccgggttacccgccggtaacgggttccgggtttaaaccggggggaaacggttcggttagggggttacggtttaggggttacgttaccggttaagttaacggaaacgtaacgtaaacgtaccgttaaacgtacggttaaacgaccgtaacgtacgtactaacgttacgtcggtacggtccgggtacgggtaaggtacgggtaaaacggtccggtaacggttaccctaccgggttaactaccggaaacgttaaagttacgtaactaaacgtaaacggtaaccgtacggttactaagtactaacgtaacgaagttaaccgaacgtaaccggtaaccggtaaaaccggaaaaccgggtcgggtaaaccgtaccgggttacgttaacgtttacgttaaccggttaacgtaacggttaacgggtaagtaaccgggtttaggtaaacgtttaacggttaacgggggttttaacgggtacggtttaacccggggaacgggttaaacccgggggggtttaaaacccggggttaaccttaacccgggttaaaccggg

SEQ ID NO: 92855 - DNA, 861 bp, Homo sapiens
  misc_feature: GYAE6OF01C1VXZ.18.78.H01.1.454.CMB.1.raw
  modified_base (190)..(190): a, c, t, g, unknown or other
  misc_feature (190)..(190): n is a, c, g, or t
  modified_base (230)..(230): a, c, t, g, unknown or other
  misc_feature (230)..(230): n is a, c, g, or t
  modified_base (853)..(853): a, c, t, g, unknown or other
  misc_feature (853)..(853): n is a, c, g, or t
  modified_base (858)..(858): a, c, t, g, unknown or other
  misc_feature (858)..(858): n is a, c, g, or t
  modified_base (860)..(860): a, c, t, g, unknown or other
  misc_feature (860)..(860): n is a, c, g, or t
tcagtacgagtatgcacgaccggtgctcgatttagtgtgagtagtttggggtttgggggctttgcctgggcccagtctgccctgactcaacctgcctccgtgtctgggtctcctggacagtcgatcaccatctcctgcacgtggaaccagcagtgtacgttggtgttataactatgtctcctagaccaanacgccaccgagaccaaaccgcccccaaatcatgtatttancgtatgtactaagtaacgtccggtacccgtcggttagggtttacctaattccgtcttctcgtcggtaccttaccgaaggttcctaggacccaaaccgtcccgggccccttacccgagtaccctacttccgtaccggtcgggccttccggacggtcgtacgggaacggtccggtacgtcgttaaggtactttacgttaccgtagaccgttactacttaccttaattaagtaaccgaaagtccgaagtacccggacctaacgttaaaccgttacggttaaaccggtttaccggttaaaccggggtaaacggtaacccggggtaacccgttaacgggttaccgttacccggttcccggtttaacccggtaaacggggttacccccgaacccgggttaccccgaaaccggtaaccccttaacccgtaccccctttacgtttcccgtaacccgttacccgtttttccggtaacccccccgtttacccccttacccccttaaccgtttacccgtaaccttaccccggttacccggtacgtacggtaaccggggtaccgggttcccggaaggggtaccaaaccgggggtcccttaaggtaaaccgttcggacttccgtacgaacggttcnctcgngng

SEQ ID NO: 92856 - DNA, 905 bp, Homo sapiens
  misc_feature: GYAE6OF01DTJOJ.18.78.H01.1.454.CMB.1.raw
  modified_base (548)..(548): a, c, t, g, unknown or other
  misc_feature (548)..(548): n is a, c, g, or t
  modified_base (872)..(872): a, c, t, g, unknown or other
  misc_feature (872)..(872): n is a, c, g, or t
  modified_base (882)..(882): a, c, t, g, unknown or other
  misc_feature (882)..(882): n is a, c, g, or t
  modified_base (894)..(894): a, c, t, g, unknown or other
  misc_feature (894)..(894): n is a, c, g, or t
tcagtacgagtatgcacgaccggtgctcgatttagtgtgagtagtttgggttggggctttgcctggcccagtctgccctgactcaacctgcctccgtgtctgggtctcctggaccagtcgatcaccattctcctggactacgtacggaaccagcctagtcgtacggttggtaggttaactattagtcgtactccgtaggtaaccaacgacgaccaaccacgggaaccaaaaccgtacccccaaaatcctattacgtagttttactaggacttcggtacgtaagttaacgccggtaccgtacggttacgggtttacaacgttccggtccttaccgttcggtcggtaccttaccgtaaacgtttcgtacgggaccaaccggtaccggtccccctacgtttacaacctcgttactccgttacgggccttccggaaggcgttaggaaccggtacggtagggtcctttaagtactttaagttaccgacgtacccgttaaggcctttaaacggaaacttaccggttaaaccgtaagggacccaacgggttaacncccgggttaaaaccctccggttaaacgttacgggttaacccgggttaaccggttaaacgggttaacccggtaaaaccgggttaccgggtaaccccgttaacccggggttaccgtaaacccgggtttaccgaacccggttacccgtaaccccgggaaccctaaccccgtacgttaccggtaacccttgggtaccccttaccgttaccccgtaaccgtttacccgtaccgtaaccggttacccgttaacggttcgtaacccgggtcgggtacccgggtccggttaacccgggacggttaaaccgttccgaggttaaacctccggtnttaccggganacgttactacgntacggactggc

SEQ ID NO: 92857 - DNA, 768 bp, Homo sapiens
  misc_feature: GYAE6OF01AB9MG.18.78.H01.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (279)..(279): a, c, t, g, unknown or other
  misc_feature (279)..(279): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcgactcgagggcacgagggtcctgggcccagtctcgccctgactcaacctgcctcgtgtctgggtctcgtaggacngtcgatcaccgtatcctcctgctaccgtacggaaccngtctaggtaggtacggtttgggtacgttaactaacgttntcgttccgtccgtacggtaaccaacgacgccaacccgaggtaccaaaccgacccccaagtcagtagtatttagtgtactcgtacgtacgttaacgtccggtccgttacgggttacgggtttacctaacgttccggttacttccgttacgtcggtacccttaccgtaacgtcggttaccggaaccgtaacccggtacccggttcccgtaccccgttacggtaacccgtacgttccggttaccgggttccggtaccgtacccggtacgggtaccggttacgggtaaccggggacggtaccggtacgttagttaaccgttaccgtttccggtacgtacgtacgtacccttagtaacgtaaccgtaacgtacgacgacggcgtaacgtacctacgtacgtacgtcgtacggacgtaccggacgtaccggtccgtacgttacgtcgtaccgaccgtaccgaaccgaccctaaccgtcgtacgtcccgtacccgg

SEQ ID NO: 92858 - DNA, 173 bp, Homo sapiens
  misc_feature: GYAE6OF02FF9CY.18.78.H01.1.454.CMB.1.raw
  modified_base (173)..(173): a, c, t, g, unknown or other
  misc_feature (173)..(173): n is a, c, g, or t
tcagtacgagtatgcacgaccggtgctcgatttagtgtgagtagtttgggtttgggggaagaggaagactgacggtcccccaggagttcaggtgctgggcacagcggccctgggctgcctggtcaaggactacttcccatactcgtactgagcgggctggcaaggcgcatagn

SEQ ID NO: 92859 - DNA, 491 bp, Homo sapiens
  misc_feature: GYAE6OF02GE6MC.18.78.H01.1.454.CMB.1.raw
  modified_base (365)..(365): a, c, t, g, unknown or other
  misc_feature (365)..(365): n is a, c, g, or t
  modified_base (481)..(491): a, c, t, g, unknown or other
  misc_feature (481)..(491): n is a, c, g, or t
tcagtacgagtatgcacgaccggtgctcgatttagtgtgagtagtttgggtttggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactnaagtcttcggaactgggaccaaggtcaccgtctaggtcagcccaaggccaacccatgtccactctgttcccacctcctccatactcgtactgacgcgggctggcaaggcgcatagnnnnnnnnnnn

SEQ ID NO: 92860 - DNA, 290 bp, Homo sapiens
  misc_feature: GYAE6OF02IYNX9.18.78.H01.1.454.CMB.1.raw
  modified_base (265)..(265): a, c, t, g, unknown or other
  misc_feature (265)..(265): n is a, c, g, or t
  modified_base (285)..(290): a, c, t, g, unknown or other
  misc_feature (285)..(290): n is a, c, g, or t
tcagtacgagtatgcacgaccggtgctcgatttagtgtgagtagtttgggtttggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagccaaggccaacccatgtcactctgttcccacctctccatactcgtactgancggctggcaaggcgcatagnnnnnn

SEQ ID NO: 92861 - DNA, 488 bp, Homo sapiens
  misc_feature: GYAE6OF02I7T3Q.18.78.H01.1.454.CMB.1.raw
  modified_base (478)..(488): a, c, t, g, unknown or other
  misc_feature (478)..(488): n is a, c, g, or t
tcagtacgagtatgcacgaccggtgctcgatttagtgtgagtagtttgggtttggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttcaatcgcttctctggctccaagtctggcaacacggcctccctgaccatctctgggctccaggctgaggcgaggctgattattactgcagctcatatacaagcagcagcactcaagtcttcggaactgggaccaagtcacgtctaggtcagcccaaggccaacccatgccactctcgtcccgccctcctccatacctcgtactgagcgggctgggcaggcgcatacgnnnnnnnnnnn

SEQ ID NO: 92862 - DNA, 297 bp, Homo sapiens
  misc_feature: GYAE6OF02F2JH4.18.78.H01.1.454.CMB.1.raw
  modified_base (291)..(297): a, c, t, g, unknown or other
  misc_feature (291)..(297): n is a, c, g, or t
tcagtacgagtatgcacgaccggtgctcgatttagtgtgagtagtttgggtttggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgtcactctgttcccaccctcctccatactcgtactgagcgggctggcaaggcgcatagnnnnnnn

SEQ ID NO: 92863 - DNA, 395 bp, Homo sapiens
  misc_feature: GYAE6OF02FU3NA.18.78.H01.1.454.CMB.1.raw
  modified_base (372)..(395): a, c, t, g, unknown or other
  misc_feature (372)..(395): n is a, c, g, or t
tcagtacgagtatgcacgaccggtgctcgatttagtgtgagtagtttgggtttggggagagagacccctcccctgggatcctgcagctccaggctcccgtgggtgggttagagttgggaacctatgaacattctgtaggggccactgttcttctccacggcctccctgaccatctcttgggctccaggctgaggacgaggctgattattactgcgagctcatatacaagccagcagcactcaagtcttcggaactgggaccaaggtcaccgtcctaggtcagccccaaggcccaaaccccacgtcgtccactcctcgttccccgccctccgtccatacctcgtactgagcgggtctggcaaggcgacatagnnnnnnnnnnnnnnnnnnnnnnnn

SEQ ID NO: 92864 - DNA, 314 bp, Homo sapiens
  misc_feature: GYAE6OF02G0CBC.18.78.H01.1.454.CMB.1.raw
  modified_base (267)..(267): a, c, t, g, unknown or other
  misc_feature (267)..(267): n is a, c, g, or t
  modified_base (287)..(287): a, c, t, g, unknown or other
  misc_feature (287)..(287): n is a, c, g, or t
  modified_base (293)..(294): a, c, t, g, unknown or other
  misc_feature (293)..(294): n is a, c, g, or t
  modified_base (296)..(314): a, c, t, g, unknown or other
  misc_feature (296)..(314): n is a, c, g, or t
tcagtacgagtatgcacgaccggtgctcgatttagtgtgagtagtttgggtttggggtttcgtaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtccactctgttccaccctcctccatactcgtnctgagcgggctggcaaggcncatagnngnnnnnnnnnnnnnnnnnnn

SEQ ID NO: 92865 - DNA, 698 bp, Homo sapiens
  misc_feature: GYAE6OF02JD1OC.18.78.H01.1.454.CMB.1.raw
  modified_base (590)..(590): a, c, t, g, unknown or other
  misc_feature (590)..(590): n is a, c, g, or t
  modified_base (687)..(688): a, c, t, g, unknown or other
  misc_feature (687)..(688): n is a, c, g, or t
  modified_base (690)..(698): a, c, t, g, unknown or other
  misc_feature (690)..(698): n is a, c, g, or t
tcagtacgagtatgcacgaccggtgctcgatttagtgtgagtagtttgggtttgggggctttgcctgggcccagtctgccctgactcaacctgcccctccgtgtcgtggtcctccgtggacagtcgatccaccatcctcctgcacgtacggaaccagcagtgtacggtttggttgttaataactatgtcctccgtacggtaaccaacagaccacccgaggacaaacccgacccccaaactcagtagttaatttatagattcgtacgtaagttaacgtcccggtcccctacgggttacggggttttactaacgtccgttcctttccttcgtcggcccttaccgaagttcgtcgggaaccaaaccgacccggtcccccttcccgtacgaaccctacttccttcggtcgggccctaccggaggtcctaggaacgggacggacgggtctagtaattttaacttacgtcgacagtcctactaattaactaacaagcaggacacgaccacctacaacgtttccgttaccgggaacgtcgggaaaccctaaggtcccacccgttcgtaggtcaccgacccgaacggaccccaacccncgtcgtaccacctcttacccgttacccccacccttcccacctacttacctccgtactcggacggccggtcgtcggacgaacggccgaactagtacgnngnnnnnnnnn

SEQ ID NO: 92866 - DNA, 494 bp, Homo sapiens
  misc_feature: GYAE6OF02IMAVV.18.78.H01.1.454.CMB.1.raw
  modified_base (486)..(494): a, c, t, g, unknown or other
  misc_feature (486)..(494): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcacgtctaggtcagcccaaggccaacccatcgtcactctcgttccccgcctcctccatacctcgtactgacgcgggctggcaggcacatagnnnnnnnnn

SEQ ID NO: 92867 - DNA, 490 bp, Homo sapiens
  misc_feature: GYAE6OF02GD4MV.18.78.H01.1.454.CMB.1.raw
  modified_base (369)..(369): a, c, t, g, unknown or other
  misc_feature (369)..(369): n is a, c, g, or t
  modified_base (476)..(476): a, c, t, g, unknown or other
  misc_feature (476)..(476): n is a, c, g, or t
  modified_base (482)..(490): a, c, t, g, unknown or other
  misc_feature (482)..(490): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctcctgaccatctctgggctccaggctgaggacgaggctgattatactgcagctcatatacaagcacagcactctctatntcttcggaactgggaccaaggtcacgtcctaggtcacgcccaaggccaacccactcgcactctcgttcccacctcctccatactcgtactgagcggctggcaaggcncatagnnnnnnnnn

SEQ ID NO: 92868 - DNA, 490 bp, Homo sapiens
  misc_feature: GYAE6OF02F8J7T.18.78.H01.1.454.CMB.1.raw
  modified_base (423)..(423): a, c, t, g, unknown or other
  misc_feature (423)..(423): n is a, c, g, or t
  modified_base (482)..(490): a, c, t, g, unknown or other
  misc_feature (482)..(490): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcacagcactctctatgtcttcggaactgggaccaaggtcaccgtctaggtcagcccaaggccaacccnctgcactctcgttcccgcctcctccatactcgtactgagcgggctggcaggcgcatagnnnnnnnnn

SEQ ID NO: 92869 - DNA, 492 bp, Homo sapiens
  misc_feature: GYAE6OF02IS9NY.18.78.H01.1.454.CMB.1.raw
  modified_base (482)..(492): a, c, t, g, unknown or other
  misc_feature (482)..(492): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggactgggaccaaggtcacgtctaggtcagcccaaggccaacccactcgtcactctcgttcccacctcctccatacctcgtactgacgcggctggcaaggcgcatagnnnnnnnnnnn

SEQ ID NO: 92870 - DNA, 144 bp, Homo sapiens
  misc_feature: GYAE6OF02JQA56.18.78.H01.1.454.CMB.1.raw
  modified_base (132)..(144): a, c, t, g, unknown or other
  misc_feature (132)..(144): n is a, c, g, or t
tcagtacgagtatgcacgaccggtgctcgatttagtgtgagtagtttgggtttgggcgacagcggccctgggctgcctggtcaaggactacttcccatactcgtactgagcgggcctggcaaggcgcatagnnnnnnnnnnnnn

SEQ ID NO: 92871 - DNA, 518 bp, Homo sapiens
  misc_feature: GYAE6OF02HLRBA.18.78.H01.1.454.CMB.1.raw
  modified_base (508)..(508): a, c, t, g, unknown or other
  misc_feature (508)..(508): n is a, c, g, or t
  modified_base (513)..(518): a, c, t, g, unknown or other
  misc_feature (513)..(518): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattatactgcagctcatatacaagcaagcagcactcaagtcttacggaactgggaccaaggtcaccgtctaggtcagcccaaggccaacccactcgtccactctcgttcccaccctcctacctactacctcgtactcgacgccgggctcggcgtaacgggccgacgtacgttagctgnacgcnnnnnn

SEQ ID NO: 92872 - DNA, 522 bp, Homo sapiens
  misc_feature: GYAE6OF02I09BT.18.78.H01.1.454.CMB.1.raw
  modified_base (435)..(435): a, c, t, g, unknown or other
  misc_feature (435)..(435): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcactaatcggccctcaggggtttctaatcgcttctctggctccaagtctggcaacacggcctccctgaccatctctgggctccaggctgaggacgagctagattattactgcagctcatatacaanacaccagcactctctatgtcgttacgacgtggaccgaaggtactaccgtacctaggtcacgccgaacgcccaaccccacctgtaccg

SEQ ID NO: 92873 - DNA, 130 bp, Homo sapiens; identical to SEQ ID NO: 92615
  misc_feature: GYAE6OF02ISZV1.18.78.H01.1.454.CMB.1.raw
  modified_base (130)..(130): a, c, t, g, unknown or other
  misc_feature (130)..(130): n is a, c, g, or t

SEQ ID NO: 92874 - DNA, 580 bp, Homo sapiens
  misc_feature: GYAE6OF02JY3AH.18.78.H01.1.454.CMB.1.raw
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggacaaacgcccccaaactcatgatttatgatgtacagtaatcggccctcgaggggtttctaatcgtcttctcgtgctcagtctggacaacgacggcctcctcgaccatctcgtcgggcctccgaggtctggacgggacgaggctagtattacttacgtgacgacgctacgtatactaacagacagacagccactcaaacgttcttacggaacgtcgggaacctaacgggtccaaccgttccgtaacggtccgaacggtaccccgaacgggaccccaaaccccgacgttacgtcctaacccg

SEQ ID NO: 92875 - DNA, 561 bp, Homo sapiens
  misc_feature: GYAE6OF02HGTI9.18.78.H01.1.454.CMB.1.raw
  modified_base (315)..(315): a, c, t, g, unknown or other
  misc_feature (315)..(315): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (545)..(546): a, c, t, g, unknown or other
  misc_feature (545)..(546): n is a, c, g, or t
  modified_base (550)..(550): a, c, t, g, unknown or other
  misc_feature (550)..(550): n is a, c, g, or t
  modified_base (554)..(554): a, c, t, g, unknown or other
  misc_feature (554)..(554): n is a, c, g, or t
  modified_base (557)..(557): a, c, t, g, unknown or other
  misc_feature (557)..(557): n is a, c, g, or t
  modified_base (559)..(560): a, c, t, g, unknown or other
  misc_feature (559)..(560): n is a, c, g, or t
tcagtacgagtatgcacgaccggtgctcgatttagtgtgagtagtttgggtttgggggtcggtttgccgtgggcccagtcttggccctcgactctaacctgtcctccgtgtctgggtctcctggacagtcgatcaccatctcctgtcgactggaaccagcgagttcgacgttggtggttataacttaatgtctcctggtaccaacagcaccaggcaaagcccccggaaactcactcgagtttactgatgtcactaatcggccctgagggtttcaactcgcttctctggctccaagtctggcaacacggcctcccnggaccgatcgtcgtggggctccgaggtacctaggaggacggaggctggattacttactgcacgtctcagtactacaagtccaccagccacttacgtctaattcgtcttacggaacgtggggaccaagggttccaaccgttcctaggtccaagtcccaaggcccaacccncncgtcactctctcccacctcctcatactcgtactgagcgggctcggacacggcacatagnnggcngacngcncnnc

SEQ ID NO: 92876 - DNA, 184 bp, Homo sapiens
  misc_feature: GYAE6OF02GC6LL.18.78.H01.1.454.CMB.1.raw
  modified_base (173)..(184): a, c, t, g, unknown or other
  misc_feature (173)..(184): n is a, c, g, or t
tcagtacgagtatgcacgaccggtgctcgatttagtgtgagtagtttgggtttgggggaagaggaagactgacggtcccccaggagttcaggtgctgggcacagcggccctgggctgcctggtcaaggactacttcccatactcgtactgagcgggctggcaaggcgcatagnnnnnnnnnnnn

SEQ ID NO: 92877 - DNA, 510 bp, Homo sapiens
  misc_feature: GYAE6OF02G6UZ2.18.78.H01.1.454.CMB.1.raw
  modified_base (424)..(424): a, c, t, g, unknown or other
  misc_feature (424)..(424): n is a, c, g, or t
  modified_base (501)..(510): a, c, t, g, unknown or other
  misc_feature (501)..(510): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggcgaggctgattattactgcagctcatatacaagcaccagcactctctatgtcttcggaactgggaccaaggtcaccgtcaggtcagcccaaggcccaaccccnctcgtcacctccttcctaccctccctcctactactccgtaccgtacgtcgcgggcgtcgcgacgacggcgacagtgnnnnnnnnnn

SEQ ID NO: 92878 - DNA, 480 bp, Homo sapiens
  misc_feature: GYAE6OF02JH5GY.18.78.H01.1.454.CMB.1.raw
  modified_base (333)..(333): a, c, t, g, unknown or other
  misc_feature (333)..(333): n is a, c, g, or t
  modified_base (412)..(413): a, c, t, g, unknown or other
  misc_feature (412)..(413): n is a, c, g, or t
  modified_base (428)..(428): a, c, t, g, unknown or other
  misc_feature (428)..(428): n is a, c, g, or t
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
  modified_base (468)..(468): a, c, t, g, unknown or other
  misc_feature (468)..(468): n is a, c, g, or t
  modified_base (472)..(480): a, c, t, g, unknown or other
  misc_feature (472)..(480): n is a, c, g, or t
tcagtacgagtatgcacgaccggtgctcgatttagtgtgagtagtttgggtttgggggtcgtttgcctgggcccagtctgtgctgacgcagccgccctcagtgtctggggccccgagggcagagggtcaccatctcctgcactgggagcacctccaacatcggggcggttatgatgtacactggtaccagcagcttccagggacagcccccaaatcctcatcttggagcaacaatcgccctcagggtccctgaccgattctctggctccaagtctggcacctcagccctccctggccatcactggctccaggctgagatgagctgactatacngcctagtcctatgacatgaggctgatggtctatgtctgatcgtggaccaggtcacgtctaagtcagccaagccaccctnntcactctcgttcccncctctccatctcgtacngagccggntcggacaaggcacanagtnnnnnnnnn

SEQ ID NO: 92879 - DNA, 510 bp, Homo sapiens
  misc_feature: GYAE6OF02HXQBL.18.78.H01.1.454.CMB.1.raw
  modified_base (501)..(504): a, c, t, g, unknown or other
  misc_feature (501)..(504): n is a, c, g, or t
  modified_base (506)..(510): a, c, t, g, unknown or other
  misc_feature (506)..(510): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaaactcatgattttatgatgtcagtaatcggccctcaggggtttctaatcgcttctctggctccaagtctggcaacacggcctccctgaccatctctgggctccgaggctgaggacgaggctgattatactgcagctcatatacaagcagcagcactcaagtcttacggaactgggaccaaggtcaccgtcctaggtcagcccaaggcccaaccccactcgtccactcctcgttccccgccctccctccatacctcgtactcgacggccggctggcaaggccgctatagcnnnncnnnnn

SEQ ID NO: 92880 - DNA, 552 bp, Homo sapiens
  misc_feature: GYAE6OF02HUGO7.18.78.H01.1.454.CMB.1.raw
  modified_base (455)..(455): a, c, t, g, unknown or other
  misc_feature (455)..(455): n is a, c, g, or t
tcagtacgagtatgcacgaccggtgctcgatttagtgtgagtagtttgggtttggggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtacactaatcggcctcgagggtttctaatcgcttctctgctcaagtctggacaacacggcctccctgaccatctctcgggctcaggctggaggacgaggctgtaatttattactgcagctacataactaacaagccaaccgancctactctctaattcgtcgttacggacgtcgggaacctaaggtccaaccggtcctacggtcacgacccgaacggaccccaacccctactttaccacc

SEQ ID NO: 92881 - DNA, 550 bp, Homo sapiens
  misc_feature: GYAE6OF02IJ083.18.78.H01.1.454.CMB.1.raw
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtggattggccgtattagaagcaaagctaacagttacgcgacagcatatgctgcgtcggtagaaggcaggtcacgtctccagaaatgattacaaagaacgacggacgtatctagacaaatagaacacgacctacgaaacgagacacggccgtagtattactgtacgtagacaggtagattacgagttaggggtagttagtacgacggtaagggggtacg

SEQ ID NO: 92882 - DNA, 497 bp, Homo sapiens
  misc_feature: GYAE6OF02GK4QZ.18.78.H01.1.454.CMB.1.raw
  modified_base (489)..(497): a, c, t, g, unknown or other
  misc_feature (489)..(497): n is a, c, g, or t
tcagtacgagtatgcacgaccggtgctcgatttagtgtgagtagtttgggtttgggggctttgcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggcccaacccatgtcactctcgttcccaccctcctccatacctcgtactgacgcgggctggcaaggcgacatagnnnnnnnnn

SEQ ID NO: 92883 - DNA, 576 bp, Homo sapiens
  misc_feature: GYAE6OF02FZY5N.18.78.H01.1.454.CMB.1.raw
  modified_base (157)..(157): a, c, t, g, unknown or other
  misc_feature (157)..(157): n is a, c, g, or t
  modified_base (180)..(180): a, c, t, g, unknown or other
  misc_feature (180)..(180): n is a, c, g, or t
  modified_base (182)..(182): a, c, t, g, unknown or other
  misc_feature (182)..(182): n is a, c, g, or t
  modified_base (184)..(184): a, c, t, g, unknown or other
  misc_feature (184)..(184): n is a, c, g, or t
  modified_base (187)..(188): a, c, t, g, unknown or other
  misc_feature (187)..(188): n is a, c, g, or t
  modified_base (192)..(192): a, c, t, g, unknown or other
  misc_feature (192)..(192): n is a, c, g, or t
  modified_base (194)..(194): a, c, t, g, unknown or other
  misc_feature (194)..(194): n is a, c, g, or t
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (222)..(222): a, c, t, g, unknown or other
  misc_feature (222)..(222): n is a, c, g, or t
  modified_base (277)..(277): a, c, t, g, unknown or other
  misc_feature (277)..(277): n is a, c, g, or t
  modified_base (296)..(296): a, c, t, g, unknown or other
  misc_feature (296)..(296): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagcggngttcgtctaggcgcttaagtgcntngngtnnagcngngncgggngctgcagctgggtcctgaacntcctgtgcagcctctgggttcaccttcagtggctctgctatgcactggtccgccngcgttccggaaggcgtggngtgggtggtcgtagttagaagacgaagactaacagtacgacgacgacgactatagtgcgtcgcggtacggtacggaacggacgtacgttacgtaccgtcctacgagtaatagtactaacgaaacgaacgacgtacgtactcgtagacaatacgaacgacgaccgtaacgaaaccgaacggaacgaccgtacgtacgtattacgtacgtacgtagagtaaggtagtagtacgttaggttaggtagttacgtacggtacgggtaacggggtacgtacgtacg

SEQ ID NO: 92884 - DNA, 310 bp, Homo sapiens
  misc_feature: GYAE6OF02ITXAH.18.78.H01.1.454.CMB.1.raw
  modified_base (291)..(310): a, c, t, g, unknown or other
  misc_feature (291)..(310): n is a, c, g, or t
tcagtacgagtatgcacgaccggtgctcgatttagtgtgagtagtttgggtttgggggtttcgtaatcgcttctctggctccaagtctggcaacaccggcctccctgaccatctctgggctccaggctgaggacgaggctgattattactgcagctcatatacaagcagcagcactcaagtcttcggaactgggaccaaggtcaccgtctaggtcagcccaaggccaacccatgtcactctgttccacctcctccatactcgtgctgacgcgggctggcaaggcacatagnnnnnnnnnnnnnnnnnnnn

SEQ ID NO: 92885 - DNA, 297 bp, Homo sapiens
  misc_feature: GYAE6OF02IU4A1.18.78.H01.1.454.CMB.1.raw
  modified_base (292)..(297): a, c, t, g, unknown or other
  misc_feature (292)..(297): n is a, c, g, or t
tcagtacgagtatgcacgaccggtgctcgatttagtgtgagtagtttggttttggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccgccctcctccatactctacctgagcgggctggcaaggcgcatagnnnnnn

SEQ ID NO: 92886 - DNA, 562 bp, Homo sapiens
  misc_feature: GYAE6OF02ITIK2.18.78.H01.1.454.CMB.1.raw
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctggggggtccctgaactctcctgtgcagcctctgggttcaccttcagtggctctgctatgcactgggtccgccaggcttccgggaaggctggagtgggttggccgtattagaagcaaagctaacagttacgcgacagcatatgctgcgtcggtagaaggcgaggttcaccgtctccagaaatgattacaaagaacacggacgtactctgacaaatagaacagacctagaaaccgaggaacgacggcgtagtattacgtagtactagacgaggtaggtattacgtagtttaggggagttagtcggacggtaacggggggtactaacgg

SEQ ID NO: 92887 - DNA, 595 bp, Homo sapiens
  misc_feature: GYAE6OF02I2W6S.18.78.H01.1.454.CMB.1.raw
  modified_base (249)..(249): a, c, t, g, unknown or other
  misc_feature (249)..(249): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttanaactatgtctcctggtaccaacagcacccaggcaaacgcccccaaactcatgatttatgatgtcactaatccggccctgagggtttctaatcgcttctctggctcaagtctggcaacacggcctcctgaccatctcgtgggcctccgaggctggaggacgaggctagacttattactgacagtctacatataacgagccaccgagcctacttccttactacttcgttaccgttacggaacgttcggggtaacccgtaacgggttccctaaccggttcccgttaacgggtaccgaaccggtccccggaaaaccggtcccccaaacccccgtacgttacggtaccccc

SEQ ID NO: 92888 - DNA, 552 bp, Homo sapiens
  misc_feature: GYAE6OF02G2YHE.18.78.H01.1.454.CMB.1.raw
  modified_base (545)..(545): a, c, t, g, unknown or other
  misc_feature (545)..(545): n is a, c, g, or t
tcagtacgagtatgcacgaccggtgctcgatttagtgtgagtagtttgggtttgggggctctgggagaggagatccagccttgggattcccagctgtctccactcggtgatcggcactgaatacaggagactcaccatggagtttgggctgagctgggttttccttgttgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaactgatggtgggacaacagactacgctgcacccgtgaaaggcagattcaccatctcaagagatgattacaaaaagcaacgctgtatctgacaaatgaacagcctgagaaccgaggacacgagccgtagtacttactgtaccacactccctagaaacgctacaactactactactacggtatggaccttcgngggaccg

SEQ ID NO: 92889 - DNA, 130 bp, Homo sapiens; identical to SEQ ID NO: 92615
  misc_feature: GYAE6OF02GC03W.18.78.H01.1.454.CMB.1.raw
  modified_base (130)..(130): a, c, t, g, unknown or other
  misc_feature (130)..(130): n is a, c, g, or t

SEQ ID NO: 92890 - DNA, 318 bp, Homo sapiens
  misc_feature: GYAE6OF02F1JUU.18.78.H01.1.454.CMB.1.raw
  modified_base (294)..(318): a, c, t, g, unknown or other
  misc_feature (294)..(318): n is a, c, g, or t
tcagtacgagtatgcacgaccggtgctcgatttagtgtgagtagtttgggtttggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaacccctatgtccactctgttccccgccctcctccgatactcgtactgagcgggctggcaaggcgcatagnnnnnnnnnnnnnnnnnnnnnnnnn

SEQ ID NO: 92891 - DNA, 489 bp, Homo sapiens
  misc_feature: GYAE6OF02F2HBI.18.78.H01.1.454.CMB.1.raw
  modified_base (420)..(420): a, c, t, g, unknown or other
  misc_feature (420)..(420): n is a, c, g, or t
  modified_base (437)..(437): a, c, t, g, unknown or other
  misc_feature (437)..(437): n is a, c, g, or t
  modified_base (480)..(489): a, c, t, g, unknown or other
  misc_feature (480)..(489): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgacccatctctgggctccaggctgaggacgaggctgattattactgcagctcatatacaagcagcagcactcaagtcttcggactgggaccaaggtcacgtctagtcagcccaaggcccaacccntcgcactctcgttcccncctcctccatcctcgtactgacgcgggctggcaggcgcatagnnnnnnnnnn

SEQ ID NO: 92892 - DNA, 525 bp, Homo sapiens
  misc_feature: GYAE6OF02G6XYG.18.78.H01.1.454.CMB.1.raw
  modified_base (305)..(305): a, c, t, g, unknown or other
  misc_feature (305)..(305): n is a, c, g, or t
  modified_base (438)..(438): a, c, t, g, unknown or other
  misc_feature (438)..(438): n is a, c, g, or t
  modified_base (456)..(456): a, c, t, g, unknown or other
  misc_feature (456)..(456): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (520)..(520): a, c, t, g, unknown or other
  misc_feature (520)..(520): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaatcatgatttangatgtcactaatccggccctcgtagggtttctaatcgtcttctctggctcaagtctggcaacacggcctccctgacccatcctcgtcgggcctccgaggcctggacggacgaggtctagatttattactgacngctacatatacaagcacngcactctntntgtctcgagtcgggactaagtccaccgtctaggtcacgcccaacggcccacccntaccg

SEQ ID NO: 92893 - DNA, 564 bp, Homo sapiens
  misc_feature: GYAE6OF02H7PY8.18.78.H01.1.454.CMB.1.raw
  modified_base (306)..(306): a, c, t, g, unknown or other
  misc_feature (306)..(306): n is a, c, g, or t
  modified_base (376)..(376): a, c, t, g, unknown or other
  misc_feature (376)..(376): n is a, c, g, or t
  modified_base (429)..(429): a, c, t, g, unknown or other
  misc_feature (429)..(429): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaatcatgatttangatgtcagtaatcggccctcgaggggttctaatcgtcttctctggcctcagtctggcaacacggcctccngaccatctcgtgggctccgaggctggaggacgaggctgattatactgcagctnatatacaagcagacagaccactactaagtccgttacggacgtacgggaacctaacggtccaacccggttccgtaacggttccaacggccccgaaacgggcccccaaacccccgtagttaccgtaccttaaccccg

SEQ ID NO: 92894 - DNA, 498 bp, Homo sapiens
  misc_feature: GYAE6OF02HZ99C.18.78.H01.1.454.CMB.1.raw
  modified_base (467)..(467): a, c, t, g, unknown or other
  misc_feature (467)..(467): n is a, c, g, or t
  modified_base (480)..(480): a, c, t, g, unknown or other
  misc_feature (480)..(480): n is a, c, g, or t
  modified_base (487)..(488): a, c, t, g, unknown or other
  misc_feature (487)..(488): n is a, c, g, or t
  modified_base (490)..(490): a, c, t, g, unknown or other
  misc_feature (490)..(490): n is a, c, g, or t
  modified_base (492)..(498): a, c, t, g, unknown or other
  misc_feature (492)..(498): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgtttggtggttataactatgtctcctggtaccaacagcacccaggcaaagcccccaaatcatgattttatgatgtcagtaatcggccctcaggggtttcaatcgcttctctggctccaagtctggcaacacggcctccctgaccatctctgggctccaggctggaggacgaggctgattatactgcagctcatatacaagcaccagcactctctatgtcttcggaactgggaccaggtcacgtctaggtcagccaaggcccaacccatctcactcctgttcccctctccattactcgtactggacgccgggntcggcaaggtccncaatcgnngncnnnnnnn

SEQ ID NO: 92895 - DNA, 560 bp, Homo sapiens
  misc_feature: GYAE6OF02GUQX5.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgctatttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcgttccgggaaagggctggagtggggttggccgtattagaagcaaagctaacagttacgcgacagcatatgctgcgtcggtgaaaggcaggtcacgtctcagaatgatacaaagaacacggacgtatctagacaaatagaacagacctagaaaccgaaggacgacggccgtagtattactagtacgtagacgaggtagtatacgtagttggggtagttagtcggacggtaacggggggtacgtagtacgg

SEQ ID NO: 92896 - DNA, 523 bp, Homo sapiens
  misc_feature: GYAE6OF02HLCED.18.78.H01.1.454.CMB.1.raw
  modified_base (435)..(435): a, c, t, g, unknown or other
  misc_feature (435)..(435): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggccctcgaggggtttctaagtcgcttctctggctccaagtctgcaacacggcctcctgaccatctcgtggctccgagctgaggacgagctgattatactgcagctcatatacagnagcagcatcaagtctacggaactgggacaacggtcaccgttcgaggtaccacgtacccaaggccccaaacccgtactccgtctaaccg

SEQ ID NO: 92897 - DNA, 848 bp, Homo sapiens
  misc_feature: GYAE6OF02J3OKZ.18.78.H01.1.454.CMB.1.raw
  modified_base (839)..(839): a, c, t, g, unknown or other
  misc_feature (839)..(839): n is a, c, g, or t
tcagtacgagtatgcacgaccggtgctcgatttagtgtgagtagtttgggtttggggtaggctctgggagaggagctccagccttgggattcccagctgtctccactcggtgatcggcactgaatacaggagactcaccatggagttggctgagctggtttccttgttgctatttaaagtgtcagtgtgaggtgcgagctggtggaggtccgggggaggtcgttcgggtccacggccggttcggggggtccctacgaacctcgttccgtgttcgccgacgtcccgtcgttcgggttcctacccgttccgtaggttcggtcccgttccgttacggtcccgttaagttccggtacctacccgggtttccgggggtccccggtacccggtaaccgggtcccgggttttaaccccggggggaaaacgggggttcccggttagggggtaacgggtttcggggggtttaccgggtacccgggttaaggtttaaacgggaacggtaaccgtaaaaggtacccgtaacgtaacgggttaaccggtacggaacgagtaacctaagtacgtacggtccgtacggtaccggtacgggttaaggaaaccgggacgttacgggttaccctaacccggttacccgtaacccgtaagtaaaacgtacgtaacttaacgaaaaacggaaccgtaccgggtaccgttaactccttagaacctaacgtaacgaacgaccgtaccgtaacgaaaacggcgtaaccgacgtacgtagttaactacgtacacgtacgaacgtggagttaagttaccggtaggtttacgggacgtaagacgggtaacgggtaaaccgggtnttaaccggg

SEQ ID NO: 92898 - DNA, 310 bp, Homo sapiens
  misc_feature: GYAE6OF02HD7R1.18.78.H01.1.454.CMB.1.raw
  modified_base (286)..(286): a, c, t, g, unknown or other
  misc_feature (286)..(286): n is a, c, g, or t
  modified_base (292)..(310): a, c, t, g, unknown or other
  misc_feature (292)..(310): n is a, c, g, or t
tcagtacgagtatgcacgaccggtgctcgatttagtgtgagtagtttgggtttggggtttctaagtcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagccaaggccaacccactgtcactctcgttcccgcctcctccatacctcgtactgacgcggctggacaaggcncatagnnnnnnnnnnnnnnnnnnn

SEQ ID NO: 92899 - DNA, 591 bp, Homo sapiens
  misc_feature: GYAE6OF02I47IG.18.78.H01.1.454.CMB.1.raw
  modified_base (238)..(238): a, c, t, g, unknown or other
  misc_feature (238)..(238): n is a, c, g, or t
  modified_base (380)..(380): a, c, t, g, unknown or other
  misc_feature (380)..(380): n is a, c, g, or t
  modified_base (480)..(480): a, c, t, g, unknown or other
  misc_feature (480)..(480): n is a, c, g, or t
  modified_base (505)..(505): a, c, t, g, unknown or other
  misc_feature (505)..(505): n is a, c, g, or t
  modified_base (570)..(570): a, c, t, g, unknown or other
  misc_feature (570)..(570): n is a, c, g, or t
  modified_base (577)..(577): a, c, t, g, unknown or other
  misc_feature (577)..(577): n is a, c, g, or t
  modified_base (583)..(584): a, c, t, g, unknown or other
  misc_feature (583)..(584): n is a, c, g, or t
  modified_base (587)..(587): a, c, t, g, unknown or other
  misc_feature (587)..(587): n is a, c, g, or t
  modified_base (589)..(589): a, c, t, g, unknown or other
  misc_feature (589)..(589): n is a, c, g, or t
tcagtacgagtatgcacgaccggtgctcgatttagtgtgagtagtttggtttgggggtcgtttgccctgggcccagtcctgccctggactcaacctggcctccgtgttctgggtctcctggacagtcgagtcaaccatctcctgccactggaaccagcagtgaacgttggtggttataactactgtctcctggtaccaacgagcacccaggcaaagcccccaaaatcatagatttagngatgtcagtaatccggccctgtaggggttttctaagtcgcttctcttggcctaccaagtcgtaggcaacgccgggcctccctgacctatcgtccggtagggcctccgaggctaggaggacgaggctgactttacttactgcngtctacaatagtaacaagcacgtccacgacactacgacgttcttacggaacgtcgggaaccaagggtccaaccgtctagcacgacccgacggcccaaccncgtcgtacacgtctaccgttccccnccttacctccgacgtacctccgttacacggacgtcggtctggaccgtaaggccgtacaggtacgnacgtcgntacggnnctntntg

SEQ ID NO: 92900 - DNA, 494 bp, Homo sapiens
  misc_feature: GYAE6OF02HE7TW.18.78.H01.1.454.CMB.1.raw
  modified_base (339)..(339): a, c, t, g, unknown or other
  misc_feature (339)..(339): n is a, c, g, or t
  modified_base (423)..(423): a, c, t, g, unknown or other
  misc_feature (423)..(423): n is a, c, g, or t
  modified_base (442)..(442): a, c, t, g, unknown or other
  misc_feature (442)..(442): n is a, c, g, or t
  modified_base (484)..(485): a, c, t, g, unknown or other
  misc_feature (484)..(485): n is a, c, g, or t
  modified_base (487)..(494): a, c, t, g, unknown or other
  misc_feature (487)..(494): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattacngcagctcatatacaagcagcagcactcaagtcttacggaactgggaccaaggtcaccgtctaggccagcccaaggcccaacccnctcgtcactctcgtccccncctcctcatcctcgtactgacgcgggctggcaggcgcagtgnncnnnnnnnn

SEQ ID NO: 92901 - DNA, 548 bp, Homo sapiens
  misc_feature: GYAE6OF02IQPRX.18.78.H01.1.454.CMB.1.raw
  modified_base (473)..(473): a, c, t, g, unknown or other
  misc_feature (473)..(473): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggtttccttgttgctatttaaaggtgtccagtgtgaggtgcagctggtggagtccgggggaggcttggtccagccgtgggggtccctgaaactctcctgtgcagcctctgggttcaccttcagtggctctgctatgcactgggtccgccaggcttccgggaagggctgggagtgggttggccgtattagaagcaaagctaaacagttacgcgacagcatatgctgcgtcggtgaaaggcgaggttcaccgtctccagaatgattcaaagacacggcgtatctgacaatgaacagcctagaaaccgaggacacgcgtntagttactgtactagacgaggtagtatacgagtttggggtagttacgtcgcgggaacggggggtactagtaacgg

SEQ ID NO: 92902 - DNA, 494 bp, Homo sapiens
  misc_feature: GYAE6OF02GYH4I.18.78.H01.1.454.CMB.1.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (346)..(346): a, c, t, g, unknown or other
  misc_feature (346)..(346): n is a, c, g, or t
  modified_base (484)..(494): a, c, t, g, unknown or other
  misc_feature (484)..(494): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaaatcatgatttangatgtcactaatcggccctnaggggtttctaatcgcttctctggctccaagtctggcaacacggcctccctgaccatctctgggcctccaggctgaggacgaggctgattatactgcagctnatatacaagcagcagcactcaagtctcggaactggacaaggtcaccgtctagtcagcccaaggccaacccactcgtcactctcgttcccaccctccctcactacctcgtactcgacgcgggctggcaaggcgcatagnnnnnnnnnnn

SEQ ID NO: 92903 - DNA, 529 bp, Homo sapiens
  misc_feature: GYAE6OF02HQWHA.18.78.H01.1.454.CMB.1.raw
  modified_base (458)..(458): a, c, t, g, unknown or other
  misc_feature (458)..(458): n is a, c, g, or t
  modified_base (519)..(519): a, c, t, g, unknown or other
  misc_feature (519)..(519): n is a, c, g, or t
tcagtacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcaccaggcaaagcccccaaatcatgatttatgatgtcagtaatccggccctcgaggggtttctaatcgtcttctctggctccaagtctggacaacacggcctccctgaccatctcgtcgggctccgaggctggacggacgaggctgtattagtactgcagtctacatactacaagcagcagcactntaagtcgttacggaactcgggactaggtccaccgtctaggtcacgacccaggcccaacccnttcgactacg

SEQ ID NO: 92904 - DNA, 562 bp, Homo sapiens
  misc_feature: GYAE6OF02GDGS5.18.78.H01.1.454.CMB.1.raw
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctgggggtccctgaactctcctgtgcagcctctgggttcaccttcagtggctctgctatgcactgggtccgccaggcttccgggaaagggctggagtgggtggccgtattagaagcaaagctaacagttacgcgacagcatatgctgcgtcggtgaaggcaggtcaccgtctccagaaatgattacaaagaacacggacgtatactgacaaatagaacagcctagaaaccgaggacgacggccgtagtattacgtgtactagaacaggtggtaagttacgtaggtttggggtagttagtacggacggtaacggggggtacttaaccgg

SEQ ID NO: 92905 - DNA, 552 bp, Homo sapiens
  misc_feature: GYAE6OF02GSFOK.18.78.H01.1.454.CMB.1.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (283)..(283): a, c, t, g, unknown or other
  misc_feature (283)..(283): n is a, c, g, or t
  modified_base (352)..(352): a, c, t, g, unknown or other
  misc_feature (352)..(352): n is a, c, g, or t
  modified_base (540)..(541): a, c, t, g, unknown or other
  misc_feature (540)..(541): n is a, c, g, or t
  modified_base (544)..(544): a, c, t, g, unknown or other
  misc_feature (544)..(544): n is a, c, g, or t
  modified_base (547)..(548): a, c, t, g, unknown or other
  misc_feature (547)..(548): n is a, c, g, or t
  modified_base (550)..(552): a, c, t, g, unknown or other
  misc_feature (550)..(552): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaatcatgatttangatgtcagtaatcggcctnagggtttctaatcgcttctctggctccaagtctggcaacncggcctccctgacctatctctgggctccaggctgaggcgagctgattatactgcagctcaatatacaancaaccagcactctctatgtctcgaactggaccaagtcaccgtctagcacgacccaaggcccaaccccactcgtaccacttccgtaccgtttcccccgcccttacccgtccctaacgttacccgttaccgtaccgtacgaacgggtcccgggtaccgtacggacgaacgggtccgaaccgtagtaccgnngcncgnncnnn

SEQ ID NO: 92906 - DNA, 571 bp, Homo sapiens
  misc_feature: GYAE6OF02IKLGP.18.78.H01.1.454.CMB.1.raw
  modified_base (382)..(382): a, c, t, g, unknown or other
  misc_feature (382)..(382): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggtttccttgttgctattttaaaggtgtccagtgtgaggtgcagctggtggagtccgggggaggcgttggtccagccgtggggggtccctggaacctctcctgtgcagcctctgggttcaccttcagtggctctgctatgcactgggtccgccaggcttccgggaaggcctggagtggggttcggccgtagttagaagcaaagctaacagttacgcgacagcatangacgtgcgtcggtagaaggcaggttcaccgtcgtaccagaatagtatacaaagaacgacggacgtatctagacaatagaacacgactacgaaaccgaggacagtcgcgtagtacttactagtactaggacgtagtaggtattacgtaggttagggtagttagtacggacggtaacgggggtactaacgg

SEQ ID NO: 92907 - DNA, 528 bp, Homo sapiens
  misc_feature: GYAE6OF02G38AG.18.78.H01.1.454.CMB.1.raw
  modified_base (304)..(304): a, c, t, g, unknown or other
  misc_feature (304)..(304): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtgttataactatgtctcctggtaccaacagcacccaggcaaagcccccaaatcatgatttangatgtcagtaatcggccctgaggggtttctaatcgcttctctggctcaagtctggcaacacggcctccctgaccatctcgtgggcctccgaggctagacggacgaggctgtattattacgtgcagctcatatacaagcagcagcactcaagtctacggaactcgggaaccaaggtccaccgtcgtaggtccacgcccaacggcccaacccgatcgtacctaccg

SEQ ID NO: 92908 - DNA, 513 bp, Homo sapiens
  misc_feature: GYAE6OF02HFQS9.18.78.H01.1.454.CMB.1.raw
  modified_base (342)..(342): a, c, t, g, unknown or other
  misc_feature (342)..(342): n is a, c, g, or t
  modified_base (357)..(357): a, c, t, g, unknown or other
  misc_feature (357)..(357): n is a, c, g, or t
  modified_base (442)..(442): a, c, t, g, unknown or other
  misc_feature (442)..(442): n is a, c, g, or t
  modified_base (499)..(499): a, c, t, g, unknown or other
  misc_feature (499)..(499): n is a, c, g, or t
  modified_base (505)..(513): a, c, t, g, unknown or other
  misc_feature (505)..(513): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctggaggacgaggctagatttattacngcagctcatactaanaagcaaccagcactctctatcgtcttacggaacgtcgggaccaacggtcaccgtccgtaggtcacgacccgaacgcccaaccccntctcactctcgttccccgccctcctccatacctcgtactgacgcggctggcaaggcncgatgnnnnnnnnn

SEQ ID NO: 92909 - DNA, 596 bp, Homo sapiens
  misc_feature: GYAE6OF02H0XV5.18.78.H01.1.454.CMB.1.raw
  modified_base (192)..(192): a, c, t, g, unknown or other
  misc_feature (192)..(192): n is a, c, g, or t
  modified_base (230)..(230): a, c, t, g, unknown or other
  misc_feature (230)..(230): n is a, c, g, or t
  modified_base (284)..(284): a, c, t, g, unknown or other
  misc_feature (284)..(284): n is a, c, g, or t
  modified_base (410)..(410): a, c, t, g, unknown or other
  misc_feature (410)..(410): n is a, c, g, or t
  modified_base (515)..(515): a, c, t, g, unknown or other
  misc_feature (515)..(515): n is a, c, g, or t
  modified_base (576)..(576): a, c, t, g, unknown or other
  misc_feature (576)..(576): n is a, c, g, or t
  modified_base (588)..(588): a, c, t, g, unknown or other
  misc_feature (588)..(588): n is a, c, g, or t
  modified_base (591)..(591): a, c, t, g, unknown or other
  misc_feature (591)..(591): n is a, c, g, or t
  modified_base (593)..(596): a, c, t, g, unknown or other
  misc_feature (593)..(596): n is a, c, g, or t
tcagtacgagtatgcacgaccggtgctcgatttagtgtgagtagtttgggtttgggggtcgtttgcctgggcccagtctgccctgactcagcctgcctccgtgtctgggtctcctggacagtcgatcaccatctcctgcactggaaccagcagtgacgttgggtggttataactatgtctcctggtaccaanagcacccaggccaaacgcccccaaaactcatgatttangatgtcagtaatccggcctgagggtttcaatcgcttctctggctaccaagttcnggcaacgaccggcctcctacgaccatcctcgtcgggcctccgacggctggaacgggacgtacgcgtacgatttattacctggaccagtcctactataacgtacaaacgctacccagccacttcctntactcgtttcgtacggtaacgtgggtaaccacggttaccacgtaccggtagtacgacgacccaaccgggacccaacccacgtcgaccacgttcctcccgttcccnccccgtaccttccaacgttacctcgtaccagtaccggcggtccgtcggacgaacggtaccnaacgtacgcgtncgnannnn

SEQ ID NO: 92910 - DNA, 610 bp, Homo sapiens
  misc_feature: GYAE6OF02I1YZ7.18.78.H01.1.454.CMB.1.raw
  modified_base (225)..(225): a, c, t, g, unknown or other
  misc_feature (225)..(225): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (593)..(593): a, c, t, g, unknown or other
  misc_feature (593)..(593): n is a, c, g, or t
  modified_base (596)..(596): a, c, t, g, unknown or other
  misc_feature (596)..(596): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
  modified_base (608)..(609): a, c, t, g, unknown or other
  misc_feature (608)..(609): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttangatgtcactaatccggccctcgaggggtttctaatcgtcttctctggcctccaagtctggacaccacggcctccctgacctatctcgtgggctccgaggctggacggacgaggctgtattagttactgcngctanaatactaacaacgccaaccgagcctactcctattacgtcgttcgttaccggaacgtacgggaacctaacgggtccgtacccgttacgtacggtacaccgacccgaacggaccctaaccctaccgttttccaccttcctccgttccccgcccttaccctcctactaccttccgtaccgttcggacggtcccgggtcgtcgggaccgtaacgggccgtaccgtaacgttacggcncgngacncncngncnnc

SEQ ID NO: 92911 - DNA, 497 bp, Homo sapiens
  misc_feature: GYAE6OF02G099V.18.78.H01.1.454.CMB.1.raw
  modified_base (488)..(497): a, c, t, g, unknown or other
  misc_feature (488)..(497): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggacaaggtcaccgtctaggtcagcccaaggcccaacccactgtcactctcgttccccgccctcctccacttacctcgttactgacgcgggctggcaggcgcatagnnnnnnnnnn

SEQ ID NO: 92912 - DNA, 561 bp, Homo sapiens
  misc_feature: GYAE6OF02HM6X6.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctggggggtccctgaaactctcctgtgcagcctctggggttcaccttcagtggctctgctatgcactgggtccgccaggcgttccgggaaagggctggagtgggttggccgtattagaagcaaagctaaacagttacgcgacagcatatgctgcgtcggtgaaaggcaggtcaccgtctccagaaatgattcaaagaacacggacgtatctagcaaatagaacagacctagaaaccgagacacggcgtagtaatactagtactagacgaggtggattacgagtttggggtagttagtacggacggtaacggggggtactacgtaacgg

SEQ ID NO: 92913 - DNA, 580 bp, Homo sapiens
  misc_feature: GYAE6OF02HD5JN.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtcccgccgaggccttccggggaaagggcctgggaggtgggttggccgtattaggaagcaagctaacagttacgcgacagcatatgctgcgtcggtagaaaggcaggttcaccgtctccagaatgattacaaagaacacggacgtatctacgactaaatcgaacacgaccgtacgaaaaccgaggaccacggccgtagtacttactgtactagacgtaggtacgtatacgtagttggggtattacggtcggtacgggtaacgggggttactacgtacgg

SEQ ID NO: 92914 - DNA, 542 bp, Homo sapiens
  misc_feature: GYAE6OF02J1QM9.18.78.H01.1.454.CMB.1.raw
  modified_base (192)..(192): a, c, t, g, unknown or other
  misc_feature (192)..(192): n is a, c, g, or t
  modified_base (228)..(228): a, c, t, g, unknown or other
  misc_feature (228)..(228): n is a, c, g, or t
  modified_base (457)..(457): a, c, t, g, unknown or other
  misc_feature (457)..(457): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
  modified_base (536)..(542): a, c, t, g, unknown or other
  misc_feature (536)..(542): n is a, c, g, or t
tcagtacgagtatgcacgaccggtgctcgatttagtgtgagtagtttgggtttgggggtcgtttgtcctgggcccagtctgccctgactcaacctgcctccgtgtctgggtctcctggacagtcgatcaccatctcctgcactggaaccagcagtgacgttggtggttataactatgtctcctggtaccaanagcacccaggcaaacgcccccaaactcatgatttangatgtcagtaatccggccctcgaggggttttctaatcgtcttctctggtctccaagtctggacaacgacggccctccctgacctatcctcgtgggcctcccgaggtcctgggaacggacgaggctaggatttattacctgcagctacatatacaagcaagcagcactcaagtccttacggaactgggaccaaggtccaccgtctacggcacgcccaacgcccaacccgntcgccactctccgttcccacctccctctactctcctactcgacgccggctggaccaaggtccgacacgtagcgancncnnnnnnn

SEQ ID NO: 92915 - DNA, 561 bp, Homo sapiens
  misc_feature: GYAE6OF02JL6G1.18.78.H01.1.454.CMB.1.raw
  modified_base (249)..(249): a, c, t, g, unknown or other
  misc_feature (249)..(249): n is a, c, g, or t
  modified_base (319)..(319): a, c, t, g, unknown or other
  misc_feature (319)..(319): n is a, c, g, or t
  modified_base (492)..(492): a, c, t, g, unknown or other
  misc_feature (492)..(492): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttanaacgtatgtctcctggtaccaacagcaccaggcaaacgccccaaactcatgaatttatgatgtcagtaancggcctcgtaggggtttctaatcgcttctctggctcaagtctggcaacacggcctccctgacctatctcgtggtcctcgaggcctaggacggacgaggctggtaatttacgtacttcgcgacgtactcaagtaactaacaaggccaagcaagcacttcaagttctacggtaancgggaccaaggtccaccgtacgtacggtcaacgtacccgaacggacccaacccgtactcgacctaaccg

SEQ ID NO: 92916 - DNA, 943 bp, Homo sapiens
  misc_feature: GYAE6OF02FT03W.18.78.H01.1.454.CMB.1.raw
tcagtacgagtatgcacgaccggtgctcgatttagtgtgagtagtttgggtttgggggggtctcaggtagggcagcgctcgtcgggaccgttctcccaccgattcggaccgtcgggctcctgtcgtattccttcaccctcctcactcacgggccacgagggttccctcgggcccaggtacctgggtcgtccgtgtacggttcctaggtcccggtccccttttacgaaggttgttccgtgggggtcccccgtaaggggcgtaggacgggtccacccgtagttccgtccgttgccggacgtcgggacggccaacccgtcccaacgagtccggggtccggttataggacttcgtacctacgttgggtaacccagtccgtaggccttttcccgaacggggttaccaaccggtaccccccctaaaacgttcccgtacaacttccgttttagggaaccgtccggtaaaacccgaacgttcccggggtccccttaccggtaacggggggttaccccgttacggtaacccgggtagttttccggttccttacgggtccttaccgtaaggtttcggtacggtaccgttaccgtttcgtaacgtcccctttacccgtacggttaccctacggttaccgtaaccgggttccgggggtcccggttacccgaaggttcccgtacggacggtacgtcgggaacggtccgttaacgaaccgttaacgttaaccgtacgccgtaagttcctttacgaacgttaacgtaaacgtaacgacctacggtacctacgaccgtaacgtaccgtaaaggttacccgttacggtaccgttacggggtaacccgttaaagggttacccgtaaccgggttacccggtaacgggttacgaacccgggtacccggaaacccgggtaccccctaaaccccgggttaccccggttacccgggtttaaccccg

SEQ ID NO: 92917 - DNA, 536 bp, Homo sapiens
  misc_feature: GYAE6OF02HPXIU.18.78.H01.1.454.CMB.1.raw
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (531)..(531): a, c, t, g, unknown or other
  misc_feature (531)..(531): n is a, c, g, or t
  modified_base (533)..(536): a, c, t, g, unknown or other
  misc_feature (533)..(536): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctcctgaccatctcgtgggctccaggctggaggacgaggctgatttattactgcagctcatactacaagcagcagcactcaagtcttacggaactcgggaccaaggtcaccgtctaggtcacgcccaacggacccaaccccactcgtccacttccttccgttcccacccttcctcctactacctcgtacctggacggccgggtcgtcgggacgaacgggccgacgaagtacggcngncncgncnnnn

SEQ ID NO: 92918 - DNA, 572 bp, Homo sapiens
  misc_feature: GYAE6OF02GT4IS.18.78.H01.1.454.CMB.1.raw
  modified_base (309)..(309): a, c, t, g, unknown or other
  misc_feature (309)..(309): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggacaaacgcccccaaactcatgtatttangatgtacagtaatccggccctcgaggggtttctaatcgtcttctcgtcggctccaagtctaggacaacgaccggccctccctgaccacttccgtcgtcgggcctaccgagggtctaggacggacgaggtctagtatttagttactgactagctactataactaacagacagcagcactactacgtacgtacggaacgtacggacgtacgtcgaccgtcgtaggtaccacgacccgacggaccccaacccgtactcctactacc

SEQ ID NO: 92919 - DNA, 569 bp, Homo sapiens
  misc_feature: GYAE6OF02GCHAO.18.78.H01.1.454.CMB.1.raw
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagccgtggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaggcaggtcaccgtctaccagaaatgaattacaaagaacacggacgtaacgtctagacaaatagaacagacctagaaaccgaggaacgacggaccgtgtattactagtactagacgaggtaggattacgtagtttggggtagttagtacggacggtaacggggggtacgtaacgg

SEQ ID NO: 92920 - DNA, 519 bp, Homo sapiens
  misc_feature: GYAE6OF02IK9TT.18.78.H01.1.454.CMB.1.raw
  modified_base (254)..(254): a, c, t, g, unknown or other
  misc_feature (254)..(254): n is a, c, g, or t
  modified_base (411)..(411): a, c, t, g, unknown or other
  misc_feature (411)..(411): n is a, c, g, or t
  modified_base (420)..(420): a, c, t, g, unknown or other
  misc_feature (420)..(420): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacaggggtcctgggcccagtctgccctgactcaacctgcctccgtgtctgggtctcctggacagtcgatcaccatctcctgcactggaaccagcagtgacgttggtgttataactntgtctcctggtaccaacagcacccaggcaaagcccccaaactcatgatttatgatgtcactaatcggccctgagggtttctaatcgcttctctggctcaagtctggcaacacggcctcctgaccatctcgtgggctccagctgagcgaggctgattntactgcagntcatatacagcaccagcactctctatcgtcttcggactcgggaacctaaggtccaccggttccgtagtccacgacccaaggcccaaccctactgtaccc

SEQ ID NO: 92921 - DNA, 493 bp, Homo sapiens
  misc_feature: GYAE6OF02GSOF3.18.78.H01.1.454.CMB.1.raw
  modified_base (483)..(493): a, c, t, g, unknown or other
  misc_feature (483)..(493): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggttttctaatcgcttctctggctccaagtctggcaacacggcctccctgaccatctctgggctccaggctgaggacaggctgattatactgcagctcatatacaagcagcagcactcaagtctcggactgggaccaggtcacgtccaggtcagcccaaggcccaacccactgtcactctcgttcccaccctcctccactactcgtactgacgcgggctcggcaggcgcacgtagnnnnnnnnnnn

SEQ ID NO: 92922 - DNA, 568 bp, Homo sapiens
  misc_feature: GYAE6OF02FWE10.18.78.H01.1.454.CMB.1.raw
  modified_base (452)..(452): a, c, t, g, unknown or other
  misc_feature (452)..(452): n is a, c, g, or t
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagccgtggggggtccctgaaactctcctgtgcagcctctgggttcacttcagtggctctgctatgcactgggtccgccaggcttccgggaaagggctgggagtgggttggccgtattagagcaaagctaacagttacgcgacagcatatgctgcgtcggtagaaggcgagttcgacgtctccagaaatgattacaaagaacgacggacgtatctagacaancgaacacgactacgaaaccgacgacgacgcgtagtatacgtgtacgtagacgtaggtaggtattacgtagtttaggggtagttacgtacggtacggtaacggggggtacgtaacgg

SEQ ID NO: 92923 - DNA, 577 bp, Homo sapiens
  misc_feature: GYAE6OF02GCEA8.18.78.H01.1.454.CMB.1.raw
  modified_base (468)..(468): a, c, t, g, unknown or other
  misc_feature (468)..(468): n is a, c, g, or t
tcagtacgagtatgcacgaccggtgctcgatttagtgtgagtagtttgggtttggggagctctgggagaggagctccagccttgggattcccagctgtctccactcggtgatcggcactgaatacaggagactcaccatggagttttgggctgagctgggttttccttgttgctattttaaaaggtgtccagtgtgaggtgcagctggtggaggtccgggggaggcttggtccagccgtggggggtccctgaaactctcctgtgcagcctctggttccaccttcagtggctctgctatgcactgggtccgccgaggcgttccgggaaagggcgtggaggtgggttggccgtagttaggaagacaaagctaacgagttacgacgacagcatatgctggcgtcggtagaagcgaggtcaccgtctccagaaatgattacaaagaacgacggacgttatctagacaagtanaacgacgacctacgaaacgaacgacgacggcgtagtattactgtactagacaggtaggattagtagttaggggtagttagtcggtacgggtaacgggggtactaaccgg

SEQ ID NO: 92924 - DNA, 797 bp, Homo sapiens
  misc_feature: GYAE6OF02GQROT.18.78.H01.1.454.CMB.1.raw
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtgttataactatgtctcatcggtaaccaacagccacccaggacaaacgccccccaaatcatgtatttatgatgtacaagtaacgtccggtacccttacggtaggggttttacctaaacgttccgtcctttccgtccgttcggaccttaccgtaaacgttccgtacgggaccaaaccgtaacccgggtccccttacccgtacggaccctacttccgttccgtcggggtccctaccggacgggtcgttacgggaacgggaaccggtacgggtacgttaggtaacttttaacgttaccgtacgtaccgtacggtaccttacctaagttaaaccttaacgaaacggtaccgaaacggacctaacggtacctaaccgttaaaccgtaacggtttacccgttaccggggtaaaccgggttaccggggaaaccgttaaaccggggttacccttaaaccccgggttaccgtttaaaccggggaccgtaaacccgggtaacccccggtaaaacccggggtaacccccctaaacccccggttaccgttacccggttaacccccgg

SEQ ID NO: 92925 - DNA, 604 bp, Homo sapiens
  misc_feature: GYAE6OF02HX6Y5.18.78.H01.1.454.CMB.1.raw
  modified_base (225)..(225): a, c, t, g, unknown or other
  misc_feature (225)..(225): n is a, c, g, or t
  modified_base (592)..(592): a, c, t, g, unknown or other
  misc_feature (592)..(592): n is a, c, g, or t
  modified_base (595)..(595): a, c, t, g, unknown or other
  misc_feature (595)..(595): n is a, c, g, or t
  modified_base (597)..(599): a, c, t, g, unknown or other
  misc_feature (597)..(599): n is a, c, g, or t
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgattttangatgtcactaatcggccctcgagggtttctaatcgcttctctggctcagtctggcaacacgcctcctgaccatctctgggctcaggctgacggacgaggctagtattacttacgtgcagccttacaattaactaacaaacgccaacccgagcctaacttctacttaatcggttacctttaccgggaaacttcgggggaaccctaaagggtcccacccgttaccgttacggtccgtaccgacccgaacggaccccaaaccccgactccggtacctacctccgttccggttcccccgacccttcccctaccactaccgttcgtaacgtggaccgtcgggctcgggaccgtaacggccgtacagtacggncgncnnnctnan

SEQ ID NO: 92926 - DNA, 485 bp, Homo sapiens
  misc_feature: GYAE6OF02GSBRR.18.78.H01.1.454.CMB.1.raw
  modified_base (400)..(400): a, c, t, g, unknown or other
  misc_feature (400)..(400): n is a, c, g, or t
  modified_base (403)..(403): a, c, t, g, unknown or other
  misc_feature (403)..(403): n is a, c, g, or t
  modified_base (419)..(419): a, c, t, g, unknown or other
  misc_feature (419)..(419): n is a, c, g, or t
  modified_base (438)..(438): a, c, t, g, unknown or other
  misc_feature (438)..(438): n is a, c, g, or t
  modified_base (460)..(460): a, c, t, g, unknown or other
  misc_feature (460)..(460): n is a, c, g, or t
  modified_base (465)..(466): a, c, t, g, unknown or other
  misc_feature (465)..(466): n is a, c, g, or t
  modified_base (468)..(485): a, c, t, g, unknown or other
  misc_feature (468)..(485): n is a, c, g, or t
tcagtacgagtatgcacgaccggtgctcgatttagtgtgagtagtttgggtttgggggctttgcctgggtgctgttggtaccaggagacatagttataaccaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgacccatctctgggctccaggctgaggacgaggctgattattactgcagctcatatacaagcagcagcactcaagtcttcggaactgggaccaaggtcaccgtcctaggtcagcccaaggcccaacccnctntcactctcgttccccnccctcctccatctcgtacngacgcggctcgggacacggtcncatgnncnnnnnnnnnnnnnnnnnn

SEQ ID NO: 92927 - DNA, 175 bp, Homo sapiens
  misc_feature: GYAE6OF02GYR52.18.78.H01.1.454.CMB.1.raw
  modified_base (174)..(175): a, c, t, g, unknown or other
  misc_feature (174)..(175): n is a, c, g, or t
tcagtacgagtatgcacgaccggtgctcgatttagtgtgagtagtttgggtttgggggaagaggaagactgacggtccccccaggagttcaggtgctgggcacagcggccctgggctgcctggtcaaggactacttcccatactcgtactgagcgggctggcaaggcgcatagnn

SEQ ID NO: 92928 - DNA, 556 bp, Homo sapiens
  misc_feature: GYAE6OF02IR7GG.18.78.H01.1.454.CMB.1.raw
  modified_base (362)..(362): a, c, t, g, unknown or other
  misc_feature (362)..(362): n is a, c, g, or t
  modified_base (540)..(540): a, c, t, g, unknown or other
  misc_feature (540)..(540): n is a, c, g, or t
  modified_base (544)..(544): a, c, t, g, unknown or other
  misc_feature (544)..(544): n is a, c, g, or t
  modified_base (547)..(548): a, c, t, g, unknown or other
  misc_feature (547)..(548): n is a, c, g, or t
  modified_base (553)..(553): a, c, t, g, unknown or other
  misc_feature (553)..(553): n is a, c, g, or t
  modified_base (555)..(556): a, c, t, g, unknown or other
  misc_feature (555)..(556): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatccggccctcaggggtttctaatcgcttctctggctccaagtctggcaacacggcctccctgaccatctctgggctccaggctgaggacgaggctgattattactgcagctcatatacaagcaccancactctctatgtcttacggactggaccaaggtcaccgttctaggtcacgacccgaacggacccaaccccacttacgtcctacctccgttacgttccccgtccccttaccctccctacttaccttccgttaacgtcggacgccgggtactcgggtacaacgggcgacgaacgtaggacncgancgnntacgntnn

SEQ ID NO: 92929 - DNA, 569 bp, Homo sapiens
  misc_feature: GYAE6OF02H3P8N.18.78.H01.1.454.CMB.1.raw
  modified_base (258)..(258): a, c, t, g, unknown or other
  misc_feature (258)..(258): n is a, c, g, or t
  modified_base (385)..(385): a, c, t, g, unknown or other
  misc_feature (385)..(385): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatcctcctgccactcggaaccagcagtgacgttggtggttaataactntgtctctggtaccaacacgcaccaggaccaaacgcccccaaactcatgatttatgatgtcagtaactccggccctgtaggggttctaatcgtcttctctggcctcaagtctgacacgacggcctccncgactgctcgtcgggtcctcgacggtcgtaggacggacgggagtctagaacttttattacgtgacacgtcctactaataacacgtaagacagcagcctactcaagtccttacgaacgtggacctacgggtccaaccgtcgacgtaccacgacccgaacgaccccaacccgactcggacctaccg

SEQ ID NO: 92930 - DNA, 720 bp, Homo sapiens
  misc_feature: GYAE6OF02F930H.18.78.H01.1.454.CMB.1.raw
  modified_base (298)..(298): a, c, t, g, unknown or other
  misc_feature (298)..(298): n is a, c, g, or t
  modified_base (388)..(388): a, c, t, g, unknown or other
  misc_feature (388)..(388): n is a, c, g, or t
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagcggcgttcgtgtaggcgtacttaaagtgtcagtgtgagtgcagctggtggagtccggggagcttggtccagcctgggggtccctgaaactctcctgtgcagcctctggttcaccttcagtggctctgctatgcacgtgggtccnccgaggtccttccggggaaacgggtccgtagggacggttggggtttcgggcccgttaagtttacggaagtaccgaaaaggtctaaaaccnggtttaaaccgccggtaaccaggacctaataacgttggccttgggccggttccgggtaagggtaaacgggcggtacgggtttaccaaacccgggttcctcccgtaaaggtaaaccttaggtaactttaacgaaaacgaaccgtaacgggtacccgtttaggtaacttcggaacctaaagttacgaaacacgtacctaaacggaaaaccgagggaaccacggtaccgttacgttacgttacgtacgtacgtacgtaacggtacggtacggtaacttacgtaggtttggggtacgttagtccggttaacgggtaacgggggttaccttaaccgg

SEQ ID NO: 92931 - DNA, 517 bp, Homo sapiens
  misc_feature: GYAE6OF02FNVVW.18.78.H01.1.454.CMB.1.raw
  modified_base (339)..(339): a, c, t, g, unknown or other
  misc_feature (339)..(339): n is a, c, g, or t
  modified_base (424)..(424): a, c, t, g, unknown or other
  misc_feature (424)..(424): n is a, c, g, or t
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (515)..(516): a, c, t, g, unknown or other
  misc_feature (515)..(516): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattacngcagctcatatacaagcagcagcactcaatctacggaactggaccaaggtcaccgtcctaggtcacgacccaaggcccaaacccnctcgaccactcttcgtcccgcctcctcactacctcgtactgacgcgggtctcgggcaaggccgacagttacggntcntcgacncgancncnnc

SEQ ID NO: 92932 - DNA, 538 bp, Homo sapiens
  misc_feature: GYAE6OF02H4RSX.18.78.H01.1.454.CMB.1.raw
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
  modified_base (464)..(464): a, c, t, g, unknown or other
  misc_feature (464)..(464): n is a, c, g, or t
  modified_base (532)..(538): a, c, t, g, unknown or other
  misc_feature (532)..(538): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggccctcgtaggggtttctaatcgcttctctgctccagtctggcaacncgcctcctgaccatctcnggctccaggctgacggacgagctagtattattactgcagctcatatacagcagcagcactcaacgtcgttacggacgtacgggaccaaggttccaccgttctaggtccacgccccgaaggccccaaccccgattcgtacctacttccgtcgttacccccnccctcctacctactaccgtccttacgtcgacggccgggtctcgggacaacggtcgacacgtgctcgcnnnnnnn

SEQ ID NO: 92933 - DNA, 587 bp, Homo sapiens
  misc_feature: GYAE6OF02GH8CO.18.78.H01.1.454.CMB.1.raw
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggccctcgtaggggtttctaatccgtcttctctggctccaagtctggacaacgacggtcctccctgacctatcctcgtcgggcctccgagcgtggacggacggaggcttagaatttacttacgtgcagtcctacataatacgaagtcagcagccactacctaagttccttacggaaccgtacgggaacctaacggtccaacccgttccgtaacggtaccaccggacccgaacgggaccccaacccccgacgttaccgtacctacccg

SEQ ID NO: 92934 - DNA, 580 bp, Homo sapiens
  misc_feature: GYAE6OF02G0OY3.18.78.H01.1.454.CMB.1.raw
  modified_base (229)..(229): a, c, t, g, unknown or other
  misc_feature (229)..(229): n is a, c, g, or t
  modified_base (249)..(249): a, c, t, g, unknown or other
  misc_feature (249)..(249): n is a, c, g, or t
  modified_base (302)..(302): a, c, t, g, unknown or other
  misc_feature (302)..(302): n is a, c, g, or t
  modified_base (450)..(450): a, c, t, g, unknown or other
  misc_feature (450)..(450): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttaanactatgtctctggtacaacagcaccaggcaaacgcccccaaatcatgtattangatgtacactaactccggtccctacgtagggtttactaagtcgtcttctcgtggactacgaagtcgtagacaaccgcgtccctcctacgacctactcgtcgtcggtcctaccgaggctaggacggacgagtctagtatttacttacgngacagtctacgaatactaaccgaacgacctaaccacgtcctactcttactagttcgtaccgttacgaacggtcggaaccgtaagtccgtaccgtcgtagtccacgtacccgaacgacccaccctataccg

SEQ ID NO: 92935 - DNA, 575 bp, Homo sapiens
  misc_feature: GYAE6OF02IYE13.18.78.H01.1.454.CMB.1.raw
  modified_base (454)..(454): a, c, t, g, unknown or other
  misc_feature (454)..(454): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggaggtccgggggaggcgttggtccagccgtggggggtccctgaaactctcctgtgcagcctctgggttcaccttcagtggctctgctatgcactgggtccgccaggcttccgggaaagggctggagtgggtggccgtattagagacaaagctaacagttacgcgacagcatatgctgcgtcggtagaaggcgaggttcaccgtctaccagaatgtatacaaagaacgacggacgtatcagacaaangaacacgacctaacgaaaccgaggaccacgggtcgtagtattactgtactagacgtaggtaggtattacgtagtttaggggtagttagtcggacgggtaacggggggtactacgtaaccgg

SEQ ID NO: 92936 - DNA, 544 bp, Homo sapiens
  misc_feature: GYAE6OF02H7Y59.18.78.H01.1.454.CMB.1.raw
  modified_base (225)..(225): a, c, t, g, unknown or other
  misc_feature (225)..(225): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
  modified_base (445)..(445): a, c, t, g, unknown or other
  misc_feature (445)..(445): n is a, c, g, or t
  modified_base (537)..(540): a, c, t, g, unknown or other
  misc_feature (537)..(540): n is a, c, g, or t
  modified_base (542)..(544): a, c, t, g, unknown or other
  misc_feature (542)..(544): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaaactcatgatttangatgtcagtaatcggccctcgtaggggttttctaatcgtctttctcgtggtctccaagtctggacaacgtacggcctccctgaccatctcgtggcctcaggctgaggacgaggctagattatacgtgcagctanatatanaagcaagcaagcactacagttcgttacgaacgtggaaccaaggtccaccgtcgtagtcacgcccgaaggacccaaccctntcgtacctactcgtaccgttcccgtcccctcctccacttaccgtcgtactcggagccgggtactgggacaacggcgtacataggctgactcnnnncnnn

SEQ ID NO: 92937 - DNA, 680 bp, Homo sapiens
  misc_feature: GYAE6OF02IZNLS.18.78.H01.1.454.CMB.1.raw
  modified_base (191)..(191): a, c, t, g, unknown or other
  misc_feature (191)..(191): n is a, c, g, or t
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagcggtcgttcgtcgtaaggcgtacttaaagtgtcagtgngagtgcngctggtgagtcgggaggcgtgtcgngcgtgggtccgtgaactctcctgtgcgcgctcgtggttcgtactcctagttggccgtccgttctacgttagtcgtcgtacgtcggtcccgtaccgacggtccggtaccgggaacggtcggtcggtaggtcggtcggtcgtacgtagtaagacgaacgacgtaacgtacgtacgacgacgacgtacactagtagtcgtcgtcggtcggtagaacggtacgtacgtccgtaccgtacgtacgaacgtaagtagtaactaacgtaacgaacgtacgtacgtacgtacgtacgaacgtaactaacgtaacgtaacgtacgaacgaaacgtaacgtacgtacgtacggtacgttacgttacgttacgtacgtacgtacgtacgtaacggtacgttaacgttacgttaggtttagggttacggttacggtaacgggtaacggggtacgggttaacggtaacgg

SEQ ID NO: 92938 - DNA, 718 bp, Homo sapiens
  misc_feature: GYAE6OF02JD87Z.18.78.H01.1.454.CMB.1.raw
  modified_base (287)..(287): a, c, t, g, unknown or other
  misc_feature (287)..(287): n is a, c, g, or t
  modified_base (707)..(707): a, c, t, g, unknown or other
  misc_feature (707)..(707): n is a, c, g, or t
  modified_base (710)..(710): a, c, t, g, unknown or other
  misc_feature (710)..(710): n is a, c, g, or t
  modified_base (713)..(713): a, c, t, g, unknown or other
  misc_feature (713)..(713): n is a, c, g, or t
  modified_base (716)..(718): a, c, t, g, unknown or other
  misc_feature (716)..(718): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatccggccctcgaggggtttctaatcgcttctctggctcaagtctggcaacncggcctcctgacccatctcgtcgggcctccgaggctggacggtaccgagggctagtatttacgttactgcacgtctacgtaattacgaacctaagccgaagcaacggacctacgttaccgtaaacggtttccgtttaccggggaaacgttacggggtaaacccggtaaagggttaccccgaaccccggttaccggttaacgggttacccgaaccgggacccccgtaaaccgggtacccccaaaccccccgtacttaccggttacccaaccgtttcccgtttcccggtttaccccccgtccccttacccgttacccgtaccgtttaaccgttacccggttaacccgttcgggaaccggtccggggtacgtaccggggtacccgaaagggtcccggaacgtaacccggtagcgtcgtacgcncgntcncgnnn

SEQ ID NO: 92939 - DNA, 568 bp, Homo sapiens
  misc_feature: GYAE6OF02GLKMK.18.78.H01.1.454.CMB.1.raw
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaaacagttacgcgacagcatatgctgcgtcggtgaaaggcaggtcaccgtctccagaaatgattacaaagaacacggcgtatctagacaaatagaacagaccgtagaaaaccgacggacgacggccgtagtattactagtactagacgaggtaggtattacgtagtttaggggtagttagtacggacggtaacggggggtactaaccgg

SEQ ID NO: 92940 - DNA, 552 bp, Homo sapiens
  misc_feature: GYAE6OF02G2DYL.18.78.H01.1.454.CMB.1.raw
  modified_base (225)..(225): a, c, t, g, unknown or other
  misc_feature (225)..(225): n is a, c, g, or t
  modified_base (540)..(540): a, c, t, g, unknown or other
  misc_feature (540)..(540): n is a, c, g, or t
  modified_base (544)..(544): a, c, t, g, unknown or other
  misc_feature (544)..(544): n is a, c, g, or t
  modified_base (548)..(552): a, c, t, g, unknown or other
  misc_feature (548)..(552): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagaagtgacgttggtggttataactatgtctcctggtaccaacagcacccaggcaaagcccccaaactcatgattttangatgtcactaatcggccctcaggggtttctaatcgcttctctggctccaagtctggcaacacggcctccctgaccatctctgggctccgaggctggaggacgaggctgattattactgcagctcatatacaagcagcagcactctctatcgttctcggaactgggaaccaaggtccaccgtctaggtcagcctacgaaccgacccaaccctctcgtaccctaccttcgttcccgttacccccgcccttccctacctacttacctccgtacgtcgggaccgtcggtaccgtcggaccggtaacggccgacagtagnactnacgnnnnn

SEQ ID NO: 92941 - DNA, 558 bp, Homo sapiens
  misc_feature: GYAE6OF02FST56.18.78.H01.1.454.CMB.1.raw
  modified_base (307)..(307): a, c, t, g, unknown or other
  misc_feature (307)..(307): n is a, c, g, or t
  modified_base (362)..(362): a, c, t, g, unknown or other
  misc_feature (362)..(362): n is a, c, g, or t
  modified_base (443)..(443): a, c, t, g, unknown or other
  misc_feature (443)..(443): n is a, c, g, or t
tcagtacgagtatgcacgaccggtgctcgatttagtgtgagtagtttgggtttgggggggggtctcagtaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttangatgtcagtaatcggccctgtaggggttttctaatcgtcttctctggctcagtcngcaacgacgcctcctgaccatcctcgtgggcctcgaggtctaggacggacggaggctagtattattacgtgactagccttnaagttactaacaagcagcaacgctaactctaacgttcttacgggaactcgggaaccaggtccaccggttcctaggtccacggacccgaacggaccccaacccgctcgtcctaccg

SEQ ID NO: 92942 - DNA, 541 bp, Homo sapiens
  misc_feature: GYAE6OF02JXBWG.18.78.H01.1.454.CMB.1.raw
  modified_base (224)..(224): a, c, t, g, unknown or other
  misc_feature (224)..(224): n is a, c, g, or t
  modified_base (304)..(304): a, c, t, g, unknown or other
  misc_feature (304)..(304): n is a, c, g, or t
  modified_base (321)..(321): a, c, t, g, unknown or other
  misc_feature (321)..(321): n is a, c, g, or t
  modified_base (535)..(536): a, c, t, g, unknown or other
  misc_feature (535)..(536): n is a, c, g, or t
  modified_base (538)..(538): a, c, t, g, unknown or other
  misc_feature (538)..(538): n is a, c, g, or t
  modified_base (540)..(541): a, c, t, g, unknown or other
  misc_feature (540)..(541): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcaaccaggcaaacgcccccaaatcatgatttangatgtcactaatcggcctcgaggggttttctaatcgcttctctggctccaagtctggcaacacggcctcctgacccatcnctggctcaggctgaggntggagctgattattactgcagctcatatacaagcaccagcactctctatgtcgttcggaactcgggaacaaggtccaccgtctacggtcacgcccaacggcccaacccactcgtccaccttctccgttccccgcccttcctccctactaccgtccgttacgtcgacggtccgggactcgggaccgaacgggccacgtacgtacgactcgacgcnncncnn

SEQ ID NO: 92943 - DNA, 542 bp, Homo sapiens
  misc_feature: GYAE6OF02IFOH5.18.78.H01.1.454.CMB.1.raw
  modified_base (531)..(531): a, c, t, g, unknown or other
  misc_feature (531)..(531): n is a, c, g, or t
  modified_base (537)..(538): a, c, t, g, unknown or other
  misc_feature (537)..(538): n is a, c, g, or t
  modified_base (540)..(542): a, c, t, g, unknown or other
  misc_feature (540)..(542): n is a, c, g, or t
tcagtacgagtatgcacgaccggtgctcgatttagtgtgagtagtttgggtttgggggctttgcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctcaagtctggcaacacggcctccctgaccatctctgggctccaggctggagacgaggctgtacttattactgcgagctcattaacgtacaagcaccagactactctctatcgtcttcgaactgggacaacggtcaccgtctaggtaccacgcccaagtcccaaccctactcgtccactctcgttacccacccgtcctaccacgtaccttcgtaaccgtgacgccgggtactacgggactaacgggccgttacagttacgtancgtcanncnnn

SEQ ID NO: 92944 - DNA, 573 bp, Homo sapiens
  misc_feature: GYAE6OF02HJ9GN.18.78.H01.1.454.CMB.1.raw
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
  modified_base (308)..(308): a, c, t, g, unknown or other
  misc_feature (308)..(308): n is a, c, g, or t
  modified_base (350)..(350): a, c, t, g, unknown or other
  misc_feature (350)..(350): n is a, c, g, or t
  modified_base (446)..(446): a, c, t, g, unknown or other
  misc_feature (446)..(446): n is a, c, g, or t
tcagtacgagtatgcacgaccggtgctcgatttagtgtgagtagtttgggtttggggggggtcgtcgaggaggcagcgctctcgggacgtctccaccatggcctgggctctgctattcctcaccctcctcactcagggcacagggtcctgggcccagtctgccctgactcaacctgcctccgtgtctgggtcctcctggacagtcgatcaccatcnccgtgcactggaaccagcagtgacgtggtgttanactatgtctcctggtaccaacagcaccaggcaaacgccccccaaatcatagtatttangatgtcagtaactccgccctgagggtttctaatcgtctctcnggtctaccaagtctggcaaacgtcggccctccgtcgacctactctcgtggcctcgaggctggaggtacgagtctagagtttatacgtgacagctanatactaacaacggaccaccagtccacgttactctatcggttcctacggaacgtccgggaactaacggtcccgtacgttacccgtaggttcaccgacccgaacggacccctaaaccgtcctagtaccc

SEQ ID NO: 92945 - DNA, 177 bp, Homo sapiens
  misc_feature: GYAE6OF02HJH5P.18.78.H01.1.454.CMB.1.raw
  modified_base (173)..(177): a, c, t, g, unknown or other
  misc_feature (173)..(177): n is a, c, g, or t
tcagtacgagtatgcacgaccggtgctcgatttagtgtgagtagtttgggtttgggggaagaggaagactgacggtcccccaggagttcaggtgctgggcacagcggccctgggctgcctggtcaaggactacttcccatactcgtactgagcgggctggcaaggcgcatagnnnnn

SEQ ID NO: 92946 - DNA, 606 bp, Homo sapiens
  misc_feature: GYAE6OF02IE7K7.18.78.H01.1.454.CMB.1.raw
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagctgggttttccttgttgctattttaaaaggtgtccagtgtgaggtgcagctgggtggaggtccgggggaggcttggtccagccgtgggggtccctgaactctcctgtgcagcctctgggttcaccttcagtggctctgctatgcactgggtcccgccgaggcgttaccgggaaaggggtctgggaggttggggttggcccgttagttaacgaagtcgaaagtcctaaacaggtttaacgcgaacagacatatgactgcggtacggtagaagcgaggtcaccgtctaccagtaatgacttacgaaagaaccgacggacgtatcgtagacaaatgaacagacctagaaaccgtacgaccgacgcgtagttacttactagtactacgacgtaggtagtacgttacgtagttaggggtagttacgtacggtacgggtaaccgggggtagtaaccgg

SEQ ID NO: 92947 - DNA, 805 bp, Homo sapiens
  misc_feature: GYAE6OF02IT1E0.18.78.H01.1.454.CMB.1.raw
tcagtacgagtatgcacgaccggtgctcgatttagtgtgagtagtttgggtttggggcgtttgcctgggtcccagtctgccctgactcaacctgcctccgtgtctgggtcttcctggacagtcgatcaccactctccgtcgcactggaacctagcagtcgacgttgggtcggttataacgtatgtactcctggtaccacagctacccgaggccaaacgcccccgaaactcgaagtcgtactttactggactggtacacgttaactccgggacccttcggtacggggttttactaaattccgtctttacgtacgtggtcctaccgtaaggttccgttcggactaaccgaccggacccgttacccgtaggaccctaagtttcccgtcgttacggggtaccttaccgaacgggtccttagggaacgggtaaccggaagggtcccttaggtaatttaacttaccgttcgacgtacggtacccttaaccgtagttaaacgtaccgtaaagtccgaacgtactaacggcctaaccgttaccgtaaacggttcccgtttaaccggaaacgttaccgggaaccgtaaacgggttccgtaaccggttacgttaacggtaccaacggtacccgtaaacgggaccctaaacccgacgttacggtacctaccgttcgtacccgttcccgacccgttaccgtaccgtaattacccgtacggtaccttacggaacggtccggggtactacgggacctaacggtaccggtaacgtaaccgtacggtctaccgtacgtctacgtacgtgacgtcgtcacgg

SEQ ID NO: 92948 - DNA, 509 bp, Homo sapiens
  misc_feature: GYAE6OF02IMZ4B.18.78.H01.1.454.CMB.1.raw
  modified_base (287)..(287): a, c, t, g, unknown or other
  misc_feature (287)..(287): n is a, c, g, or t
  modified_base (424)..(424): a, c, t, g, unknown or other
  misc_feature (424)..(424): n is a, c, g, or t
  modified_base (499)..(509): a, c, t, g, unknown or other
  misc_feature (499)..(509): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagccccccaaactcatgatttatgatgtcagtaatcggccctcaggggttttctaatcgcttctctggctccaagtctggcaacncggcctccctgaccatctctgggcctccgaggctggaggacgaggctgatttatactgcagctcatatacaagcagcagcactcaagtctacggactgggaccaggtcaccgtctaggtcacgccacgcccaacccnctcgtccactctccgttcccaccctcctaccactacctcgtacctgacgccgggctcggcaaggccgacagtcgnnnnnnnnnnn

SEQ ID NO: 92949 - DNA, 675 bp, Homo sapiens
  misc_feature: GYAE6OF02FV5PA.18.78.H01.1.454.CMB.1.raw
  modified_base (396)..(396): a, c, t, g, unknown or other
  misc_feature (396)..(396): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggaggtccgggggaggcgttggtccagccgtggggggtccctgaaactctcctgtgcagcctctgggttcaccttcagtggctctgctatgcacgtgggtccgccgaggcgttccggggaaagggccgtgggaggtggggttggccgtaagttaggaagtcaaagctaacagttacgcgacagcagtangtcgtgcgtcggtagaaaggcgtaggtccaccgtctaccagaaatgacttacaaagaacgacggacgtatcgtgacaaagtacgaaacacgaccgtaacgaaaacccggaaggaaccgaaccgggtaccgttacggttaacgtttaaccgttagttaccgtaacggacggtaagggttacggtaacggtttaacgttaaggttttacgggggttaaggtttacgttaaccgggtaaccggggtaaaccggggggggttaccgttaacggttaacccggg

SEQ ID NO: 92950 - DNA, 489 bp, Homo sapiens
  misc_feature: GYAE6OF02FLQQY.18.78.H01.1.454.CMB.1.raw
  modified_base (444)..(444): a, c, t, g, unknown or other
  misc_feature (444)..(444): n is a, c, g, or t
  modified_base (463)..(463): a, c, t, g, unknown or other
  misc_feature (463)..(463): n is a, c, g, or t
  modified_base (471)..(489): a, c, t, g, unknown or other
  misc_feature (471)..(489): n is a, c, g, or t
tcagtacgagtatgcacgaccggtgctcgatttagtgtgagtagtttgggtttgggggctttgcctgggtgctgttggtaccaggagacatagttataaccaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctcaagtctggcaacacggcctccctgaccatctctgggcctccaggctggaggacgaggctgattattactgcagctcatatacaagcagcagcactcaagtcttacggaactgggaccaaggtcaccgtctaggtcacgccaacggcccaacccactgtcactctcgttcccgccctcctccactacctcgtactcgnggccggctggacagggccncgatagcnnnnnnnnnnnnnnnnnnn

SEQ ID NO: 92951 - DNA, 564 bp, Homo sapiens
  misc_feature: GYAE6OF02GENOS.18.78.H01.1.454.CMB.1.raw
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (450)..(450): a, c, t, g, unknown or other
  misc_feature (450)..(450): n is a, c, g, or t
  modified_base (551)..(551): a, c, t, g, unknown or other
  misc_feature (551)..(551): n is a, c, g, or t
  modified_base (555)..(556): a, c, t, g, unknown or other
  misc_feature (555)..(556): n is a, c, g, or t
  modified_base (560)..(560): a, c, t, g, unknown or other
  misc_feature (560)..(560): n is a, c, g, or t
  modified_base (562)..(564): a, c, t, g, unknown or other
  misc_feature (562)..(564): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatccggccctcgtaggggtttctaactcgcttctctggcctcaagtctggcaacgacggcctccctgaccatctcgtgggcctccgaggctggaggacgaggctagtattattacngcagctanatanacagcacagccactctactatcgtctacggaacgtcgggaaccaggtccacccgtccgtaggtaccacgcccaacggccccaacccncgttctacaccttcctccgttacccccacccttcctacctaactaccgttccgtacgtcggacggtccgggtactgggacgaaccggcgtacaacgtagcngacnngacngnnn

SEQ ID NO: 92952 - DNA, 509 bp, Homo sapiens
  misc_feature: GYAE6OF02F4IC4.18.78.H01.1.454.CMB.1.raw
  modified_base (303)..(303): a, c, t, g, unknown or other
  misc_feature (303)..(303): n is a, c, g, or t
  modified_base (501)..(501): a, c, t, g, unknown or other
  misc_feature (501)..(501): n is a, c, g, or t
tcagtacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaatcatgatttangatgtcagtaatcggccctgaggggtttctaagtcgcttctctggctccaagtctggcaacacggcctccctgaccatcctctgggcctccaggctggaggacgaggctgattatactgcagctcatatacaagcagcagcactcaagtctacgactgggaccaaggtcaccgtctaggtcagccaaggcccaacccnctgctacg

SEQ ID NO: 92953 - DNA, 605 bp, Homo sapiens
  misc_feature: GYAE6OF02FOEJZ.18.78.H01.1.454.CMB.1.raw
  modified_base (585)..(585): a, c, t, g, unknown or other
  misc_feature (585)..(585): n is a, c, g, or t
  modified_base (595)..(595): a, c, t, g, unknown or other
  misc_feature (595)..(595): n is a, c, g, or t
  modified_base (598)..(598): a, c, t, g, unknown or other
  misc_feature (598)..(598): n is a, c, g, or t
  modified_base (600)..(601): a, c, t, g, unknown or other
  misc_feature (600)..(601): n is a, c, g, or t
  modified_base (603)..(605): a, c, t, g, unknown or other
  misc_feature (603)..(605): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcgaggggtttctaatcgcttctctggctccaagtctggcaacacggccctcctgaccatctcgtgggcctccgaggctggaggacgaggctgattattactgcagctcatactacagcagcagcactcaacgttcgttacggaacgtcgggaacctaaggtccgaccgttccgtaagggtccacggtaccccaaacgggccccaaaccccgtacgttacgtacccaccttccgttacccgttacccccgccccttacccttcccgtaacgtttacccgtaccgttaccgtcggaacgggtccgggtacgttccgggacgaacgggcccgtaactagtacggntacgacgtcncgntnntnnn

SEQ ID NO: 92954 - DNA, 594 bp, Homo sapiens
  misc_feature: GYAE6OF02JP5B7.18.78.H01.1.454.CMB.1.raw
  modified_base (235)..(235): a, c, t, g, unknown or other
  misc_feature (235)..(235): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
  modified_base (298)..(298): a, c, t, g, unknown or other
  misc_feature (298)..(298): n is a, c, g, or t
  modified_base (309)..(309): a, c, t, g, unknown or other
  misc_feature (309)..(309): n is a, c, g, or t
  modified_base (322)..(322): a, c, t, g, unknown or other
  misc_feature (322)..(322): n is a, c, g, or t
  modified_base (409)..(409): a, c, t, g, unknown or other
  misc_feature (409)..(409): n is a, c, g, or t
  modified_base (457)..(457): a, c, t, g, unknown or other
  misc_feature (457)..(457): n is a, c, g, or t
tcagtacgagtatgcacgaccggtgctcgatttagtgtgagtagtttgggtttggggggggttcggtcgaggaggcgagcgctctcgggacgtctccaccatggcctggctctgctattcctcaccctcctcactcagggcacagggtcctgggcccagtctgccctgactcaacctgcctccgtgtctgggtctcctggacagtcgatcaccatctccgtagcaactggaaccngcagtgacgttggtgttanaacntgctctggtaccanagcaccaggcaaacgcccccaaactnactgatttacngatcgcaagtacnccggcctagtagggtttactatcgtcttctcgtagtctactagtcgtgacaaccgtcgtccctccacgacctatcctcggtggtccnccgtacggtctcggacggcggacgtcgtagtagtttactacgcgtacncgtctacactagaacgacgtaccacgactcctacttacttatacgtacgtaccgttacggacgtacgggaccgtacggtcctaccggtaccgtacggtaccaccggtaccgaccgtaacccgacccctgtacgtacc

SEQ ID NO: 92955 - DNA, 582 bp, Homo sapiens
  misc_feature: GYAE6OF02GDRZ4.18.78.H01.1.454.CMB.1.raw
  modified_base (309)..(309): a, c, t, g, unknown or other
  misc_feature (309)..(309): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgtgggggaggcttggtccagccgtggggggtcccttagacctcccctgtacagcctctggattcactttcagtaaggcctggatgactgggtccncgaggctccgagggagggctggagtgggtggcgtaattaaaaccaaatgagtggtaggacaacgagactacgctgacaccgtagaacgcagacttcaccatcacgaagagatagattaacgaaaagcaacgtctagtatcgtagacaaagtgaacagctagaacgaccgaagacacgacgtcgtattacgtacgtcgtaccacctaccgtcccaagaacgtccgtaactaaccttacctacttaaccgtacggtacgtacggtacctaccggg

SEQ ID NO: 92956 - DNA, 517 bp, Homo sapiens
  misc_feature: GYAE6OF02IMNF0.18.78.H01.1.454.CMB.1.raw
  modified_base (245)..(245): a, c, t, g, unknown or other
  misc_feature (245)..(245): n is a, c, g, or t
  modified_base (506)..(509): a, c, t, g, unknown or other
  misc_feature (506)..(509): n is a, c, g, or t
  modified_base (511)..(512): a, c, t, g, unknown or other
  misc_feature (511)..(512): n is a, c, g, or t
  modified_base (514)..(517): a, c, t, g, unknown or other
  misc_feature (514)..(517): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgattttatgatgtcactaatcggccctnaggggtttctaatcgcttctctggctccaagtctggcaacacggcctcctgaccatctctgggctccgaggctgaggacgaggctgtattattactgcagctcatatacagcagcagcactcaagtctacggactgggaccaaggtcaccgtctaggtcacgacccaacggcccaaccctctcgtccacttcctccgttccccaccctcctccactacctcgtactggacgccgggctacgggcaacgggtccacagtagnnnncnncnnnn

SEQ ID NO: 92957 - DNA, 499 bp, Homo sapiens
  misc_feature: GYAE6OF02HXAWF.18.78.H01.1.454.CMB.1.raw
  modified_base (248)..(248): a, c, t, g, unknown or other
  misc_feature (248)..(248): n is a, c, g, or t
  modified_base (354)..(354): a, c, t, g, unknown or other
  misc_feature (354)..(354): n is a, c, g, or t
  modified_base (482)..(482): a, c, t, g, unknown or other
  misc_feature (482)..(482): n is a, c, g, or t
  modified_base (488)..(499): a, c, t, g, unknown or other
  misc_feature (488)..(499): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttaataactatgtctcctggtaccaacagcacccaggcaaaagcccccaaaatcaatgattttatgatgtcactaatcggccctnaggggttttcaatcgcttctctggctccaaagtccggacaacacggcctcctgaccatctctgggctccaggctgaggacgaggctgattatactgcagctcatanacaagcagcagcatcaagtcttacggaactgggaccaaggtcaccgtctaggtcacgccaacggcccaacccatcgtcactctcgttcccaccctcctaccatacctcgtactgagcggctgcaggcncatagnnnnnnnnnnnn

SEQ ID NO: 92958 - DNA, 641 bp, Homo sapiens
  misc_feature: GYAE6OF02JIN4L.18.78.H01.1.454.CMB.1.raw
  modified_base (590)..(590): a, c, t, g, unknown or other
  misc_feature (590)..(590): n is a, c, g, or t
  modified_base (628)..(628): a, c, t, g, unknown or other
  misc_feature (628)..(628): n is a, c, g, or t
  modified_base (630)..(631): a, c, t, g, unknown or other
  misc_feature (630)..(631): n is a, c, g, or t
  modified_base (633)..(634): a, c, t, g, unknown or other
  misc_feature (633)..(634): n is a, c, g, or t
  modified_base (636)..(640): a, c, t, g, unknown or other
  misc_feature (636)..(640): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaatcatgatttatgatgtcagtaatcggcctcgtaggggtttctaatcgtcttctctggctccgaagtctggcaacacggcctcctcgaccatcctcgtcgggcctccgaaggcctaggacgggacgaggtctaggtatttacgtactgcagtccttacataataacaggacacggacacgactaaccttacgtaaccgttttcggtttacggaaccggttacgggtaaccgtaaacggttccgtaaccggttaccgttaaggtcccgaacggtaaccccgaaacgggacccctaaacccgtaccgtacgtacctaacccgttccgttacccggtttccccgccccgttaccctacccgtactacccgttccgttaacncggacggtccggcggtcgacgacgacgtcgaaatcggncnncnncnnnnnc

SEQ ID NO: 92959 - DNA, 635 bp, Homo sapiens
  misc_feature: GYAE6OF02HSAB5.18.78.H01.1.454.CMB.1.raw
  modified_base (622)..(622): a, c, t, g, unknown or other
  misc_feature (622)..(622): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
  modified_base (633)..(635): a, c, t, g, unknown or other
  misc_feature (633)..(635): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatccggccctcgaggggttttctaatcgcttctcttggctccaagtctggcaacacggcctcctgaccatctcgtggctccgaggctggaggacgaggctgattacttactgcagctcatatacaagcacagcactctctatcgttacgttcggaaccgttagggaaccctaaggtcccgtaacccgttccgttaagggtcccaacggacccccgtaaacgggaccccctaaaccccccgtacgttaccggtaccctaccctttccgttcccgtttacccccgtaacccccgttccctacccgtaacctttacccttaccggttaacccgttggaaccgggtccggggtcctacggggaccgaaacgggccgaccgtaagtcggacngtacncngncnnn

SEQ ID NO: 92960 - DNA, 570 bp, Homo sapiens
  misc_feature: GYAE6OF02IU3OE.18.78.H01.1.454.CMB.1.raw
  modified_base (343)..(343): a, c, t, g, unknown or other
  misc_feature (343)..(343): n is a, c, g, or t
  modified_base (569)..(570): a, c, t, g, unknown or other
  misc_feature (569)..(570): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctctggtaccaacagcaccaggcaaagcccccaaactcatgatttatgatgtcagtaatcggccctcaggggtttctaatcgtcttctctggctcaagtctggcacacggcctcctgaccatctctggctccaggctgaggacaggctgattatactgcagctcatanaacagcagcagccactctaagtcgttacggaactcgggaaccaagggtccaacccggttctacgggtactacggacccaacggaccccaaaccccgacttaccggtcctacctccttaccgttccccgaccccttccctacccattacccgttcgtacgttacggacggcccgggtcgtcgggaccgaagggtccgtacaacgtaggtcagtcgagtccagcagcnn

SEQ ID NO: 92961 - DNA, 534 bp, Homo sapiens
  misc_feature: GYAE6OF02HJJCX.18.78.H01.1.454.CMB.1.raw
  modified_base (371)..(371): a, c, t, g, unknown or other
  misc_feature (371)..(371): n is a, c, g, or t
  modified_base (386)..(386): a, c, t, g, unknown or other
  misc_feature (386)..(386): n is a, c, g, or t
  modified_base (427)..(427): a, c, t, g, unknown or other
  misc_feature (427)..(427): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtgttataactatgtctcctggtaccaacagcacccaggacaaacgcccccaaactcatgatttatgatgtactagtaactcggaccctcgaggggttttctaatcgcttctctgctcaagtctgcaacncgtcctcctgacctntctcgtggctccgaggctgaggacgagctgatttactagtncagctacatacgtaacagtacagcagcactacaattcgtacgactacgggactaagggtcaccggtctaacggtcacgaccgacgacccaacccgctcgtactaccg

SEQ ID NO: 92962 - DNA, 593 bp, Homo sapiens
  misc_feature: GYAE6OF02HILLR.18.78.H01.1.454.CMB.1.raw
  modified_base (307)..(307): a, c, t, g, unknown or other
  misc_feature (307)..(307): n is a, c, g, or t
  modified_base (472)..(472): a, c, t, g, unknown or other
  misc_feature (472)..(472): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgctatttaaaaggtgtccagtgtgaggtgcagctggtggagtccgggggagcgttggtccagccgtggggggtccctgaaactctcctgtgcagcctctggttcaccttcagtggctctgctatgcacgtgggtcccnccgaggtccgttccggggaaaagggccgtggaggttggggttcggccgttaagttaggaagacaaagctaaacgagttaacgcgaacagcatatgctgcgtcggtagaaggcgagtcacgtctcaagaatagattacaaagaacacggacgtactctagactaanacgaacagactagaaaccgagaccgacggccgtacgtattactacgtactacgacgaagtgtagtacgtaggttagggtacgttacgtacggacggtaaacgggggtacgtacgtaaccgg

SEQ ID NO: 92963 - DNA, 562 bp, Homo sapiens
  misc_feature: GYAE6OF02HA9NL.18.78.H01.1.454.CMB.1.raw
  modified_base (363)..(363): a, c, t, g, unknown or other
  misc_feature (363)..(363): n is a, c, g, or t
  modified_base (434)..(434): a, c, t, g, unknown or other
  misc_feature (434)..(434): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttaataactatgtctctggtaccaacagcaccagcaaacgcccccaaactcatgatttatgatgtcactaatccggcctgtagggtttctaatcgtcttctctggctcaagtctgcacncgcctcctgaccatctcgtgggcctcgaggctggacggacgaggctagtaattacttacgtgacagtcctnaatataacaagtcacgacacgctaactacgaacgttcgttacggacgttacggaaccgtaacggtccaaccggttccgtacggtaccaccgacccgaaccggaccccaacccgtacgtccgtaacccg

SEQ ID NO: 92964 - DNA, 554 bp, Homo sapiens
  misc_feature: GYAE6OF02HPE4Z.18.78.H01.1.454.CMB.1.raw
  modified_base (189)..(189): a, c, t, g, unknown or other
  misc_feature (189)..(189): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (553)..(554): a, c, t, g, unknown or other
  misc_feature (553)..(554): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaanagcacccaggcaaagcccccaaactcatgatttatgatgtcagtaatcggccctcgaggggttttctaatcgcttctctggctcaagtctggcaacacggccctcctgaccatctcgtgggcctccaggctggagggacgaggctaggtatttacttacgtgcagcctagattatacaagcagcagcactcagtcttacggactcgggaccaaggtccacgtcctaggtcacgacccgaaggacccaacccgtactcgttaccactctccgttacccacccttcctaccacttaccgtccgttacgtgacggccgggtctcggacgaacggtccgactaacgtgcgatcgagtcgangntagtnn

SEQ ID NO: 92965 - DNA, 612 bp, Homo sapiens
  misc_feature: GYAE6OF02HEF8M.18.78.H01.1.454.CMB.1.raw
  modified_base (374)..(374): a, c, t, g, unknown or other
  misc_feature (374)..(374): n is a, c, g, or t
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggaagtccgggggaggcttagttcagccgtgggggtccctgagactctcctgtgcagcctctggattcagtttcagtcgcctactggatgcactggactccggaccaagttccgaaggggaagagacgtgggtgtgggtctcacgtattaaagatagagtggggtnccacactccgtacgcggactccggtgacggggcctcttcgaccactcctacccgagaaccaaccaccaaagtaaccacgtaatacgtactactgactaaatcggaagcgtagtctaggggacgtacggaggaccgacggcttcgtactagttaccgtggtacgacgaaagggtacgggaaccgttacgggtcgtacccggttaggggacgggggtttcggtacccggtaaccccgggg

SEQ ID NO: 92966 - DNA, 538 bp, Homo sapiens
  misc_feature: GYAE6OF02J0K4T.18.78.H01.1.454.CMB.1.raw
  modified_base (348)..(348): a, c, t, g, unknown or other
  misc_feature (348)..(348): n is a, c, g, or t
  modified_base (527)..(527): a, c, t, g, unknown or other
  misc_feature (527)..(527): n is a, c, g, or t
  modified_base (531)..(537): a, c, t, g, unknown or other
  misc_feature (531)..(537): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtcctcctggtaccaacagcacccaggcaaagcccccaaactcaatgatttatgatgtcactaatcggccctcgaggggttttctaatcgctttctctggctccaagtctggcaacacggccctccctgaccatctcgtcgggctccaggcctgaggacgaggctgattattacngcagctcatatacaagcagcagcactcaagttctcggaactcggaaccaaggtcaccgtcctaggtcacgaccacgaccaaccccactcgtccactcctacgttcccgccctcgccctactaccttcgtacctcggacgccgggtcgtcggccgaacggccggacaaccttggcgtacncgcnnnnnnnc

SEQ ID NO: 92967 - DNA, 536 bp, Homo sapiens
  misc_feature: GYAE6OF02JV4JD.18.78.H01.1.454.CMB.1.raw
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (292)..(292): a, c, t, g, unknown or other
  misc_feature (292)..(292): n is a, c, g, or t
  modified_base (330)..(330): a, c, t, g, unknown or other
  misc_feature (330)..(330): n is a, c, g, or t
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (376)..(376): a, c, t, g, unknown or other
  misc_feature (376)..(376): n is a, c, g, or t
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (458)..(458): a, c, t, g, unknown or other
  misc_feature (458)..(458): n is a, c, g, or t
  modified_base (526)..(526): a, c, t, g, unknown or other
  misc_feature (526)..(526): n is a, c, g, or t
  modified_base (530)..(532): a, c, t, g, unknown or other
  misc_feature (530)..(532): n is a, c, g, or t
  modified_base (534)..(536): a, c, t, g, unknown or other
  misc_feature (534)..(536): n is a, c, g, or t
tcagtacgagtatgcacgaccggtgctcgatttagtgtgagtagtttgggtttgggggtcgtttgtcctgggcccgagtctgccctgactcaacctgcctccgtgtctgggtctcctggacagtcgatcaccatctcctgcactggaaccagcagtgacgttggtggttataactatgtctcctggtaccaacagccaccaggcaaacgcccccaaatcatgatttangatgcagtaancggccctntagggtttctaatcgcttctctgctccaagtctgacacacggccncctgacccatctcgtggacctccgaggctgacggacgnggactgtatttctactgcacggctanatanacgaacgcaacgtacnctactctctagtttcgcttacggagtcggacaacgggctccgtcaggtacacgccagcccaaccncngtcnctctcgtcccncctaccctcactactaccgtcgtacgcggacgggtcctggaccgaccggtcgaccgattaccggatcncgcnnncnnn

SEQ ID NO: 92968 - DNA, 610 bp, Homo sapiens
  misc_feature: GYAE6OF02FZ9X2.18.78.H01.1.454.CMB.1.raw
  modified_base (369)..(369): a, c, t, g, unknown or other
  misc_feature (369)..(369): n is a, c, g, or t
  modified_base (471)..(471): a, c, t, g, unknown or other
  misc_feature (471)..(471): n is a, c, g, or t
  modified_base (596)..(596): a, c, t, g, unknown or other
  misc_feature (596)..(596): n is a, c, g, or t
  modified_base (601)..(601): a, c, t, g, unknown or other
  misc_feature (601)..(601): n is a, c, g, or t
  modified_base (604)..(604): a, c, t, g, unknown or other
  misc_feature (604)..(604): n is a, c, g, or t
  modified_base (607)..(607): a, c, t, g, unknown or other
  misc_feature (607)..(607): n is a, c, g, or t
  modified_base (609)..(610): a, c, t, g, unknown or other
  misc_feature (609)..(610): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtgttataactatgtctcctgtaccaacagcacccaggcaaacgccccaaactcatgatttatgatgtacagtaatccggcctcgtagggtttctaatcgcttctctggcctcaagtctggaccaacgccggcctccctgacccatcctcgtgggcctacccgaggctggaggacgaggtctagtaatttattactgactagctacatanacagcagcagcactcaagtccgtacggaacgtacgggaaccgtaaggtccctaaccgttaccgtagggtaccacggaccccgaacggccccgtaaaccccgngttaccgtaccacccgtttcctacccgttacccctaccccttaccctccctacttacccgtaccgttaacgcggaacggtccgggacgtcgggaccgaacgggcctacgtaacgtcgacgtcgtnacgtncgntangnn

SEQ ID NO: 92969 - DNA, 661 bp, Homo sapiens
  misc_feature: GYAE6OF02GNWO9.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttggctgagctgggtttccttgttgctattttaaaaggtgtccagtgtgaggtgcagctggtggagtccgggggaggcttggtccagccgtggggggtccctgaaactctcctgtgcagcctcgtgggttcaccttcagtggctctgctatgcacgtcgggtcccgccgaggccgttaccggggaaagggcgtgggaggttggggttcggccgtagttaggaagacgaaagctaaacgtagttaaccgacgaacgagacaagttacgtgacgttcggacggtacgggtaggaaacgggccgtaggttaccctacccggttacctacccgaagtaaacgtgtaacttaacgaaaacggaacgaccggtacgtaactcgtacgactaaagtagaaacacgacctaacggaaaccgacggaccgacggccgtagtacttacgtagtacgtagacgaggtagtagttacgtaggtttagggtagttacggtacggtacgggtaacggggtactacgtaacgg

SEQ ID NO: 92970 - DNA, 690 bp, Homo sapiens
  misc_feature: GYAE6OF02HE05I.18.78.H01.1.454.CMB.1.raw
  modified_base (264)..(264): a, c, t, g, unknown or other
  misc_feature (264)..(264): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtcgtgggtctcctggacagtcgatcaccatctcctgcacgtacggaaccagcaggtcgtacgttggtagttaactaacgtntcgtctcgtaggtaccaacacgccaaccgaggaccaaacgaccccaaactcatacgtattacgtgatcgtactaacgtaacgtccggtccttacggtacgggtttactaacgtctacttctcgtacggtacctaccgaagttcggtacggacctaaacgtccggtaccccttccgtacgacctaacgttccgtacggttcgggaccctcggacggtcgtacgggacgggtacgtacggttactagttaacgttactaacgtcgcgtaacgtctataataaacgtacaacgtaccacacgtaccttacttactacgttacgttccgttacgtaacggtaccgtacggtaaccgtaacggtccctaacggtaccgttacggtaccgaccgtaacccggaacccgaacccgtaccctacgcttaacccg

SEQ ID NO: 92971 - DNA, 603 bp, Homo sapiens
  misc_feature: GYAE6OF02G8KCG.18.78.H01.1.454.CMB.1.raw
  modified_base (584)..(584): a, c, t, g, unknown or other
  misc_feature (584)..(584): n is a, c, g, or t
  modified_base (597)..(599): a, c, t, g, unknown or other
  misc_feature (597)..(599): n is a, c, g, or t
  modified_base (601)..(602): a, c, t, g, unknown or other
  misc_feature (601)..(602): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaaacgcccccaaaactcactgatttatgatgtcactaatccggccctcgtaggggtttctaagtcgcttctctggctccaagtctggcaacaccggcctccctgaccatctcgtggcctccgaggctgacggacgacggtctagtactttattaccgtgaccagctcaattaactacgaagcagcagcactcaacgtcttacggaacgtcggaccaaggtccaccgtcgtagacacgacccaacggaccctaaacccgcttacgtacctacgttccgtccgttccccgacccgttccctaccgttaacgttaccgtccggttaaccgtcggacgggtaccgggtccgtcggtaccgaacggggtcccgtaacgaacggttagntcgatcgacgtcnnncnnc

SEQ ID NO: 92972 - DNA, 652 bp, Homo sapiens
  misc_feature: GYAE6OF02HHXVY.18.78.H01.1.454.CMB.1.raw
  modified_base (373)..(373): a, c, t, g, unknown or other
  misc_feature (373)..(373): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacaggagactcaccatggagttttggctgagctgggttttccttgttgcttatttcaaaaggtgtccagtgtgaggtgcagttgggtggagactgggaggaggcttgatccagccgtggggggtccctgagactctcctgtgcagtctctgggttcgtcagtggcgactacatgagcgtgggtccgccgaggcctccgaggggaagggcctgggagtggatctcacttattatgtgtgtacactatacacnagactcgtgaacgggccgatcaccatctacgaagaagaacacttaccgaaggaacctactaagtttagtacttacttactaaatataaacttaacctaggaacgacgaccggaaggaaccgaaccggtaccctaagttacggtaactttaccggttagttacggggttcgggggtaccttaagttttacccgttaccggtaaccccccgggttgggggacccccggggggtaacccctttcggggtaccccttacccggttaccccctaccccccccgg

SEQ ID NO: 92973 - DNA, 833 bp, Homo sapiens
  misc_feature: GYAE6OF02HQA8C.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgctattttaaaaggtgtccagtgtgaggtgcagctgggtggaggtccgggggaggcgttggtccagccgtcggggggtccctgaaactctcctgtgcagcctcgtgggttccaccttcagtggctctgctatgaacgtcgggtccgccgagggccgttaccggggaaagggccgtgggacgggttgggggttcgggccggttagttaacggaaggaccgtaaaaggactaaacgacggtttaaccggacggaaccgaggtacaattaagtcgtaccgtcggaccgggttcgggttaagggaaaacgggtccgtaacggggtttacccgtaacccgttcccgtaccgtaaaggtaaacgttacggtaactttaaccgaaaaggtaaaccgaacgggtacgttaacgttaccgtacggtaactaaaacgtacggaaaccgtaacggtaacccggttaaacgggaaaaacccgggaacgggaaaccggaacccggggttaacccggttaacggtttaaacgttaacgttacgttaaccgttacggtaacggttaagggttacggtaagttttaacggttaacgggttttacgggggtaaggtttacggttaccggggaacggggttaaacccggggggggtttaacttaccgggtacgttaaccggg

SEQ ID NO: 92974 - DNA, 586 bp, Homo sapiens
  misc_feature: GYAE6OF02GVIBS.18.78.H01.1.454.CMB.1.raw
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
  modified_base (366)..(367): a, c, t, g, unknown or other
  misc_feature (366)..(367): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (407)..(407): a, c, t, g, unknown or other
  misc_feature (407)..(407): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
tcagtacgagtatgcacgaccggtgctcgatttagtgtgagtagtttgggtttggggtttcgtaatcgcttctcctggctacccaagtctggcaacacggcctccctagacccatctctgggccttccaggctgaggacgaggctgattattactgctaggctcatatacgaacgcgagccagccacgtcaagtcttcggaactgggaccaaggttccaccggtcctaggtcgagaccgaaggcccaacccgactgtacactcgttcgttcccacctccgtaccgtattaccgtcgtaacctggtacggccggtcttagggacaacggtcgtactaagtacggcagcntcgaccngagtagctagnngagngcagtcnggtgngcgngngnacgacgacgacagagntcgcgcgcncncngcgcgacgcgcgtacgacgacacgagtgtagtagtagtacgtagagcgacgctacgcgcgtacgacgacgacgacgtagtagttagttagtacggtcggtacggacggtacggacggtacggtacggtaacgtaacgtaacggtaacggtacggtaccggtaccgg

SEQ ID NO: 92975 - DNA, 679 bp, Homo sapiens
  misc_feature: GYAE6OF02HEQ8U.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgctattttaaaagtgtccagtgtgaggtgcagctggtgggaggtccgggggaggtcgttggtccagccgtgggggtccctgaaactctcctgtgcacgcctcgtgggttccaccttcagtcggctctgctatcgcacgtcgggtccgccgtaggtccgttacccggggaaagggccgtgggtagggttggggtagggtccgttaagttaggaagacgaaaagcctaacgacgttacgcgaacgagacatagtagcgtggtcggtcggtaggaaggtcgtacggtacctaccgtctaccgaagtaactagtacgtaacgaaacgaacgtacggtacgtactcgtagactaaatacgaacgacgaccgtaaacgaaaccggacggaccgaccgggtcgtagttacttacgtacgttacgtaacggacgtagggttacggtagttaacgtagggttaggggtaagttacggtaccgggtaacggggtaaacgggggttactaccggttaacgg

SEQ ID NO: 92976 - DNA, 568 bp, Homo sapiens
  misc_feature: GYAE6OF02FVBVH.18.78.H01.1.454.CMB.1.raw
  modified_base (207)..(207): a, c, t, g, unknown or other
  misc_feature (207)..(207): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
  modified_base (467)..(467): a, c, t, g, unknown or other
  misc_feature (467)..(467): n is a, c, g, or t
  modified_base (548)..(548): a, c, t, g, unknown or other
  misc_feature (548)..(548): n is a, c, g, or t
  modified_base (550)..(553): a, c, t, g, unknown or other
  misc_feature (550)..(553): n is a, c, g, or t
  modified_base (555)..(568): a, c, t, g, unknown or other
  misc_feature (555)..(568): n is a, c, g, or t
tcagtacgagtatgcacgaccggtgctcgatttagtgtgagtagtttgggtttgggggctttgcctgggtgctgttggtaccaggagacatagttataaccaccatctcctgcactggaaccagcagtgacgttggtggttataactatgtctcctggtaccaacagccacccaggcaaacgccccccaaactcatagtattttaangacttgtctaagttaatccggccctcgtagggggttttcctaatccgcttctcgtggcctcctaaagttctggccaaacaccgggtcctaccccctgacccatcctcgtggtcctccgaggctgacggacgagcttgattagttacgcagctnatanaccgagcaccnaccacttctacgtatcggttactacggaactgggacctaagggtcccaaccggttcccgaggtcaaccgacccgtaacggaccctaaccccnctacgtcctacctcgtactcccctaccctcctcccactactcctactcgacgtccgggatcggcaacggcacgactaagcngnnnncnnnnnnnnnnnnnn

SEQ ID NO: 92977 - DNA, 869 bp, Homo sapiens
  misc_feature: GYAE6OF02I8GE8.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcaaccgtgaatacaggagactcacccatggagttgggctgagctgggtttcctgttgctatttaaaggtgtccagtgtgaggtgcagctggtggtacggtccgggggagtcgttggtccaggccgtgggggtccctagaacctctccgtgtcgcgagtcctcgtgggttcacctttcgagtcggtcctctggcctattgccacttcggggtcccgccgacgggtccgtttaccgggggaaaacgggtccgtagggtaacgggtttggggttaccgggacccggtttaaagtttagggaaacgaaccggtaaaaacggtaccttaaaaccgtaacggtttaaccggacccggttaacccaagggtccctaagttaaacgttccggtaacttcgggtacccgggttacggggttacggaaaaacggggtccgtaaacgggttcccgtaaacccggttaccgttaaccccgaaggtaaaacgtagtaaacgtttaaacgaaaaacggaaccgtaaccgggttacgttaacgttaccgttacgggaaacctaaacgttacgaaacgaaccgtacccgtaaacggaaaaaccccggaagggaaccgtaacccgggttaccggtacgtttaaaccgtactttaccggtaacgttacggtaaccgtaagggttacgttaacgttaccgttaaggttttaccggggtaagttacggtaccggtaaacgggtaaaccggggggttacctaaccggttaacccgg

SEQ ID NO: 92978 - DNA, 689 bp, Homo sapiens
  misc_feature: GYAE6OF02F64QY.18.78.H01.1.454.CMB.1.raw
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcaggtgtacggttggtagttaataacgtattcgtcctcgtcggtaaccaacgacgaccaccgaggaccaaaccgacccccaaactacatagttactttagtgtatcgtactaagtaacgtccggcccgtacggttagggtttactaacgtccgtactttcgtacgtcggtcctaccgtagtccgtcggaccaaccgtccgccctcccgtacgactacttccgtcgtcggcctccggacggtcgtagggacggacggacggtcttagtaagttacgttacgcgtactacgtctacgtaattaacgtaacgacgacacgtaccgactacctaaccgttacgtaacgttccgttaacgggacgttacgggaaccgtacggtacccgtaaccgtttaccggaacgtaccgaccgtaacccgtaaccggaaccccctaacccgtacgtccggtaccctacccgg

SEQ ID NO: 92979 - DNA, 702 bp, Homo sapiens
  misc_feature: GYAE6OF02IU07P.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagcttgggtttccttgttgcttatttaaaaggtgtccagtgtgaggtgcagctggtggaggtccgggggaggtcttggtccacggccgtcggggggtccctgaaacctctcctgtgcagcctgtgggttcaccttcagtggctctgctatgcacgtcgggtccgccgaggtccggttaccggggaaagggcgtgggacggttgggttacggtccgtaagttaggaagacgaaaagtctaaacgtagttacgacgaccgaagacaagtatacggcgtaggtccgggttacgggtacggaaaacggtccgtacgggttacccgtacccgttaccgtaccgaagtaaattcgtaacttacgaaaacgaacgacggtacgtatcgtacgaactaaatacgaacgacgaccgtaacgaaaccggtaacgaacgtaaccggtaccgtacgttaacttacgttaacgtacgtaagtaacggtaggttagtaacgttaagtaggtttaggggtacgttacggtacggtacggggtaaacgggggtacctaacgtaacgg

SEQ ID NO: 92980 - DNA, 304 bp, Homo sapiens
  misc_feature: GYAE6OF02IC4I3.18.78.H01.1.454.CMB.1.raw
  modified_base (290)..(290): a, c, t, g, unknown or other
  misc_feature (290)..(290): n is a, c, g, or t
  modified_base (295)..(304): a, c, t, g, unknown or other
  misc_feature (295)..(304): n is a, c, g, or t
tcagtacgagtatgcacgaccggtgctcgatttagtgtgagtagtttgggtttggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcacgcccaacggcccaaccccactgtccactctcgtccccgcctcctcatactcgtactgacgcgggctggcaggcgnatagnnnnnnnnnn

SEQ ID NO: 92981 - DNA, 604 bp, Homo sapiens
  misc_feature: GYAE6OF02G486O.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctggggggtccctggaaactctcctgtcgcagcctcgtgggttcaccttcagtggctctgctatgcacgtgggtcccgccgacgggccgtttaccggggaaagggctgggaggtggggttggccgttattaggaagcaaaggctaacagttacgcgacagcatatgctggcgtcgtagaaaggcgaggttcaccgtctcaagaatagattacaaacgaacgacggacgtactctagacaaatgaacacgactaagaaaccgaggaaccgacggccgtagtacttacgtacgtactacgaacgtacgggtaggtattacgaggtttaggggtagttacgttaccgacgggtaacgggggtactacgtaacgg

SEQ ID NO: 92982 - DNA, 571 bp, Homo sapiens
  misc_feature: GYAE6OF02H10FS.18.78.H01.1.454.CMB.1.raw
  modified_base (147)..(147): a, c, t, g, unknown or other
  misc_feature (147)..(147): n is a, c, g, or t
  modified_base (226)..(226): a, c, t, g, unknown or other
  misc_feature (226)..(226): n is a, c, g, or t
  modified_base (538)..(538): a, c, t, g, unknown or other
  misc_feature (538)..(538): n is a, c, g, or t
  modified_base (553)..(553): a, c, t, g, unknown or other
  misc_feature (553)..(553): n is a, c, g, or t
  modified_base (563)..(563): a, c, t, g, unknown or other
  misc_feature (563)..(563): n is a, c, g, or t
  modified_base (565)..(571): a, c, t, g, unknown or other
  misc_feature (565)..(571): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccngcagtgacgttggtggttataactatgtctcctggtaccaacagcacccaggcaaaacgcccccaaaatcatgatttangatgtcagtaactcggccctcgtaggggttttcaagtccgctttctctggctacctaagtctggcaacacggcctccctgaccctatccttcgtcgggctaccgaggctggacggacgaggctgtatttattcgagccagtctacatatacaagcagacagactaactcaacgttcgttacggaacgttcggaacctaggtccaccgttactacggtcacgacccacggacccacccgtactcgtacctctaccgtccgttacccgtcccttcctacctacttaccgttccgtacgtcggaggtccggtacncggacgacgtccganagtcagctcncnnnnnnn

SEQ ID NO: 92983 - DNA, 550 bp, Homo sapiens
  misc_feature: GYAE6OF02HUBNV.18.78.H01.1.454.CMB.1.raw
  modified_base (358)..(358): a, c, t, g, unknown or other
  misc_feature (358)..(358): n is a, c, g, or t
  modified_base (501)..(501): a, c, t, g, unknown or other
  misc_feature (501)..(501): n is a, c, g, or t
  modified_base (538)..(538): a, c, t, g, unknown or other
  misc_feature (538)..(538): n is a, c, g, or t
  modified_base (542)..(542): a, c, t, g, unknown or other
  misc_feature (542)..(542): n is a, c, g, or t
  modified_base (544)..(550): a, c, t, g, unknown or other
  misc_feature (544)..(550): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccacagcacccaggcaaagcccccaaactcatgattttatgatgtcagtaatcggccctcgaggggttttctaatcgcttctctggctccaagtcgtggacaacaccggcccttccctgacccattcctcgtggggcctccgaggctggagggacgaggcttaggattattacngcaagccttacattatacaaggcaggcagctactcaacgttcgttacggaacgtcgggaaccaaggtccaccgtctaggtcacgacccgaagcccaacccactcgtaccactcctaccgttcccacccttcctaccattaccncgtactgacgcgggctggaccaggccgactagtacgntagnannnnnnn

SEQ ID NO: 92984 - DNA, 311 bp, Homo sapiens
  misc_feature: GYAE6OF02GNQZC.18.78.H01.1.454.CMB.1.raw
  modified_base (296)..(311): a, c, t, g, unknown or other
  misc_feature (296)..(311): n is a, c, g, or t
tcagtacgagtatgcacgaccggtgctcgatttagtgtgagtagtttgggtttggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtccactctcgttcccgccctcctccatacctcgtactgacgcgggctggcaaggcgcatagnnnnnnnnnnnnnnnn

SEQ ID NO: 92985 - DNA, 536 bp, Homo sapiens
  misc_feature: GYAE6OF02G8KDR.18.78.H01.1.454.CMB.1.raw
  modified_base (330)..(330): a, c, t, g, unknown or other
  misc_feature (330)..(330): n is a, c, g, or t
  modified_base (524)..(524): a, c, t, g, unknown or other
  misc_feature (524)..(524): n is a, c, g, or t
  modified_base (528)..(529): a, c, t, g, unknown or other
  misc_feature (528)..(529): n is a, c, g, or t
  modified_base (531)..(536): a, c, t, g, unknown or other
  misc_feature (531)..(536): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggccctcgtaggggtttctaatcgcttctctggctccaagtctggcaacaccggcctccctgaccatctcgtggctccaggctggaggacgnggctgattattactgcagctcatactacaagcagcagcactcagtctacggaactgggaccaaggtccaccgtctaggtcacgcccgacgacccaacccactcgtcactcctcgttccccacccttccctcctacttaccgtaccgttacctcggcggccggtcgtacgggccgaagggcccgctagttacggntcgnncnnnnnn

SEQ ID NO: 92986 - DNA, 702 bp, Homo sapiens
  misc_feature: GYAE6OF02HKLEX.18.78.H01.1.454.CMB.1.raw
  modified_base (201)..(201): a, c, t, g, unknown or other
  misc_feature (201)..(201): n is a, c, g, or t
  modified_base (255)..(255): a, c, t, g, unknown or other
  misc_feature (255)..(255): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctccgtggacngtcgatcaccatctcctgcactggaaccagcagtgacgttggtagttataactntcgtcctcctggtaccaacagccaccaggacaaacgacccccaaatcatgtatttatgatgtctaagtaactccggcctacggtacggggtttactaacgtccggtcttcgtcgtcggaccttacgtaacgttcgtcggaccaaccggtaccggtccccttacccgtagaccctaacgtccgttacggttccgggcccttacccgacgggtaccgtacgggaacgggaccggtacgggtacgttaagggtttaacttaacgtttaactcggtacctacggtacctacaacttaacgtaaacgactacgacgacacgactaaccgtactacggttaccgtaacggaacgtcgggtaaaccaccgggttacccaccggttacgtaacgggtcccaacggaccccggaaaccgacccctaaccccgtacttaccggtacccttaacccgg

SEQ ID NO: 92987 - DNA, 788 bp, Homo sapiens
  misc_feature: GYAE6OF02H0QFP.18.78.H01.1.454.CMB.1.raw
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
  modified_base (302)..(302): a, c, t, g, unknown or other
  misc_feature (302)..(302): n is a, c, g, or t
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagctgggttttccttgttgcttatttaaaggtgtccagtgtgaggtgcagctggtggagtccgggggagcgttggtcagccgtgggggtccctgaactctctgngcagcctgtcggttcacttcngtgctctgctatgcacgtgggtccncgacgggccgttcggggaaacggtcgtgggtacggtgggttcggccgtttagtaaggaacgactaaacggtactaaaccgtaggtttaaccgacgtaccgaaggacctaagttaagtcgtacgttcggaccgggtttaccggggtaagaaacgggtaccgtaacgggtttaccgaccccgggtttaaccgtacccgtaaacggtaaaacgttacgtaaacgttaaccgtaaaaacgggtaaaccgtaaaccgggtaccgttaacgtaccgtacgtaaccaaaacgtaacgtaaaccgtaacggtaacccgtaaacggaaaacccggtaacggaaaccgtaaccgggtacccgttagttaactttaccgttacgtaaccgttaacgaacggtacgggttaacggtaacgtttaacgttagggtttaacgggggttagtttaacggtaaccgggtaacggggtaaacggggggttaaccttaaccggg

SEQ ID NO: 92988 - DNA, 627 bp, Homo sapiens
  misc_feature: GYAE6OF02HQI0V.18.78.H01.1.454.CMB.1.raw
  modified_base (257)..(257): a, c, t, g, unknown or other
  misc_feature (257)..(257): n is a, c, g, or t
tcagtacgagtatgcacgaccggtgctcgatttagtgtgagtagttgggttggggggggggtctcaggaggcagcgctctcgggacgtctccaccatggcctgggctctgctattcctcaccctcctcactcagggcacagggtcctgggcccagtctgccctgactcaactcgcctccgtcgtctggtctcctcggacagtcgactcaccatctcctgcactggaaccacgcagtgacgttggtgttataactatntctctcgtacaacagacaaccacggacaaacgacccccaaacctacactagtatttatagtatgtactagtaactccggtcctacgtacggggtttactaactcgtcttctcgtcgtcctacctaacgtcgtcggacgaacgaccggtccctccctcgacctactcctcgtcgggcctcccgtaggctggaaggacgaggtctgtaattacttacgtgcacgtctcaatactaacgaggacacgacagacctaacgttacgtaaagttccgggttacgaacggtaccgggaacctaacgggttccgacccggttaccgtacggacctaccggacccaacggtcccctaccccgtacgtcgtacctacccg

SEQ ID NO: 92989 - DNA, 546 bp, Homo sapiens
  misc_feature: GYAE6OF02IUFP0.18.78.H01.1.454.CMB.1.raw
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
  modified_base (350)..(350): a, c, t, g, unknown or other
  misc_feature (350)..(350): n is a, c, g, or t
  modified_base (530)..(530): a, c, t, g, unknown or other
  misc_feature (530)..(530): n is a, c, g, or t
  modified_base (534)..(534): a, c, t, g, unknown or other
  misc_feature (534)..(534): n is a, c, g, or t
  modified_base (536)..(537): a, c, t, g, unknown or other
  misc_feature (536)..(537): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (544)..(546): a, c, t, g, unknown or other
  misc_feature (544)..(546): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgtttggtggttataactatgtctcctggtaccaacagcacccaggcaaacgcccccaaatcatgatttatgatgtcagtaatcggccctgagggtttctaatcgcttctctgctcagtctgcaacncgcctcngaccatctcgngctccaggctgagngagctgtattatacngcagctcataanacaagcacgnagcacgtacaagtcgttacgaacgtgggaacctaaggttcctacgttggcacgaccgacgaccaacccgatcgactaccttcgtaccgttccccgcccttaccgtacctaacgtaccgttcgtaccttaggaccggtcgggccgtaacgggccgtaacgggcctaccgtaacgttcgcgngacncnncgngncnnn

SEQ ID NO: 92990 - DNA, 571 bp, Homo sapiens
  misc_feature: GYAE6OF02HM304.18.78.H01.1.454.CMB.1.raw
  modified_base (390)..(390): a, c, t, g, unknown or other
  misc_feature (390)..(390): n is a, c, g, or t
  modified_base (475)..(475): a, c, t, g, unknown or other
  misc_feature (475)..(475): n is a, c, g, or t
tcagtacgagtatgcacgaccggtgctcgatttagtgtgagtagtttggggtttggggggggggtctcaggaggcagcgctctcgggacgtctccaccatggcctgggctctgctattcctcaccctcctcactcagggcacagggtcctgggcccagtctgccctgactcaacctgcctcgtgtctgggtctcctggacagtcgatcacatctcctgcactggaaccagcagtgacgttggtgtatactatgtctctgtaccacagcaccaggacaacgccccaatcatgtattatgatgtacagtactccgtcctagtacgggtttactaagtcgtcttctcgtgtcctcgtaagttcgtcggacaaccgaccggtccctacccgtanaaccctattccgtacgtcgggcctccgaggtctaggaacggacgacggactaggtattagtactgacagtctactagtatacganacgagcacgcactacgaagtcctaggacgtacggaactaacggtccaccgtcgtagtacgacgtacccgacgacccctaaccagtccgtacctccg

SEQ ID NO: 92991 - DNA, 301 bp, Homo sapiens
  misc_feature: GYAE6OF02GUQD4.18.78.H01.1.454.CMB.1.raw
  modified_base (294)..(301): a, c, t, g, unknown or other
  misc_feature (294)..(301): n is a, c, g, or t
tcagtacgagtatgcacgaccggtgctcgatttagtgtgagtagtttgggtttggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaaccccactgtcactctcgttcccaccctcctccatacctcgtactgagcggctggcaaggcgcatagnnnnnnnn

SEQ ID NO: 92992 - DNA, 527 bp, Homo sapiens
  misc_feature: GYAE6OF02G8EBQ.18.78.H01.1.454.CMB.1.raw
  modified_base (319)..(319): a, c, t, g, unknown or other
  misc_feature (319)..(319): n is a, c, g, or t
  modified_base (505)..(506): a, c, t, g, unknown or other
  misc_feature (505)..(506): n is a, c, g, or t
  modified_base (509)..(527): a, c, t, g, unknown or other
  misc_feature (509)..(527): n is a, c, g, or t
tcagtacgagtatgcacgaccggtgctcgatttagtgtgagtagtttgggtttgggggctttgcctgggtgctgttggtaccaggagacatagttataaccaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctcaagtctggcaacacggcctcctgaccattctctgggctaccgaggctggaggacgtaggctgatttattacngcagcctacatactacaacgcagcagcactctaagtccttacgggaactcggggaaccaaggtccacccgtcgtaggccaacgccccgaaggacccaacccacctacgtacctacctctaccgttccccgccctccctaccactacctacgtactgacgcggctcggactaagggccacagtacgnnagnnnnnnnnnnnnnnnnnnn

SEQ ID NO: 92993 - DNA, 704 bp, Homo sapiens
  misc_feature: GYAE6OF02GCM32.18.78.H01.1.454.CMB.1.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatccaccatctcctgcactggaaccngcagtgacgttggtagttataactntgtctcctgtaccaacagcaccaggacaaacgacccccaaatcatgtatttatgatgtacaagtaactccggtccctgtacggggtttcaacgtcgtcttctctcggcctaccgaagtcgtaggaccaacgaccggtccctcccgtacgacctagtcctcgtcgggccttccgacggtcgtcgggacggaccggtaggtacgttacgttaactttaaccttaacggttcgtaacgtacggtaccttaacgtaacttaacgtaaacgtaaacggaccgaagaccgtacgtaccttaaccgtaaccgtaacggttaccgttaaccggggtaaccggttacgggaacccgtaacgggtccccgtaaaccggttacccggtaacggtacccgtaaccggaaccccgtaaccggaccccgtaacccccgtacgtttaccggtaccctaacccgg

SEQ ID NO: 92994 - DNA, 560 bp, Homo sapiens
  misc_feature: GYAE6OF02HBISS.18.78.H01.1.454.CMB.1.raw
  modified_base (254)..(254): a, c, t, g, unknown or other
  misc_feature (254)..(254): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactntgtctctggtaccaacagcaccagcaaagcccccaaactcatgatttatgatgtcagtaatcgcctcgacggggtttctaatcgcttctctggctcaagtctggacaacgacggcctccctcgaccatctcgtcgggcctccgaggctgaggacgaggctgtattatactcgcagctacgatactaacaagcagcagactactactaagtccgttaggaaccgtagggaactacggtccgtacccgtacggtacgtaccgacggtacccgaacggaccccgaaccctacgttcgtaccttaacccg

SEQ ID NO: 92995 - DNA, 638 bp, Homo sapiens
  misc_feature: GYAE6OF02J274F.18.78.H01.1.454.CMB.1.raw
  modified_base (222)..(222): a, c, t, g, unknown or other
  misc_feature (222)..(222): n is a, c, g, or t
  modified_base (276)..(276): a, c, t, g, unknown or other
  misc_feature (276)..(276): n is a, c, g, or t
  modified_base (617)..(617): a, c, t, g, unknown or other
  misc_feature (617)..(617): n is a, c, g, or t
  modified_base (621)..(621): a, c, t, g, unknown or other
  misc_feature (621)..(621): n is a, c, g, or t
  modified_base (630)..(630): a, c, t, g, unknown or other
  misc_feature (630)..(630): n is a, c, g, or t
  modified_base (632)..(632): a, c, t, g, unknown or other
  misc_feature (632)..(632): n is a, c, g, or t
  modified_base (637)..(637): a, c, t, g, unknown or other
  misc_feature (637)..(637): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtgttataactatgtctcctggtaccaacagcaccaggcaaaacgccccaaatcatgtattangatgtacagtaactccgcctgtagggtttactatcgcttcgctgctaccagttncgacacgtaccggccttaccgtgaaccctgtcctcggtcggtcctaccgaggcgtacggacggacgtacggtctaaggttacttacttacgtcggactacgtctaactaacttaacgtacgaaccgtccaacctacgtaccttacttacgtagtaccgtttagtacccgtaacgggaacgtacggtaaccgtaacggtcccaccggttacgtacggtaaccaccgaccggtaacacccctaaccgtctacgtccttaccctcgtttcccaccctaccgtccttaacgcttacgtacgtcgtaagccgggtagtccaggaacgtcggacctggtaatccggntacnggactcgcncncgtcnc

SEQ ID NO: 92996 - DNA, 859 bp, Homo sapiens
  misc_feature: GYAE6OF02GN8WE.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggaggtccgggggaggcgttggtccagccgtgggggtccctgaaactctcctgtgcagcctcgtgggttcctaccttcgagtggctctcgctatgctacgtcgggtcccgccgtacggtaccgttaccgggggaaagggtccgtaggggtagggttcgggggtttcgggacccggtttaagtttaacgggaaggtaaccgtaaaacggtaccgttaaaaccgtaacgggtttaaccggacccggtaaccgaacggtactaaacgttacgttacggtccgttacgggtccggggttaccggggtaacgggtaaaacgggtccggttaacgggtttacccgacccggtttaacccgtaacccgtaaacgtaaaacgttacgtaacgttaaaccgaaaacgaaaccggtaaccgggtaaccgttaacgttacgtacgaaccgtaaaacgttacgaaaccgtacggtaacccgtaacggaaaaacccgggtaacggaacccgtaaccgggtaccggttaacgttaacgtttaacgtacgttaccgttaaggaaccggtaaggttaacggtaacgttacggttaagggtttacggggttaagtttacggtaaccgggtaaccggggtaaaccggggggttaccttacggtaaccggg

SEQ ID NO: 92997 - DNA, 785 bp, Homo sapiens
  misc_feature: GYAE6OF02HVNOP.18.78.H01.1.454.CMB.1.raw
  modified_base (772)..(772): a, c, t, g, unknown or other
  misc_feature (772)..(772): n is a, c, g, or t
  modified_base (781)..(781): a, c, t, g, unknown or other
  misc_feature (781)..(781): n is a, c, g, or t
  modified_base (784)..(784): a, c, t, g, unknown or other
  misc_feature (784)..(784): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaaccacagccacccaggacaaaccgcccccaaaatcatgtattttatgatgtacaagtacgtccggcccgttcggtaaggggttttcctaaagttccgtctttcgtcgttcggccttaccgaacgttcgtacgggacctaaaccggacccggtcccctcccgtacgaccctacttccgtccggtcggtccgttacccgacggtcgtagggaacgggaccgtacggtcgttagttaacgttaacttacgtgccgtacgtacctacaatttaaccgaacaaccgaccgaaccgacgtacttaccttccttacgttaagttccggttaaccgtttacgggaaccggttaccgggaaacccgttaaacgggtccccgttaaccggtacccgttaaccggtccgaaccccggtaacccggtaacccgaaccccctaccccgtactaccgttaccctacccgttcccgtttaccccgtccccgttacccttaccccgtaccgttaacgtttacccgtaccggttagacccggggtacggtacccgggaccggttacgggacccgtaacgggtccctaaggaccgtacgagtgccngtccacgcncgna

SEQ ID NO: 92998 - DNA, 656 bp, Homo sapiens
  misc_feature: GYAE6OF02FX16E.18.78.H01.1.454.CMB.1.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (303)..(303): a, c, t, g, unknown or other
  misc_feature (303)..(303): n is a, c, g, or t
  modified_base (465)..(465): a, c, t, g, unknown or other
  misc_feature (465)..(465): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcaccatctcctgcactggaaccngcagtgacgttggtgttataactntgtctctggtacaacagcaccaggacaaacgcccccaaactcatgtatttangtatgtcactaacgtccggcctcgtagggtttactaagtccgtcttctcgtggccttaccgaagttcgtcggacaaccgaccgtccctccctacgacctactcgtcgtcgggcctacgaggtcgtgggaacggacggtacggtacgtagtactttagttacnggtcctaagtcctataacgttaactaaccgaacgtccaaacctacggaccttaccgttcctaacgttacgtaccgtttaccgttacgggtaaccgtacgggtaaacccgtaacgggtacccgtaacccggttaccgttacggtacctaccggaacccccgtaacggtacccctaaaccccgtgttaacccg

SEQ ID NO: 92999 - DNA, 679 bp, Homo sapiens
  misc_feature: GYAE6OF02GW7JD.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggtttccttgttgctatttaaaaggtgtcagtgtgaggtgcagctggtggaggtccgggggaggcttggtccagccgtcggggggtccctggaaactctcctgtgcacgcctcgtgggttcaccttcagtggctctgctatgcacgtcgggtcccgccgacgggccgttaccgggggaaaggggccttaggggtaggttgggggttcgggtcccggttaagttaacggaaggacgaaaaggtcctaaacgtaaggttaaccgaccggaacgagcaatagtcgctggccggtcggtagggaaacggcgtacgttccgaccgtcctaccgaagtaaatgtaacttacaaaagaacgacgggtactacgtactagacaaatacgaacacgaccgtaacgaaacgacggaacgaccggtaccggttataacgttacgtacgtacgtagtacgtaggtacggttataacgttaggtttaggggtaacgttagtacggtacgggtaacgggggtaccgtacggtaccgg

SEQ ID NO: 93000 - DNA, 790 bp, Homo sapiens
  misc_feature: GYAE6OF02HRVPD.18.78.H01.1.454.CMB.1.raw
  modified_base (702)..(702): a, c, t, g, unknown or other
  misc_feature (702)..(702): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagcttgggttttccttgttgctattttaaaaggtgtccagtgtgaggtgcagtctgggtgggaggtccgggggaggtcttggtccgagtccgtcggggggtccctgaaactctcctgtgcagccttcgtgggttcctaccttcagtcggctctgctagtgcacgtcgggtcccgccgacggtccggttaccggggaaaggggtcctggggtacgggttcggggtttacgggaacccggttaaacttaaaaaaacccgtaaaacgttagggtaaggttacggggtacgggtaaccaaaccggaacgtacgtaccgtacgtcgacccggtaaaccgtacgggaaaaggaccgtaacgtaactttaccctaaccgtagttacccgtaacgaaaacggtacgtacgttaacggtaaacgtttaaaaccgaaaaaaggtccccgtaacggtccgtttaacgttattacccggtaagaaacgttaaaacgaaccgaaacgttacccggtacgtaacgaaccgggaaacggacgaaccctaacgcgttaaccgggttntaacgttacggtaggttaacgcgtaaacggtacgtaccgagggtccggtaggtacggagacggtttacggaccggtacggtacggggg

SEQ ID NO: 93001 - DNA, 752 bp, Homo sapiens
  misc_feature: GYAE6OF02FIEDC.18.78.H01.1.454.CMB.1.raw
  modified_base (738)..(738): a, c, t, g, unknown or other
  misc_feature (738)..(738): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggttggttataactatgtctcctggtaccaacagcacccaggcaaacgccccaaactcatgtatttatgatgtcagtaactccggcctcgtaggggttttactaactccgtcttctcgtaggcctcctaacgtcgtcggaccaaccgaccggccctccctcgaccctattcctcgtcggccttaccgaggtctaggacggacgacgtcgtagtactttacgttactcgacacgtctactactaactacgaacgacacgtaccagacctaaccgtactaaacgttccgtaaccgggtaacggttacggggaacctaacgggtccctaacccggttccgtaacgggtaccgaaccggaccccgtaaaccgggaccccctaaaaccccgtacccgttaacggttacccgtaccttccccgttttacccggttaccccctaaccccctacccgttaacccgtaacctttaacccgttaacccggtttaacctaccgggtaaccgggtccggggtaccctacggggttaaccggaaccgggtaccgtaccgtaacggttaacggactacgaccgttacactacgnaccgtgtccgtacg

SEQ ID NO: 93002 - DNA, 837 bp, Homo sapiens
  misc_feature: GYAE6OF02IVJY1.18.78.H01.1.454.CMB.1.raw
tcagtacgagtatgcacgaccggtgctcgatttagtgtgagtagtttgggtttggggagctctgggagaggagctccagccttgggattccagctgtctccactcggtgatcggcactgaatacaggagactcaccatggagtttgggctgagtcgtcggtttcgtgttgcttatttaaaggtgtacagtgtgaggtgcagctagggtggaggtccgggggagtcgttggtccagtccggtgggggtccctaggaaacctcgtacccgtgtcgacctcgtcccgttcgtaggggttcctaccgttacgtagtcggacttcgtagcttactaggaccctagtccggggtccgaccgtaacgggtccggtttaaccggggggaaacggtcgttacggggtaacgggtttccgggggttacgggtacccggtttaacgtttaacgggaaaaccggtaccgttaaaacggtaccgttaaaacggtaacggttttaacccggaccgtaaacgaacggtaacctaagttacgtaccggtccgttagggtaccggttaccgggtaacgggtaaacggtaccgtaacgggttacccgtaaccggtccttaaccggaacgtaaagtacgtaacgtaacgtaaacgaaccgtacggtaccgttaacgtcgtaacgtactaaacgtcgtaaaccgtaacgtaccgtaacggtaaaccggtaggaacccgacggtacccgttaagttaccgttacgttacgttaacggtaacgtaacggtagtaggtaccgttagtacggtttacgggtacggttaagtccggtaacggggtacggggttactaacggg

SEQ ID NO: 93003 - DNA, 578 bp, Homo sapiens
  misc_feature: GYAE6OF02HCD73.18.78.H01.1.454.CMB.1.raw
  modified_base (565)..(565): a, c, t, g, unknown or other
  misc_feature (565)..(565): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (576)..(577): a, c, t, g, unknown or other
  misc_feature (576)..(577): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggccctcgaggggtttctaatcgcttctctggctccaagtctggacaacaccggccctccctgaccatcctcgtgggcctccgaggctggagggacgaggctagattattactgcagctcatacacaagccacagcactctactatcgttcgttcgaacgtcgggaccaacggtccaccgtctacggtccaacgacccaacgaccccaacccgtactcgcctacctccttccgtcccctacccctcctacccaacttaccgttccgttacgtacggacgggtccgggtctacgggaccgaacgggtcccgactaacgtcgagtacgngactgcncncnnc

SEQ ID NO: 93004 - DNA, 734 bp, Homo sapiens
  misc_feature: GYAE6OF02JW2I5.18.78.H01.1.454.CMB.1.raw
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcaggcacagggtcctgggcccagtctgccctgactcaacctgcctccgtgtctgggtctcctggacagtcgatcaccatcctccgtgcacgtgggacnccacctcaacngtcggggcggttatgatcgtacacgtgtacagcagtcctacgacgggaccaccgacccccaaactccctactaacgttcgtttacggtaacgactaaactaacgtcccggtacccgtacggtaccggggttccctacggtaccgttacttccgtccgtcggtacctaccggtaaggttccgtacggtaccctaaccgtccgtaccgtccccgttacccgtaccgggacctacgttacccgtacggtccgggaccctacgtacggtcgtacggaggacgttggacggtctagtacctaagttaccgctaccgtacgttccgttaagacgtaacgtagtacggtacggtaccggttaggtaccgggtttaggttaccgttaaggttccggttacggttacgtacggttcggtaaccgggtaaccggtaacggttcccgtaaaccgttcgttaacgacgtacccggaaccgtacccgtacccgtaccttcgtaccg

SEQ ID NO: 93005 - DNA, 689 bp, Homo sapiens
  misc_feature: GYAE6OF02IYSYL.18.78.H01.1.454.CMB.1.raw
  modified_base (200)..(200): a, c, t, g, unknown or other
  misc_feature (200)..(200): n is a, c, g, or t
  modified_base (286)..(286): a, c, t, g, unknown or other
  misc_feature (286)..(286): n is a, c, g, or t
  modified_base (319)..(319): a, c, t, g, unknown or other
  misc_feature (319)..(319): n is a, c, g, or t
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
  modified_base (358)..(358): a, c, t, g, unknown or other
  misc_feature (358)..(358): n is a, c, g, or t
  modified_base (615)..(615): a, c, t, g, unknown or other
  misc_feature (615)..(615): n is a, c, g, or t
  modified_base (651)..(651): a, c, t, g, unknown or other
  misc_feature (651)..(651): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctccaccctcctcactcaggcacagggtcctgggcccagtctgccctgactcaacctgcctcgtgtcgtggtctccgtggacngtcgatccaccatcctcctgaccacgtcgaaccagcctaggtcgtacgttggttaggttaacaactatcgtcctctcgtaaccaanacgaccaccgacggaccaaaccgacccccaacncatacgtaattangtntcgtactacgtaactccggtccnggttacgggtttactaacgtcgtactttcgtccgtggtccctacttaagtccgtaggtaaccaccgcccgtccccgttccaaccggtacctaacgtcccgtacgttccgggtccctacccggtacgggttccgagggtaacgggaaccggtcgggtaccgttaggttaaaccttttattaccggttaccgtacgtaccgtccgtaacttaacgtacctaaacgaacgtacccaacgtacgtacctacttcttacttntacgtacgtcggacgcggtacgtacgtccaccggtnccggtacaccgtaccaccggaccctaacgtctcgtacc

SEQ ID NO: 93006 - DNA, 827 bp, Homo sapiens
  misc_feature: GYAE6OF02HJIB5.18.78.H01.1.454.CMB.1.raw
tcagtacgagtatgcacgaccggtgctcgatttagtgtgagtagtttgggtttggggagctctgggagaggagactccagccttgggattcccagctgtctccactcggtgatcggcactgaatacaggagactcaccatggagtttgggctgagctgggtttccttgttgctatttaaaggtgtctagtgtgaggtgcagctgggtgggacgggtaccggggggtaggtcgttacgggtccgaacggtcccggttcggggggggttccccttaggtaaaaccgttccgttccgttcggttcgaccgacggtcccgttcgttcggggtttcctaacccgttcgaacggttcgggcttcgtcggtcttacgtcgccgtaaccgttccggggtcccgtacccgagggtacccggttaccgggggaaacggggtcgttacgggggacgggttcggggttcggggtaccgttaacggtttaacggaaacggtacgtaaaacggtactaaacggtacggtttaaccgcggtaacgcgtacgtagttatcggtccgtgggtacggttacgggtaaggtaacggcggtacggttctacccggttacctaccgtaagtaaacgtagtaacgttaacgaaaacgtaaccgtaccgggtacttacgtactacgactaataacgaaacgacgtaccgtaaacggaaaccggaacggtaccgtaaccggacgttacgtaacgttacgtacgtacgtaacggtcggtaaggtacgtaagttaacgttagggttacgggtaggttacgtacgggtaccgggtaacggggtacgttaaccgg

SEQ ID NO: 93007 - DNA, 570 bp, Homo sapiens
  misc_feature: GYAE6OF02GCVPT.18.78.H01.1.454.CMB.1.raw
  modified_base (559)..(559): a, c, t, g, unknown or other
  misc_feature (559)..(559): n is a, c, g, or t
  modified_base (564)..(565): a, c, t, g, unknown or other
  misc_feature (564)..(565): n is a, c, g, or t
  modified_base (567)..(568): a, c, t, g, unknown or other
  misc_feature (567)..(568): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcaggggtttctaatcgcttctctggctcaagtctggcaacacggcctccctgaccatctcgtgggctccaggctaggacggacgaggctgtattacttactgcagctacataactacaaagcaccagcactctctaatgtacttacggaacgtcgggaaccgtaaggtccacccgtcgtacgtaccgacgaccccgaaacggtccccaaaccccgtattcggacctacctccttccgttcccccgcccttccctacctaacgttacctcgtaacgtcgacggtccgggctacggacgacggtccgacaactggcngctgnncnngc

SEQ ID NO: 93008 - DNA, 837 bp, Homo sapiens
  misc_feature: GYAE6OF02HCUC1.18.78.H01.1.454.CMB.1.raw
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagctgggtttccttgttgctattttaaaggtgtccagtgtgaggtgcagctggtgggaggtccgggggaggtcgttggtccgaggtccggtcggggggtccctagaaaccttcctaccgtgtgccagtcctcgtcgggttaccaccgttcaggtggctctgtctatcgtactacgtcgggtcccgccgtacggtccggttaacccggggaaagggtcgtaggggtagggttcgggggttacgggtaccggttaagttacggaaacgtaacgaaaacgtacgtaaacgtaacggtttaccggaccggtaaccgacggtacctaaagttacgtacggtcgttacgggtacccgggttacggggtaacggtaaacggggtaccggtaacggggtttacccgtaaacccggttacccgttacccgtaaaggtaaacgtaggttaaacgttaaccgtaaaacggaacgtaacggtacgtaacgtacgtacgaactaaacgtacgaaacggtacgtaccgtaaaccgggaaaacccggaaggtaacccgaaacggggttacccgtaagttaacgtttaacgtacgttaacgtaacggtaacggtacgggtagtacgtaacggtttaggttaacggggttacggtttacgtaccggggtaaccggggttaaccggggggttaactaaccggg

SEQ ID NO: 93009 - DNA, 519 bp, Homo sapiens
  misc_feature: GYAE6OF02GCNDN.18.78.H01.1.454.CMB.1.raw
  modified_base (243)..(243): a, c, t, g, unknown or other
  misc_feature (243)..(243): n is a, c, g, or t
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
  modified_base (509)..(513): a, c, t, g, unknown or other
  misc_feature (509)..(513): n is a, c, g, or t
  modified_base (515)..(516): a, c, t, g, unknown or other
  misc_feature (515)..(516): n is a, c, g, or t
  modified_base (518)..(519): a, c, t, g, unknown or other
  misc_feature (518)..(519): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcagtaatcggccctnaggggtttctaatcgcttctctggctccaagtctggcaacacggcctcctgaccatctcgtgggctccgaggctgacggcgaggctgattattactgcagctcatatacaagcagcagcactacgaacgtcttacggaacgtcgggaccaaggtccaccgtcgtaggtacacgaccaacggcccaacccnctcgtaccnctctcgttacccactcctccctacacttacctcgtactgacgcgggctggacacgggcactagtgannnnngnngnn

SEQ ID NO: 93010 - DNA, 764 bp, Homo sapiens
  misc_feature: GYAE6OF02IJL8X.18.78.H01.1.454.CMB.1.raw
  modified_base (261)..(261): a, c, t, g, unknown or other
  misc_feature (261)..(261): n is a, c, g, or t
  modified_base (290)..(290): a, c, t, g, unknown or other
  misc_feature (290)..(290): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacaggagactacaccatggaggtttgggctgagctgggttttccttgttgctaattttaaaaggtgtccagtgtgaggtgcagcgtggtggagtccgggggaggctggtcagccgtgggggtccctgaactctcctgtncagcctctgggttcacctttcagtggtcncgtgtactactgcactcgggtcccgaccgaggtccgttacccgggggaaagggtccggtgggtagggttaggggttcgggtaccccgttaagttaacggaaaacgacgtaaaaaagaccgtttaaaccgaaacgtttaaccggcgtaaaccgaaggtacctaagtaacgttcgcttcggaacggttaccgggtaaggaaacggtcgtaacggttacccgtacccggtaccgtacccgaaacgtaaacgttagtaacgtaagaaaaacgaaacgaaccggtaacgtaattaccgacggtaacaaaagtaaccgaaacgacgtaaccgtaacggaaaaccgtacggaacaaccgggtaccgtacgttaacgtttacgtacgtacgtacgtaacgaagtaggtaacgttaacttagggttaagggtacgttacggtaggaaccggggtaaacggggggttacctaacggttaaccgg

SEQ ID NO: 93011 - DNA, 605 bp, Homo sapiens
  misc_feature: GYAE6OF02I80X0.18.78.H01.1.454.CMB.1.raw
  modified_base (225)..(225): a, c, t, g, unknown or other
  misc_feature (225)..(225): n is a, c, g, or t
  modified_base (441)..(441): a, c, t, g, unknown or other
  misc_feature (441)..(441): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
  modified_base (599)..(600): a, c, t, g, unknown or other
  misc_feature (599)..(600): n is a, c, g, or t
  modified_base (602)..(604): a, c, t, g, unknown or other
  misc_feature (602)..(604): n is a, c, g, or t
tcagtacgagtatgcacgaccggtgctcgatttagtgtgagtagtttgggtttgggggcgtttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaatcatgatttangatgtcagtaatcggcctcgagggttttctaatcgcttctctggcctcaagtctggacaacacggcctccctgacccatcctcgtggcctccgaggctggaggaccgaggctgtattactacgtgctagctcatataacgaagcacgactagcctaatcgtaaagttccgttacggaacgttcggaaactacggtcctacccgtccgtaggtaccnccggtacccgaaacggccccaacccgtaacgttcgtaccccgtacttacttccccggttaacccctaccccgttccctaccgtaactttacccgtaccgttacgaccgtggaccgggtcgttacgaccgtacggcgtaccgtatacggncncgcgcgnncnnnc

SEQ ID NO: 93012 - DNA, 821 bp, Homo sapiens
  misc_feature: GYAE6OF02H9Z6X.18.78.H01.1.454.CMB.1.raw
  modified_base (794)..(794): a, c, t, g, unknown or other
  misc_feature (794)..(794): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcaccaggacaaacgcccccaaatcatgtatttatgatgtcagtaactcgcctacgtaggggtttactaatccgtctttcctcgtcggtcctaccgaagtcgtggaccaaaccgaccggtcccttcctacgacctatcctcgtcggtcctccgaggtcgtacggaacgggacggtacggtctaggttaactttaacgttacgtcgacgtaacgtccttactaactaactaacgaacggaccgaaacgcgaacgacctaaccgttacgtaacggtttaccgttaacgggaaccggtacgggaacccgtaaacgggttacccgtaacccgttacggtaacggtacccgaaccggtaccccggaaaaccgggaaccccctaaaccccggtacgttacgggtaccccttaaaccgttcccgttaccccggtttacccccgttacccccgttaaccctttaccccgtaaacccgtttaaccccggttacccggtttaaaccggtaccgggtaccggggaccccggggttacggttaaccggggaccccggttaaacggggtaccccgtaacgtttaaaaccggtccgggaacctcgtaccggttaaccnccgtaccgtacgtacgtacgacgtacg

SEQ ID NO: 93013 - DNA, 649 bp, Homo sapiens
  misc_feature: GYAE6OF02ISNGU.18.78.H01.1.454.CMB.1.raw
  modified_base (190)..(190): a, c, t, g, unknown or other
  misc_feature (190)..(190): n is a, c, g, or t
  modified_base (284)..(284): a, c, t, g, unknown or other
  misc_feature (284)..(284): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
  modified_base (632)..(632): a, c, t, g, unknown or other
  misc_feature (632)..(632): n is a, c, g, or t
  modified_base (640)..(640): a, c, t, g, unknown or other
  misc_feature (640)..(640): n is a, c, g, or t
  modified_base (642)..(642): a, c, t, g, unknown or other
  misc_feature (642)..(642): n is a, c, g, or t
  modified_base (647)..(648): a, c, t, g, unknown or other
  misc_feature (647)..(648): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacngcacccaggcaaagcccccaaactcatgatttatgatgtcagtaactcggccctcaggggtttcctaatcgcttctctggctcaagtctgcacncgcctccngaccntctcgtggctccaggctggacggacgaggctgtatttatactgcagactctatacgtaacaaacggtcaggcaagcgaactacgaacgtttcgttacggaaccgttgggaaaccctaaggtccaacccggttaccgttaacggggtcccaagggacccccgaaacgggtaccccaaaccccgtacttcccggtaccaccctttcccgtaccgtttaccccctaaccccgttcccctaccgtaactttacccgtttccgtaaaccgttcgggtaaccggcccggggtacttaccgggccgtaaacgggcccggtactaaaggttccggatacggcncgacgacncnctacnnc

SEQ ID NO: 93014 - DNA, 607 bp, Homo sapiens
  misc_feature: GYAE6OF02G0M2G.18.78.H01.1.454.CMB.1.raw
  modified_base (295)..(295): a, c, t, g, unknown or other
  misc_feature (295)..(295): n is a, c, g, or t
  modified_base (349)..(349): a, c, t, g, unknown or other
  misc_feature (349)..(349): n is a, c, g, or t
  modified_base (592)..(592): a, c, t, g, unknown or other
  misc_feature (592)..(592): n is a, c, g, or t
  modified_base (596)..(596): a, c, t, g, unknown or other
  misc_feature (596)..(596): n is a, c, g, or t
  modified_base (599)..(599): a, c, t, g, unknown or other
  misc_feature (599)..(599): n is a, c, g, or t
  modified_base (601)..(601): a, c, t, g, unknown or other
  misc_feature (601)..(601): n is a, c, g, or t
  modified_base (607)..(607): a, c, t, g, unknown or other
  misc_feature (607)..(607): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctctggtaccaacagcacccaggacaaacgcccccaaactcatgatttatgatgtcagtaatcggccctcgtaggggtttctaatcgcttctctgctcaagtctgcaacacggcctcctnaccatctcgcggctaccaggctggagacggagctagtattatactgcagcctanattacaacagaccaccagacctactctacttatcgttacgtccggtaacgtacggaacctaacggtcccgtaacccgtccgtaacgtcccgaaccgaccccgaaccggtaccccaaccccctacgttccgtaccctacccttacccgttaccgttaccccctacccttccccgttaccctaaccttacccgtacgttacgtcgaccggcgggtacgtacggcgaacggtacgactacgtacgntacntgntnagctan

SEQ ID NO: 93015 - DNA, 766 bp, Homo sapiens
  misc_feature: GYAE6OF02JK5KN.18.78.H01.1.454.CMB.1.raw
  modified_base (337)..(337): a, c, t, g, unknown or other
  misc_feature (337)..(337): n is a, c, g, or t
tcagtacgagtatgcacgaccggtgctcgatttagtgtgagtagtttgggtttgggggtaggctctgggaggagggaggctccagccttgggagttcccagctgtctccactcggtgatcggcactgaatacaggagactcaccatggaggttgggctgagctgggttttccttgttgctatttaaaggtgtctagtgtgaggtgcagctgggtgggacggtccggggggaggcgttggtccgaggtccgttgggggggtccctaggaaacttcctcctggtcgcacgccttcgtgggttcacttcagtcgtctctgtctatcgctacgtgggtccnccgtaggtccggttaccggggaaacgggcgtaggggtagtcggggttcgggtacccgtagtttaacggagtacaaacggtcgtaaacgtacggttaaccggccgtaacggacgtacgagttaacgtgaccgttgggccgggttaccggggtagaaaccgggtcgtacggttaccggtaaccgtccgtacctaaggtaaactcggtaactaacggtaaaacgaacgtacggtacgtatccgttagaacgtaaatacggaaacgtatacccggaaacgtaaaacccggtagggaaccgtaaccgggtaccggttacgtaacgttacttacggtaatacgggtaacggtaaacgtggtaacttacggttaagggttacggggttattaaccggttacggaaccgggggtaaccggggttacgtaaacccggg

SEQ ID NO: 93016 - DNA, 707 bp, Homo sapiens
  misc_feature: GYAE6OF02FJWGP.18.78.H01.1.454.CMB.1.raw
  modified_base (306)..(306): a, c, t, g, unknown or other
  misc_feature (306)..(306): n is a, c, g, or t
  modified_base (418)..(418): a, c, t, g, unknown or other
  misc_feature (418)..(418): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttcctgttgctattttaaaaggtgtccagtgtgaggtgcagctgggtggaggtccgggggaggcgttggtccaggccgtggggggtccctgaactctccgtgtcgcagcctcgtgggttccaccttcagtcggctcgtgctatgcnctcgggtccgccgaggtcgttaccgggaaggcgtgggtacgggttgggttcgggtaccgttaagttaggaacgtacaaaacggctaaacgacgttacgacgtacagcaatangtctgcgtaggtagaagcgtacggttccaccgtctaccaaagaactagtaacttaaccgaaagtaaccgtacggtacgtacgtactacgtaactaaacgtacgaaaccgacgtaaccgttaaccgaaaaccggaaccggaaccgtaaccgggtaccgttaacgttaacgttaccgttacgtacgttaacggaacggttaacggtacgttaacgttacgttaacggtttaggggtaacgttacggtaaccgggaccgggttaaaccggggggtacgttaccgttaaccgg

SEQ ID NO: 93017 - DNA, 702 bp, Homo sapiens
  misc_feature: GYAE6OF02JDTTQ.18.78.H01.1.454.CMB.1.raw
  modified_base (290)..(290): a, c, t, g, unknown or other
  misc_feature (290)..(290): n is a, c, g, or t
  modified_base (678)..(678): a, c, t, g, unknown or other
  misc_feature (678)..(678): n is a, c, g, or t
  modified_base (682)..(682): a, c, t, g, unknown or other
  misc_feature (682)..(682): n is a, c, g, or t
  modified_base (684)..(684): a, c, t, g, unknown or other
  misc_feature (684)..(684): n is a, c, g, or t
  modified_base (686)..(689): a, c, t, g, unknown or other
  misc_feature (686)..(689): n is a, c, g, or t
  modified_base (691)..(702): a, c, t, g, unknown or other
  misc_feature (691)..(702): n is a, c, g, or t
tcagtacgagtatgcacgaccggtgctcgatttagtgtgagtagtttgggtttgggggtcgtttgcctgggtgctgttggtaccaggagacatagttataaccaccatctcctgcactggaaccagcagtgacgttggtggttataactatgtctcctggtaccaacagcacccaggcaaagcccccaaactcatgatttatgatgtcagtaatcggccctcgtaggggtttctaatccgtcttctacgtggcctccaagtctggccaacaccggtcctccctgaacccntcctctcggggccttccgaggctgagggaaccgaggggtcctgacttttaagttacctggtaccagtcctctaaactataaccgacgtaccaacccagccaacgttcctacgttagttcgttcccgttttaacgggaaaccgtttgggggaaaacccctaaggggtttccccaaaccccggtttaccccggtttagggtcccgaaacccggacccccgaaacgggaccccctaaaccccccgaccgttacggtacccctaacctttcccgttcccgttaccccctacccccttccttaaccccttaaccttaacgtttacccgtaccgtaccggtaacggcggggttaccgttaccgggaccgtaacgggccggtacctaagaccggntcgncncnnnncnnnnnnnnnnnn

SEQ ID NO: 93018 - DNA, 585 bp, Homo sapiens
  misc_feature: GYAE6OF02FHYKQ.18.78.H01.1.454.CMB.1.raw
  modified_base (463)..(463): a, c, t, g, unknown or other
  misc_feature (463)..(463): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (579)..(580): a, c, t, g, unknown or other
  misc_feature (579)..(580): n is a, c, g, or t
  modified_base (582)..(584): a, c, t, g, unknown or other
  misc_feature (582)..(584): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgccccaaactcatgatttatgatgtcagtaactcggccctctaggggttttctaatcgcttctctggctccaagtctggcaacacggccctccctgacccatctctcggctccaggctgacgggtacgagggtctagaactttacgttactgcacggctcatactaaccaagtcaccagcctactctctatcgtcgttacggaacgtcgggaaccaaggtaccaccgtccgtaggtccacgcccaacggcccaaccccnctcgtccacttcctcgtttccccgcccttccctacctaacttaaccgttaccgtaaccttcggacggccgggtcctacgggtaccaacgggccgtacaacgtaagcgctacncncnncnnnc

SEQ ID NO: 93019 - DNA, 761 bp, Homo sapiens
  misc_feature: GYAE6OF02H6US3.18.78.H01.1.454.CMB.1.raw
  modified_base (281)..(281): a, c, t, g, unknown or other
  misc_feature (281)..(281): n is a, c, g, or t
tcagtacgagtatgcacgaccggtgctcgatttagtgtgagtagtttggggtttgggggggggtctcaggaggcagcgctctcgggacgtctccaccatggcctgggctctgctattcctcaccctcctcactcagggcacagggtcctgggcccagtctcgccctgactcaacctgcctcgtgtctgggtctcctggcagtcgatcaccatctcctgcacgtcggaaccaggcaggtggacgttggtagttaatactatcgtctccgtacggtaccaacngccaaccacggaacaaacgacccccaaactacgactagtactttacgtgattcgtactaagttaacgtccggtacccttacggtacggggttttactaacgttcgtacttctcgtcggcctacgtaacgttcgttacggaccaaaccgacgggtcccctacccgtacgtaccctaacgtccgttaccggtcgggtaccgtacccggtagggtaccgtacgggaacgggtacgacggtaccgttaggttaactttaacgttaccgttacgtacgtacgttactacgtaaacgttaactaacgaaacgtacgaacggtaccaacggtacctaaaccgttacggtaaacgttccggttaaccggtaaccgggtacgggtaacccgttaacggtcccggttaacccgttaccggtaaccggttaccgacccggaacccgtaaccggaaccccctaacccgtacttacccggtacttaaccccgg

SEQ ID NO: 93020 - DNA, 643 bp, Homo sapiens
  misc_feature: GYAE6OF02JI2QD.18.78.H01.1.454.CMB.1.raw
  modified_base (500)..(500): a, c, t, g, unknown or other
  misc_feature (500)..(500): n is a, c, g, or t
  modified_base (636)..(636): a, c, t, g, unknown or other
  misc_feature (636)..(636): n is a, c, g, or t
  modified_base (642)..(643): a, c, t, g, unknown or other
  misc_feature (642)..(643): n is a, c, g, or t
tcagtacgagtatgcacgaccggtgctcgatttagtgtgagtagtttggtttgggggcggtttgccgtgggccgagtactgccctgactcagcctgcctccgtcgtctgggtctcctggacagtcgatcaccatctcctgcactggaccgagcagtgacgttggtggttataactatgtctcctggtaccaacagcaccaggcaaacgccccaaatcatgatttatgatgtacactaatcggccttcaggggtttcctaatcgcttctcgttggctaccaagtctcggcaacacggcctcctgaccatctcgttcgggcctccgtaggctcggagacggaggccgtggaatttacgttacgtggacagtcctcgtaattacgtacaacggccacgagctaacgtctactagttcgtcttacggaaacgtcgggtaacctaacggttccaccggtttacgtaacggttaccgacgtacccgaaacgacccgtaaacccccngtaccgtacaccgttcctaccggttccccgaccccgttccttacccaactttacccgtacggtaaaccttcgggaaccggtccggtaccggttcggaccgttaaacgggcctaacgtacgttacgcgacgtcaccnctcgcnn

SEQ ID NO: 93021 - DNA, 758 bp, Homo sapiens
  misc_feature: GYAE6OF02I03DE.18.78.H01.1.454.CMB.1.raw
  modified_base (250)..(250): a, c, t, g, unknown or other
  misc_feature (250)..(250): n is a, c, g, or t
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
tcagtacgagtatgcacgaccggtgctcgatttagtgtgagtagtttgggtttggggggggggtctcaggaggcagcgctctcgggacgtctccaccatggcctgggctctgctatcctcaccctcctcactcagggcacagggtcctgggcccagtctgccctgactcaacctgcctcgtgtctgggtctcctggacaggtcgatcaccatctcctgcacgtggaaccagcagtgacgttggtggttanaactatgtctcctgaccacaggccaccaggcaaccnccccaatcatgtaattangtatgtacagtaacgtccggtccctacggtagggtttactaacgttctccttcgtccgttggaccttacgaacgttcgtcgggtacctacccgttacgaccgttcccctacccgtacgggtaccctaaccgtcgtaccgtttcccgggaacccgttcccgtaacggggtacccgtgggtaacgggttacggttaacgggaaaccgggttcggtaacggttaacctttacgtttaacccgccggtaaacccgttacgttccgttaacgtacggtaaccctaagggtcgtacgggtaacgttcgggtaacggtttacgggttcggtttaacgtcgggttttacccgttagggtaaccgttcggttaacggggtaacccggtacggttaacccgttacggtaccgtttaacggccggtaacccggtacccggaccggttaacccctcccgttaccgg

SEQ ID NO: 93022 - DNA, 684 bp, Homo sapiens
  misc_feature: GYAE6OF02I3BKO.18.78.H01.1.454.CMB.1.raw
  modified_base (373)..(373): a, c, t, g, unknown or other
  misc_feature (373)..(373): n is a, c, g, or t
  modified_base (397)..(397): a, c, t, g, unknown or other
  misc_feature (397)..(397): n is a, c, g, or t
  modified_base (676)..(676): a, c, t, g, unknown or other
  misc_feature (676)..(676): n is a, c, g, or t
  modified_base (679)..(679): a, c, t, g, unknown or other
  misc_feature (679)..(679): n is a, c, g, or t
  modified_base (681)..(681): a, c, t, g, unknown or other
  misc_feature (681)..(681): n is a, c, g, or t
  modified_base (683)..(684): a, c, t, g, unknown or other
  misc_feature (683)..(684): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctctggtaccaacagcaccaggcaaacgcccccaaactcatgatttatgatgtcagtaactccggccctcgtaggggtttactaatcgtcttctctggcctaccaagtctggacaacgcggcctcctgaccatctcgtcgggcctccgaggtctaggacgggacgaggcttagtatttacgttactgactagtcctanaagttactacgaaagccaaccganacctacttccttactacgtttcgttacgtttaaccggaacgttacgggaaaccctaacggttccctaaccccggttaccgttaacgggtccaaccggaccccgaaacggtacccccaaaccccgttcgttaccgttacctaaccctttcccttacccgtttacccccacccccgtttccctaaccgtaacctttacccgttacccgttaacgtacggtacgggccgggtcccttacgggaaccggtacgggcccggtactaacgtaggcctagccgtangcncncnn

SEQ ID NO: 93023 - DNA, 669 bp, Homo sapiens
  misc_feature: GYAE6OF02I7JVF.18.78.H01.1.454.CMB.1.raw
tcagtacgagtatgcacgaccggtgctcgatttagtgtgagtagtttgggtttggggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatcctcctgcactggaaccagacagtgtacggttggtaggttataactatgtctcctggtaccaacagccaccagaccaaacgacccccaaactcactgtactttagtagtatacgtactaactaacgtccggacccttcggtaacggggttttacctaaagttccgttcctttccgtcgttacggacctaccgtaagttccgtacggaccaacgacccggtcccttaccccgtacgaccctactttccgtccgttcgggtaccctccggacggtcgtacgggacggtaacggacgggtctaggttaactttaacgttacgtcgactacgtcctactaactacgtaacaacgccaccgtaagctactctaccttagtcgttacgtacggtacgacggtaaccgacgtaccgaccgttacgtacggcaccgacccgaaccgacccctacccatacccg

SEQ ID NO: 93024 - DNA, 620 bp, Homo sapiens
  misc_feature: GYAE6OF02HQUBP.18.78.H01.1.454.CMB.1.raw
  modified_base (403)..(403): a, c, t, g, unknown or other
  misc_feature (403)..(403): n is a, c, g, or t
  modified_base (589)..(589): a, c, t, g, unknown or other
  misc_feature (589)..(589): n is a, c, g, or t
  modified_base (605)..(605): a, c, t, g, unknown or other
  misc_feature (605)..(605): n is a, c, g, or t
  modified_base (611)..(620): a, c, t, g, unknown or other
  misc_feature (611)..(620): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacggttggtggttaataactatgtctccgtggtaaccaacacgccacccgaggacaaaccgacccccaaactcatgtatttaatgatgtcaactaagtccggcctacgtacggggtttactaacgtcgtcctttctcgtcggcctaccgaagtcgtggaccaaccgaccggcccctccgttagaccctagttctccggttcggcctacgcggcgtaggaagggacgaacggtctagttacttaattacgngacgacgcctacaactaagtacaacaccgaactcactacttctacgtagtcgtctaacggaacggtcgaaccgtagcctaccgtcgtacgacgaccgaccgtaacgacccctaccctagtacctcctacgtccgttccgccccctaccctacccgtacgtattacccgtgtaccgtgacgggcgtnacggactacgggctanacgtannnnnnnnnn

SEQ ID NO: 93025 - DNA, 626 bp, Homo sapiens
  misc_feature: GYAE6OF02H9G7H.18.78.H01.1.454.CMB.1.raw
  modified_base (615)..(615): a, c, t, g, unknown or other
  misc_feature (615)..(615): n is a, c, g, or t
  modified_base (617)..(618): a, c, t, g, unknown or other
  misc_feature (617)..(618): n is a, c, g, or t
  modified_base (620)..(626): a, c, t, g, unknown or other
  misc_feature (620)..(626): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagccaccaggacaaacgacccccaaaactcatgatttatgatgtcagtaatcgccctcgtaggggtttctaagtcgtcttcctctcggcctaccgtaagtcgtggaccaaaccgccggcccttccctacgacctatcctcgtcgggcctccgaggtctggaacgggacgaggtctagtaatttacttactgcacgcctacaatataacaagcacgcacgacacctacgaacgtttcgttaccggaacggtacgggtaaccgtaacggtccgtacccggtaccgttaggaccgaaccgacccgaaacggaccctaaaccccgacttaccgtcctaaccgtcctacccgttcccctacccctcctaccctacttacctacgttacgtcgcggaccgggtcgtacggaccgaacggcgcgtacgtacgncnncnnnnnnn

SEQ ID NO: 93026 - DNA, 786 bp, Homo sapiens
  misc_feature: GYAE6OF02I6B3Y.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacgaggagacttcaccagtgggaggtttgggctgtagctttggggttttccttggtttgacttaagtttttaaaaggtgtacctagtgtggtagggtgcgagtcgtgggtgggtacggtccggggggaggtcgttcggtcacggccggttggggggtcccctagaaccttccgtccgttagtcgcgtacgccgttcggttcggtttacctaccttcgtaggtcgggaccttcgttcggacttagttgtaccgtaccggttaccgggtaccccggaccggttacgggtacccgggtttaaccggggggtaaaacggccggtttagggggtacgggttttcgggggttacgggtaccgtttaaagttaaggaaacggttaacgaaaacgtcgtaaaacgttagtaacgacaacgtacagatagtagtcgtagtccgggtagtaagggaacggtcaccggttacgaccgtttaccaaccgtaagtaagtctaagtaacgaaacgagaccggtaagtacttcgtaactaataaaggtaccaaggtaaccacgtaaagaaccgaaacgcgaacgttccgtattactacgtacgtagtacgtagtaaggtacgtaggttaagttaggtaggttagttcaacgggtacggtaaacgggtcgtaggttaacg

SEQ ID NO: 93027 - DNA, 548 bp, Homo sapiens
  misc_feature: GYAE6OF02HV52M.18.78.H01.1.454.CMB.1.raw
  modified_base (317)..(317): a, c, t, g, unknown or other
  misc_feature (317)..(317): n is a, c, g, or t
  modified_base (333)..(333): a, c, t, g, unknown or other
  misc_feature (333)..(333): n is a, c, g, or t
  modified_base (360)..(360): a, c, t, g, unknown or other
  misc_feature (360)..(360): n is a, c, g, or t
  modified_base (443)..(443): a, c, t, g, unknown or other
  misc_feature (443)..(443): n is a, c, g, or t
  modified_base (529)..(529): a, c, t, g, unknown or other
  misc_feature (529)..(529): n is a, c, g, or t
  modified_base (534)..(534): a, c, t, g, unknown or other
  misc_feature (534)..(534): n is a, c, g, or t
  modified_base (544)..(544): a, c, t, g, unknown or other
  misc_feature (544)..(544): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaaactcatgattttatgatgtcactaatcggccctgtaggggtttctaatcgctttctctggcctccaagtctggcaacacggcctcctgaccatctcgtgggccncgaggctgacggacgnggctagattactacgtgcagctcatanacaagccacgagcactctctatcgtcgttacgacgtgggaccaacgtcaccgtcgtacgtacacgtaccaacggacccacccncgtcgccacctctccgttacccaccctcctaccactccttacgtacgtgcggcgggtctggtaccaacggcgtaccaagtaggtcngtcgncgtcgatagntacg

SEQ ID NO: 93028 - DNA, 923 bp, Homo sapiens
  misc_feature: GYAE6OF02HLCQ7.18.78.H01.1.454.CMB.1.raw
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagctgggtttcctgtgctatttaaaaggtgtccagtgtgaggtgcagcgtggtgggaggtccgggggaggtcgttgggtccaggcccggtcgggggggtcccctaggtaaaccttccgtcccgttggtcgccgacgccttcgttcggggtttaccaaccctttcgaaggttcgggtccttccgtggtccttaagtcggtacccgtaacggtccgggggttccccgcccgtaggggtcccggtttaacccggggggaaacggggtccgtaggggtacgggttcgggggttcgggtaccggttaagttaaggaacggtacgaaaacggtaccttaaaacgtacgggtttaacggaccggtaacgacggtacaacgttaagtcggtaccttagggtccgggttacggggtaaggaaaacgggtccggtaaccgggtttaccgtaaccccgttaccgtaacccgtaaaggtaaacgtagtaacgttaaccggaaaacggtaaccgtaaccggtaccgttaacgttccgtaacgtaaacgtaaacgtaacgaaaccgtaaccggacccgtaaacggaaaacccggtaacgggtaaccggtaaccgggtacccgttaaggttaaccgtttaccgtacggttaaaccgtacggtaaaccggttaacgggttacgggttaaacgtttaaccgggttagggtttaacggggggttacggtttaaacgggttacccggggttaacggggggtaaaccgggggggtttaccttaaaccgggg

SEQ ID NO: 93029 - DNA, 659 bp, Homo sapiens
  misc_feature: GYAE6OF02FSGEV.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggaggtccgggggagacgttggtccagccgtgggggtccctagaactctcctgtgcagcctcgtgggtcaccttcagtggctctgctatgcacgtgggtcccgccgagggccgttccggggaaagggctgggagtgggttggccgttatagagacaaagctaacgagttacgcgaacagcagtatgctgcgtacgggtagaaaggcgtaggttacacccgtctaccgaagaaactagtaacttaacgaaaagtaaccgacggtaccgtacttcgacgacgtaaatacggaaacacgaccgtaacggaaaaccgaaccggacgaccggaccgttggttaacttacgtacgttacgtacggaacggtagggtagtaacttaacgttagggtttagggggtaagtttacggtaccggtaaccggggtaaacggggggtaccgtaacggtaacggg

SEQ ID NO: 93030 - DNA, 768 bp, Homo sapiens
  misc_feature: GYAE6OF02GU9J5.18.78.H01.1.454.CMB.1.raw
  modified_base (313)..(313): a, c, t, g, unknown or other
  misc_feature (313)..(313): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcaggcacagggtcctgggcccagtctgccctgactcagcctgcctcgtgtctgggtctcctggacagtcgatcaccatcctcctgcactggaaccagcagtgacgtttggtggttaataacgtatcgtctccgtggtaccaacagcaccgaggcaaacgcccccaaactcatagtatttangagtgtacactaactcggcctcgtagggtttctaactcgtcttctctgctcgaagtcgtgacaacgaccggtccctccctacgacctacgttccgtaccgtcgggtacccttaccggacgggtctacgggaacgggtacggtacggtcgttacggtaactttaacgtttaaccgtcgtaaccggtactacctacgtaacgttaacttaaaccgtaaacccggaccctaaacccgaaccggtacccttaacccgtttccctttaaccgttaaccgtttacccgggtttaaccgtttacccggggtaaaccggtttaacccggggtaaacccgttaaaccgggttacccccgtaacccggttttaacccggaacccgggtttaacccgtaaccccgggtaaccccccggttaaaccgggtaccccccccgtaaacccgtacccgggtttaaccccgg

SEQ ID NO: 93031 - DNA, 863 bp, Homo sapiens
  misc_feature: GYAE6OF02HHG7K.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagtcgttgggttttccttgttgtcttaattttaaaaggtgttccagtgtgaggtgcagcgtgggtggagggtccgggggaggtcgttggtccaggtccggtcgggggtccctaggaaacctcctcctgtgcgacgtccgtcgttcgggttcctaccgttcgtacggtcggtcttcgtcgtcgtatcgcctaccggtcggtccccgccgtacgggtcccggttaccgggggaaacggggtccgttagggggtacgggtttcgggggtttcgggtacccggtttaaggttacggaaaggtaacgaaaacgtaccgtaaacgtaacggttaaccgtacgaacgtaacggacctaagttacgtaccggtcgtacggtccgggttacggtaaacgggtaaacgggtacgtaaccggttacccgtacccgttaccctaacggtaaacgtaagttagtaaaacgttaaacccgaaaaggtaacccgtaacgggttaccggtaaacttcggtaaccgaaacgtaaacgtacgaaaccgtacggtaaccgttaaaccgggaaaaccgtacggaaccgggttaccgaccggtttaagttaaccgttagtaccggtacgtaacggtaggacgggttactaaggttacggtaacgggttttaggggtactttacggggaacgggttaaccggggggttaaacggggtacctaccggttaaccgg

SEQ ID NO: 93032 - DNA, 821 bp, Homo sapiens
  misc_feature: GYAE6OF02JG11E.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagcgtgggtttccttgttgctatttaaaggtgtccagtgtgaggtgcagctggtggagtccgggggaggcgttggtccagccgtgggggtccctgaactctcctgtgcacgcctcgtcggttcaccttcgagtggacctcgtgactagtgctacgtcgggtccgaccgaggtccggtaccgggaaagggtccgtagggacggttcgggggttcggtaccggttaagttaacggaacggtaccgaaaacggtacctaaaccggaacggtttaaccgggaccgtaaccgtaacggacgtaaacgttaacgtcgtacggttacggtaccggggttacggggttacgggaaaacgggtcccgtaacgggtttacccgtaacccggtaccgttaccgtaaaggtaaacgttacgtaacgttaaccgaaaaccggaaaccggtaacgggtacgttaacgtaccgtacggtaacctaaacgtaacgaaacgtacgtaaccgtaacggaaaaccgggacggaaccgaaccgggtacgttacgttaacgttaccgtacgttaccggtaacgtaacggtaacgggttacggtaacgttaaccggttagggttttacggggtagttacggttaccgggtaaccgggtaaccgggggggttacccttaacgggttaaccggg

SEQ ID NO: 93033 - DNA, 847 bp, Homo sapiens
  misc_feature: GYAE6OF02I0FHR.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttggctgagcttggtttccttgtgcttagtttaaaggtgtccagtgtgaggtgcagcgtggtggacggtccgggggagtcgttggttcgacggccggttcgggggtccctagaaaccgtcctccgtgtgcacgtcctcgttcgggttccaccgtttcaaggtcggaccttcgtcgtacgtatccggacctacggttccggggtcccgcccgtacgggttccggtttaaccggggaaaagggtccgtaggggtaacgggttcgggggtttacggtacccggttaagtttaacggaaacggacgtaaaacggtacctaaacgtacggttaaccgaccgtaacgacgtactaacgttactacggtccgttacgggtaccgggttacggtaacgggtaaacggtccggtaacgggtttaccccgaacccgttaccggtaaccgaaacggttaaacgtacgttaaacgtttaaaccgaaaaacggtaaacccgtaaccgggttaaccgttaacgtaccgtacgtaaaccgtaaaacgtacgtaaaccgacgtaacccgtaaacggaaaacccgtacgggaaccgtaaccggtccgtaagtaacgttacgtacgtactacggtacggtacggtacgtaacgttaggtacggtttagggaacgtttacggaccggtaaccggggtaaacggggttacctacggttaaccgg

SEQ ID NO: 93034 - DNA, 871 bp, Homo sapiens
  misc_feature: GYAE6OF02GTUF1.18.78.H01.1.454.CMB.1.raw
tcagtacgagtatgcacgaccggtgctcgatttagtgtgagtagtttgggtttgggggcgtctgggagaggagctccagccgttgggattcccagctgtctccactcggtgatcggcactgaatacaggagactcaccatggagtttgggctgagcgtgggttttccttgttgcttattttaaaggtgtccagtgtgaggtgcagcgtgggtggaggtccgggggaggtcgttggtccgaggccggtcggggggtccctagaaactcgtcctgtgcacgcctcgtggttcctaccttcgaggtcggtctcgtgtctagtcgccacgtcgggtccgccgaggtccggttaccggggaacggtcgtagggtaggttggggttacggtaccgttaagttaacggaacgtaacgtaaaacggtaccgttaaacgtaaggttaaccgaccggtaacaacggtacctaaaggtaacgtcggtacggttcggtaaccgggttacggggtaacgggtaaaacgggtcggttaacccgggtttacccggtaaccccgtttacccgtaaccggtaaacggtaaacgttaacggtaaacgtttaaaccggaaaaaccggtaaaccggtaaccgggttaaccgttaacgttaaccgtaacgttaaacgaaacggttaaccggaaaccgtaaccggtaaccggttaaaaccggaaaacccggggaaaccggtaacccggtaccgggttaacccgttaacggttaacgttacgtaacggttaaccgtaacggtacggtaacggttacgttacggtttaaccggtagggtttagggtacgttacggacgggttaaccggggtaacggggttactaacggttaccgg

SEQ ID NO: 93035 - DNA, 625 bp, Homo sapiens
  misc_feature: GYAE6OF02FXX9U.18.78.H01.1.454.CMB.1.raw
  modified_base (198)..(198): a, c, t, g, unknown or other
  misc_feature (198)..(198): n is a, c, g, or t
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
  modified_base (269)..(269): a, c, t, g, unknown or other
  misc_feature (269)..(269): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctcgtgtctgggtctctggacngtcgatcacatctctgcactagaaccngcagtgacgttggtagttataactntgtcttccgtggtaccaanagccacccaggaccaaacgcccccaaatcagtgtatttatgatgtctaagtaagtccgtccgtacgtacgggtttactaatccgtcttctcgtcgctcaagtcgtcgacaacgccggtcctacccgtagaccctattcctcgtcgggtcctccgaggtcgtaggacggacgaaggtctacggtatttatttaacgctacgacgttacctgtaatacctaagaacgtacgaacgtccgaacgtcctaacgttaccgtaagttccgttaaccgggaacgtacgggaaccgtacggtacctaccggttcctacggtacgaccgacccgtaacgacccctaacccgattcgtccgtaccg

SEQ ID NO: 93036 - DNA, 738 bp, Homo sapiens
  misc_feature: GYAE6OF02HRCXV.18.78.H01.1.454.CMB.1.raw
  modified_base (601)..(601): a, c, t, g, unknown or other
  misc_feature (601)..(601): n is a, c, g, or t
tcagtacgagtatgcacgaccggtgctcgatttagtgtgagtagtttgggtttggggggggggtctcaggaggcagcgctctcgggacgtctccaccatggcctgggctctgctattcctcaccctcctcactcagggcacagggtcctgggcccagtctgccctgactcaacctgcctccgtgtcgtgggtcctccgtggacagtcgaatccaccatcctcctgacaacgtagaaccacgcacgtgtacggttggttagttaataactactacgtctccgtacggtaccaaacacgtccgaacccgaggtaccaaaaccgacccccaaactctatacgtaatttagtagtattcgtaacgtaagttaacgtcccgacccgttacgtaggggttttacaacgtccgttacttcgtcgttcgaccttacgtaagtcgacggaactaacgacccggtaccctaccgacgtaacctccgtacgtaccggtcgggtccctaaccggtggttaccgggtagtaaccgggagtacggtacctagttaaatttacgtaactcggactacgaactactagtaacttaaacgacacgtaacgccgtaacnccttaacggaacctaaacggttccgtaaaccgggtacgtaacggggtaccctaaaggtcccggtaaacccgttcggtaacggttacccgaacggaacccgaccggtaaccccaaccgtaacttccgaccttaacccg

SEQ ID NO: 93037 - DNA, 809 bp, Homo sapiens
  misc_feature: GYAE6OF02H88A7.18.78.H01.1.454.CMB.1.raw
  modified_base (793)..(793): a, c, t, g, unknown or other
  misc_feature (793)..(793): n is a, c, g, or t
  modified_base (797)..(797): a, c, t, g, unknown or other
  misc_feature (797)..(797): n is a, c, g, or t
  modified_base (799)..(799): a, c, t, g, unknown or other
  misc_feature (799)..(799): n is a, c, g, or t
  modified_base (803)..(803): a, c, t, g, unknown or other
  misc_feature (803)..(803): n is a, c, g, or t
  modified_base (808)..(809): a, c, t, g, unknown or other
  misc_feature (808)..(809): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtgttataactatgtctctggtaccacacgacaccaggacaaacgcccccaaaactcatgtatttatgatgtacagtaacgtccgccctcggtagggtttactaatccgtcttctcgtcggtacctacgtaacgtcgtcggaccaaccgtacccggccccttccgtacgaacccgtattccccgttcggtccgggtacctaccggagggtccttagggaacgggtcgggacggtgtacgttaacgtttaacgtacgtcgacgtacgtacccgtataataacgttaacgaacgacaaggcctacgactaccgttaacttaacggttacccgtttaaccggggaacggttaaccgggggtaaaccctaaccgggtttaccccgaacccgggtttacccggttacgggtacccgtaaaccccggtaacccgggaaacccggttaaccccccaaaccccggttacgttaccgttacccgttacccgttaaccgtttcccccggtaacccccttacccccgtttaccccgttacccttaacgttaaccccgtttacgtacccgggttacgggaccggggtcccgggtttaccggaccgggtaacgaaccggtccggtaacttaaccggtacgctaacgngtcncncgcncgtcnn

SEQ ID NO: 93038 - DNA, 193 bp, Homo sapiens
  misc_feature: GYAE6OF02JELA3.18.78.H01.1.454.CMB.1.raw
  modified_base (173)..(193): a, c, t, g, unknown or other
  misc_feature (173)..(193): n is a, c, g, or t
tcagtacgagtatgcacgaccggtgctcgatttagtgtgagtagtttgggtttggggggaagaggaagactgacggtccccccaggagttcaggtgctgggcacagcggccctgggctgcctggtcaaggactacttcccatactcgtactgagcgggctgggcaaggcgcannnnnnnnnnnnnnnnnnnnn

SEQ ID NO: 93039 - DNA, 845 bp, Homo sapiens
  misc_feature: GYAE6OF02FXAYB.18.78.H01.1.454.CMB.1.raw
  modified_base (230)..(230): a, c, t, g, unknown or other
  misc_feature (230)..(230): n is a, c, g, or t
  modified_base (258)..(258): a, c, t, g, unknown or other
  misc_feature (258)..(258): n is a, c, g, or t
tcagtacgagtatgcacgaccggtgctcgatttagtgtgagtagtttgggtttggggggggggtctcaggaggcagcgctctcgggacgtctccaccatggcctgggctctgctattcctcaccctctcactcagggcacagggtcctgggcccagtctgccctgactcagcctgcctcgtgtctgggtctcgtggcagtcatcacctatcctctgcctactcggaaccngcagtggtacgttggtagttaataactntgtctcgtcgtaaccaacgacgaccaccgaggacaaaccgacccccaactctatacgtatttagtcgtatcgtacaacgttaacgtcccggtacccgttacggttacggggttttactaacgttccgttacctttccgttacgttcgggccctttacgtaacggttcgtacggaacctaaccggccggtcccctaccgtacgaccttacgtaccgttcggtacgggcccttacgggacggtcgtaggggaaccgggtaacggtacggtacgttacggttaacgttttaacgtttaccgtcggaaccggtacgttaccctaacgttaaattaaccgttaaaccgaacccggtaccctaaacccgtaacggttaccccttaactttacccgttacgttaacgggttttacccgggttaccggtttaacccgggggtaaccgggttaacccgggggttaaaccccgaaaccgggtttacccccggttaaaccccggttaccgggtttaaacccggggtcccttaaaccccgggaaacccccgggtaacccccggttaacccccgtaaaccccccgttaacggttacccgg

SEQ ID NO: 93040 - DNA, 681 bp, Homo sapiens
  misc_feature: GYAE6OF02HVY0W.18.78.H01.1.454.CMB.1.raw
  modified_base (248)..(248): a, c, t, g, unknown or other
  misc_feature (248)..(248): n is a, c, g, or t
  modified_base (354)..(354): a, c, t, g, unknown or other
  misc_feature (354)..(354): n is a, c, g, or t
tcagtacgagtatgcacgaccggtgctcgatttagtgtgagtagtttggggtttgggggggggtctcagggaggcagccgctcctcggggacttcctccacctatggcctgggctctgctattcctcaccctctcactcagggcacgagggttcctgggcccagtctgcccttgactcaacctgccttacgtgtcctgggtctccgtggacagtcgatcgaccatctccgtgctacgtagggaaccgngcagtcgtacggttggtagttaactaactagtcgttcctccgttggtaaccaacgacgccgaacccgaggaccaaacggccccccaaactcgatcgtaagtttagngtatcggtcgaagtaacgtcggtaccctacgtaggggtttactaacgtcgtacttctacgtcggcctacgagtccgtcggacaaccggaccgtccctccgtacgaacctacttccgtcgtacgggcctacgagggtactaggaacggacgagtactagttactttactacgtgacagtacctactactaacaagaaccgaccaaccgagtaccgtacttcttagtactaccgtccgttacggtaccgtacggaaccgtaacggtacccctacggtaccttacggcctaaccgacccgtaaccggccccaaccgttacgtcgtacccg

SEQ ID NO: 93041 - DNA, 668 bp, Homo sapiens
  misc_feature: GYAE6OF02G3X6G.18.78.H01.1.454.CMB.1.raw
  modified_base (493)..(493): a, c, t, g, unknown or other
  misc_feature (493)..(493): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggtttccttgttgctattttaaaaggtgtccagtgtgaggtgcagctggtggagtccgggggaggcgttggtccgagccgtggggggtcccctgaaactctcctgtgcacgcctcgtgggttcaccttcagtggctctgctatcgcacgtcgggtcccgccgacggtccgttaccggggaaagggccgtgggaggttggggttcggccgttagttaggaagacgaaaagctaaacagttaacgcgaacagacatagtgcgtgcgtacggtgaaaggcgaggttaccgaccggtactacaacgaaatagattacgaaagaacacggtacgtatcgtanacaaatacgaacacgaccgtaacggaaaaccgtacggaaccgaacggtaccggtacgttaacgttacgtacgttacgttaagtacgaacgggttagtaacgttaacgtagggtttaggggttaacgttacggtaccggtaacgggtaaacggggggttaccgtaaccgtaaccgg

SEQ ID NO: 93042 - DNA, 966 bp, Homo sapiens
  misc_feature: GYAE6OF02IQK93.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgcttatttaaaggtgtcagtgtgaggtgcagcgtggtggacggtccgggggaggcgttggtccgaggccgtcgggggtcctagaactctccgtgtcgcacgccttcgtcgggttcctaccgttacgaggttcgggccttcgtacggtcttagtcgtaccgtaccggttcggggtccccgacccggtacgggtaccgggtttaccgggggaaaaggggtccggttaggggtcgggttagggggtttacgggtaccggtttaaggtttaacgggaaacggtaaccggtaaaaacggtaccgtaaaacggttaacgggttaaccggacggaaacgtaacggtaactaaacgttacggttacgtaccgttacgggtaccgggttaaccggggtaacgggtaaacggggttaccgttaaacggggtttacccgtaaccccggttacccgttaaaccgtaaacgggtaaacgttaacgtaaacggtttaaaccaaaaacgggtaaacccggtaaccggggttaacccgttaaacgttacccgtaacggtaaacgtaaacgtaaaccggtaaacgtaaccggttaacccgaaaaccggggttaaaaccgacggggtaaaccccgtaaccggggttaaccgtttaaacggttaaccgtttaaccgttaagttaaccggtaacggtaaccgggtaagggttaccggttaacggttaacggtttaaggggttaacggggttaaggttaaccgggtaaccgggttaacggggggtaacccgggggtttaacgtaaccggttaaccggg

SEQ ID NO: 93043 - DNA, 751 bp, Homo sapiens
  misc_feature: GYAE6OF02H4N2Z.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggtttccttgttgctaatttaaaggtgtccagtgtgaggtgcagctggtggaggtccgggggaggtcgttggtccaggccgtcggggggtccctaggaaaccttctcctgtcgacagtcctcgttcgggttcctagttttcaggttcgtacccttacgtggacttggctacgtggtactcccggtaccgtaacgttccggaaggaaggacgtacgtgggtggttgggtcctacgtacgtaattaaagtagtagaggtggggtcgaccacgtatccgtacggcgactcggcggacggggccgtcttaccgacctagtcccgtcccgaagtaaccaaacaaccgtaaacgaacctacgctagttactcgtacgaactaaagtcgaacgtaccgtagttccggtaggggaggtacggaacggtacgaacgggtcctagttaacgttaacgttacggtacggttacggaccggtaaaaggggtccggggttaccgtaaaccggggttccgttaccgggttaacgggggttaccggggtttaccgggtaccccgggtaacccccgggggttaccggggaccccggttaaaccccgggggg

SEQ ID NO: 93044 - DNA, 696 bp, Homo sapiens
  misc_feature: GYAE6OF02HAQIJ.18.78.H01.1.454.CMB.1.raw
  modified_base (189)..(189): a, c, t, g, unknown or other
  misc_feature (189)..(189): n is a, c, g, or t
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (680)..(680): a, c, t, g, unknown or other
  misc_feature (680)..(680): n is a, c, g, or t
  modified_base (685)..(685): a, c, t, g, unknown or other
  misc_feature (685)..(685): n is a, c, g, or t
  modified_base (691)..(691): a, c, t, g, unknown or other
  misc_feature (691)..(691): n is a, c, g, or t
  modified_base (693)..(693): a, c, t, g, unknown or other
  misc_feature (693)..(693): n is a, c, g, or t
  modified_base (695)..(696): a, c, t, g, unknown or other
  misc_feature (695)..(696): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaanagcacccaggcaaagcccccaaatcatgtatttangatgtcactaancggtccctcgtagggttttctaatcgcttctctggcctccgaagttcgtgacaacgaccggtccctccgtagaccctatccgtcgtacggcctaccgaggctaggacggtacgaggtcctagtactttaagtctggcacgtcttactacggtaactacgaaacgccaaccgacgtctaacctttcgttctaacgtttcgttaccgtttacggggtaaccgtccggggtaaacccttacgggtacccttaacccggttacgttaacggtccaacccggacccgttaaccgacccccgttaacccttaccggtcttaccgtaccgtttaccgttacccccgttacccctaacccccgtttacccgaacccttaaccgttacccgttaaccgtccggtaacggtccgggacgtccgggtacgaccggtaacggctaaaggtctagcncgtancacgtncngnn

SEQ ID NO: 93045 - DNA, 716 bp, Homo sapiens
  misc_feature: GYAE6OF02I6PSD.18.78.H01.1.454.CMB.1.raw
  modified_base (181)..(181): a, c, t, g, unknown or other
  misc_feature (181)..(181): n is a, c, g, or t
  modified_base (184)..(184): a, c, t, g, unknown or other
  misc_feature (184)..(184): n is a, c, g, or t
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
  modified_base (311)..(311): a, c, t, g, unknown or other
  misc_feature (311)..(311): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctctcactcagggcacagggtcctgggcccagtctgccctgactcaacctgcctcgtntcnggtctcctggacngtcatcaccntcnctgcactggaccagcagtgtcgttggtagtaataactatgtctcgtaggtaaccacacgccacccaggacaaaccgaccccaaactcatacgtaatttagngtatgtacaagttaaccgcggtcccgttacggttacggggtttactaacgtccgtctttctcgtcggtacccttacgaacgtccgtcggaactaaccggtcccgtccctacccgtacacctacgttccgtacgttcgggtaccttacccgaagggttcgtaacgggacgggtaaccgtaccgggttagtaacgtttaacgttaactttccggtaacgtacgtaacgtccgttaactaacttaaaccaacggtaaacgaccctacgaccgttaacctacttcgttacttacgtcgtttaccgtcggtaacgtccgggaaccgttaccggtacgtcccgttacgggtaccgtaccgaacccggtacccgaaacccggtaacccccaccgttaggttacccgtacccg

SEQ ID NO: 93046 - DNA, 598 bp, Homo sapiens
  misc_feature: GYAE6OF02GAHOB.18.78.H01.1.454.CMB.1.raw
  modified_base (231)..(231): a, c, t, g, unknown or other
  misc_feature (231)..(231): n is a, c, g, or t
  modified_base (589)..(589): a, c, t, g, unknown or other
  misc_feature (589)..(589): n is a, c, g, or t
  modified_base (595)..(597): a, c, t, g, unknown or other
  misc_feature (595)..(597): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtnagtaactccggccctgtaggggtttactaactcgcttctctggcctccaagtctggcaaccgaccggccctcctcgacctattcctcgttcgggccttccgaggtcgtaggacggacggaggtctgaactttagttactcgcgactctctaataactaacgaacgctacgacacgcctactacgtaacgtcgttacggaacgtacgggacaacggtccgtaaacgtccgtaggtacacgacccgaacgaccccaacctctctaccgaccttcctccgttcccacccttccacctacttccgacgttactccggacggtcggactacgggaccgacgtccgtcgagttacggcagcacncgctgnnnc

SEQ ID NO: 93047 - DNA, 753 bp, Homo sapiens
  misc_feature: GYAE6OF02JFCNK.18.78.H01.1.454.CMB.1.raw
  modified_base (390)..(390): a, c, t, g, unknown or other
  misc_feature (390)..(390): n is a, c, g, or t
  modified_base (416)..(416): a, c, t, g, unknown or other
  misc_feature (416)..(416): n is a, c, g, or t
  modified_base (702)..(702): a, c, t, g, unknown or other
  misc_feature (702)..(702): n is a, c, g, or t
tcagtacgagtatgcacgaccggtgctcgatttagtgtgagtagtttgggtttgggggtcgtttcgtcctggacccagtctgccctgactcaacctgcctccgtgtctgggtctcctggacagtcgatcaccatctcctgcactggaacagcagtgacgttggtggttataactatgtctcctggtaccaacagcaccgaggcaaacgcccccaaatcgatgtatttatggatgtacactaagcgccctcgtagggtttctaagtcgtcttcgtcttacgggcctaccgtaagtcgttcgggaccaaaaccgtcccgggcccttcccctggtaaccccattccgtcgtcggggtaccttccgaagggttcctagggaacggtacgacggnttacgacttttaattccgtggtaccngtacctactactaaacgttacgacggaacccaccggatcctaacctacgttttacaacgtttcgggtaaccgtttacgaaccggttacgggaaccaacgggttacctcccggttacgtaccggtagacccgtacccgtacggaaccccaaccccttaggtccctccgttaacccgtcttaccccggtttacccctaccccttcccttacccgtaccttaccgttaaccgggtttcctaacgggtaccggtccgggacccgtttacggaaccgggtacccggtaccncggttaacaacggttcccgaagtcggttaacgcgaggttacctgacctacg

SEQ ID NO: 93048 - DNA, 786 bp, Homo sapiens
  misc_feature: GYAE6OF02JD0RX.18.78.H01.1.454.CMB.1.raw
tcagtacgagtatgcacgaccggtgctcgatttagtgtgagtagtttgggtttggggagctctgggagaggagctccagccttgggattcccagctgtctccactcggtgatcggcactgaatacaggagactcaccatggagttggctgagctgggtttccttgttgtctaatttaaaggtgtccagtgtgaggtgcagtcgtggtggacggtccgggggaggtcgttggtccgacggtccggtcggggggtccctacggtaaacctccgtccgtgtcgcgtacgtccgttcgttcgggttcctaccttcgtaggttcgctcgtcgcttactcgcctacggtcgggtccgccgtacgggtccggttaccggggaaaggtcggtacgggtacggttcggggttcggtaccggttaagttaacggtaaacggaacgtaaacgtaccgtaaacgtaacggtttaaccggacgtaacgtaacgtacgtaagttacgtacgtacgtcgtacggtacgggtaaggtaaacggtcgtacggttaccgaccgttaccgtaccgtaaagtaaactagtaacttaacgaaacgaccgtaacggtacttacgtacgtacgtaacgtaaacgtacgaaacgtacgtaacccggtaaacgaaaaccggacgtaaccgtaaccgtacggttaagtaacgttaacgtagtaaccgtaaggtaacggtaaggtggttaacgttacgttagggttacgggtacttacggtacgggtaacggggtaaccggggttataaccgg

SEQ ID NO: 93049 - DNA, 708 bp, Homo sapiens
  misc_feature: GYAE6OF02JLF1F.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcacctgaatacaggagactcaccatggagtttgggctgagctgggttttccttgttgctatttaaaaggtgtccagtgtgaggtgcagctggtggagtccgggggagtcgttggtccagccgtggggggtccctggaaactctcctgtcgcagcctcgtggttcacctcagtggctctgctagtgcctacgtcgggcccgaccgagggtccgttacccggggaaagggcgttagggacggttgggtcggtccggtaattacggagtacaaaagtcctaaagagttacggacgaccgaagcaaatattcggactgggccgtacgggttagaaacggcgtacggtcgtaacccgtccgttacccgaaagtaaacgtacgtaacgttacgaaaacggaaaccgtaaccgggtacgttacgtacgtaacgtaaacgtaaactaggaaaccaacgtacccgtaacgaaaacccgggtaaggaacccgtacgggaccgttacgttaacgttaacgtagtactacgaacgtggaagtacttacgaggtttaacggggtagttacgtaccggtaacgggtaacggggtacgttagtaaccgg

SEQ ID NO: 93050 - DNA, 585 bp, Homo sapiens
  misc_feature: GYAE6OF02IG196.18.78.H01.1.454.CMB.1.raw
tcagtacgagtatgcacgaccggtgctcgatttagtgtgagtagtttgggtttggggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcaccaggacaacgcccccaaatcatgatttatgatgtcagtaatcggcctcgtagggttctaatcgtcttctctgtctcaagtctggacaacgaccggcctccctgacctatctcgtgggcctcgacggcgtaggaggacgaggtctgtaattactacgtgacacgctacataactacaacgtacagacacgactactacgtaaacgttccgtacgggaacgtacggggaacccgtaacgggtcccgaacccggttccgtaaggtccaacgaccccgaacggaccccaacccctacgttccgacctacccg

SEQ ID NO: 93051 - DNA, 652 bp, Homo sapiens
  misc_feature: GYAE6OF02FTN0O.18.78.H01.1.454.CMB.1.raw
  modified_base (124)..(124): a, c, t, g, unknown or other
  misc_feature (124)..(124): n is a, c, g, or t
  modified_base (510)..(510): a, c, t, g, unknown or other
  misc_feature (510)..(510): n is a, c, g, or t
  modified_base (578)..(578): a, c, t, g, unknown or other
  misc_feature (578)..(578): n is a, c, g, or t
  modified_base (584)..(584): a, c, t, g, unknown or other
  misc_feature (584)..(584): n is a, c, g, or t
tcagtacgagtatgcacgaccggtgctcgatttagtgtgagtagtttgggtttgggggctttgcctgggtgctgttggtaccaggagacatagttataaccaccatctcctgcactggaaccancagtgacgttggtggttataactatgtctcctggtaccaacagcacccaggcaaagcccccaaatcatgtatttatgatgtcaagtaatccggccctgtagggtttcaatcgcttctcgtggactccaagtctggacaacgcggcctcctgacctatctcgtcgggcctccgaggtcctaggacggtaccgagggcctaggtacgtttaattaccgtgtaccgacgtcctacgtattaacgtaacgagtcagtcacgactactacgtaagttcgttaaccggagtacgggacctaagggtaccctaccgtacgtaacgtcgacgacccgaacggacccctaaccacttcggtaccacgttcgtcccttacccgtacctcccgttanacgttaccttcggtaactcgggactacccgggtacgtcggaaccggtacggtcgaactacgggtacgngtaccncgtacgacgtactcggtacgtcgtacgacgtagtcctcgtacgtcgtccgtacgtacgtactcgtacg

SEQ ID NO: 93052 - DNA, 709 bp, Homo sapiens
  misc_feature: GYAE6OF02HF8YT.18.78.H01.1.454.CMB.1.raw
  modified_base (684)..(684): a, c, t, g, unknown or other
  misc_feature (684)..(684): n is a, c, g, or t
  modified_base (706)..(709): a, c, t, g, unknown or other
  misc_feature (706)..(709): n is a, c, g, or t
tcagtacgagtatgcacgaccggtgctcgatttagtgtgagtagtttgggtttggggctttgcctgggtcctgggcccagtctgccctgactcagcctgcctccgtgtctgggtctcctggacagtcgatcaccatctcctgcactggaaccagcagtgacgttgtcggttataactatgtctcctggtaccaacagcacccaggacaacgcccccaaactcatgatttatgatgtcactatccgcctcgtagggttcaatcgtcttctcgtcggtactccgaagtccgtagaccaacgacccggtcccttaccctcggtaaccctacgttccttcggttcgggcccttaccgacggttccgagggacgggacggtacgtacttaggttaactttacttacgtgaccgtacgtactactaagttaacaaacgaacgaccaacccgaacgtccgtaaaccttccgttacttaacgtttcgttaccggtttaaccgggtaacgtacggggtaaccccgttaaggtacccgtaaccccgtttacgtacggtacctacccggaccccggtaaaccggacccctaaaccccgtcgttaacctccgtacccttaccgttcccggttaccccctcccggttaccctaccgcgttaaaccctggtacgtccgacgtccgggccgtaggaacncgggcctagtcgaagtccatcnnnn

SEQ ID NO: 93053 - DNA, 763 bp, Homo sapiens
  misc_feature: GYAE6OF02H6YI9.18.78.H01.1.454.CMB.1.raw
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagctgggttttccttgttgcttaattttaaaggtgtcagtgtgaggtgcagctggtggaggtcgggggaggtcttggtccgaggccggtcgggggtccctagaaccgtctccgtgtcgcacgccttcgtggttcctaccttcgagtcggtcttccgtagtcctagtcgctaccggttcgggaccccgccgacgggtccggttaaccggggaaacgggcgtgggtagggttggggttcggtaccgttagttaaggaaacggtacgaaaacgtacttaaaccgtaaggttacgacgaacgtacgtaccgaattaacgtgtcgtacggtccgggtacggtaagggaaacgggtcgtacggttacctccgggttactaccgaagtaaatgtaacttaacgaaagtaacgaccggtagtactacgtagacctaaagataacccgataacccggtagtaaaacccggcggaacgtaccgggtcgtagttaaacttacgtacgttacgtaacggtaagtaagggtacggttaattaacggttaacggggtttgggttaacggtttacggttaaccggggaaccggggtttaaacgggggtaccgttaacgtaacccggg

SEQ ID NO: 93054 - DNA, 522 bp, Homo sapiens
  misc_feature: GYAE6OF02I258G.18.78.H01.1.454.CMB.1.raw
  modified_base (226)..(226): a, c, t, g, unknown or other
  misc_feature (226)..(226): n is a, c, g, or t
  modified_base (289)..(289): a, c, t, g, unknown or other
  misc_feature (289)..(289): n is a, c, g, or t
  modified_base (353)..(353): a, c, t, g, unknown or other
  misc_feature (353)..(353): n is a, c, g, or t
  modified_base (356)..(356): a, c, t, g, unknown or other
  misc_feature (356)..(356): n is a, c, g, or t
  modified_base (446)..(446): a, c, t, g, unknown or other
  misc_feature (446)..(446): n is a, c, g, or t
  modified_base (469)..(469): a, c, t, g, unknown or other
  misc_feature (469)..(469): n is a, c, g, or t
  modified_base (495)..(495): a, c, t, g, unknown or other
  misc_feature (495)..(495): n is a, c, g, or t
  modified_base (510)..(510): a, c, t, g, unknown or other
  misc_feature (510)..(510): n is a, c, g, or t
  modified_base (513)..(522): a, c, t, g, unknown or other
  misc_feature (513)..(522): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaaacgcccccaaactcatgatttangatgtcagtaactccggccctcgtaggggttttcaatcgcttctctggctacagtctgcaacncggccctcctgaccatctcgtcggctccaggctggacggacgaggctagattatactgcagctnatntaccaagcagcagcactacacgttccgttacgaacgtcgggaccaaggtccaccgtcctaggcacgcccaacggcccaacccgctcgtcnccttctccttccccaccttcccnccacttactccgtactgacggcgcgngtacgaggcgcaagngcnnnnnnnnnn

SEQ ID NO: 93055 - DNA, 761 bp, Homo sapiens
  misc_feature: GYAE6OF02JAP76.18.78.H01.1.454.CMB.1.raw
  modified_base (257)..(257): a, c, t, g, unknown or other
  misc_feature (257)..(257): n is a, c, g, or t
tcagtacgagtatgcacgaccggtgctcgatttagtgtgagtagtttgggtttggggggggggtctcaggaggcagcgctctcgggacgtctccaccatggcctgggctctgctattcctcaccctcctcactcagggcacagggtcctgggcccagtctgccctgactcaacctgcctccgtgtctgggtctccgtgacagtcgatcaccatctcctgcacgtggaaccagcagtcgacgttggtagttataactntcgtctcctaggtaccaacacgccacccgaggaccaaacgccccccaaatccattagtaatttactagattgtacgtaagttaactccggtccctacggtacggggtttacttaaacgtcgtactttccgttcgtcggtcctaccgtaagttccgtacggaccaaccgtacccggtccctcccgttacgaccctacttccgtccgtacgggtcctaccgtacggtcgtacgggacgggtaacggacggtcgttaggtactttaacgttactacggacctaggtccctacgtaactaacgtaacgtaacgacgttaacgacgaacgtaccgtaaccttacggttaaaccggtttaccgtaaccgggtaaccggtaccggggtaacccgtaaacgggttcccctaaccccgggttacgttaaccggggacccgtaacccggtaaccccggtaacccggaacccccgtaaacccccgtcgttacccggttacccgtttaacccccgg

SEQ ID NO: 93056 - DNA, 766 bp, Homo sapiens
  misc_feature: GYAE6OF02H2DFX.18.78.H01.1.454.CMB.1.raw
  modified_base (287)..(287): a, c, t, g, unknown or other
  misc_feature (287)..(287): n is a, c, g, or t
  modified_base (318)..(318): a, c, t, g, unknown or other
  misc_feature (318)..(318): n is a, c, g, or t
  modified_base (354)..(354): a, c, t, g, unknown or other
  misc_feature (354)..(354): n is a, c, g, or t
  modified_base (388)..(388): a, c, t, g, unknown or other
  misc_feature (388)..(388): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
  modified_base (432)..(432): a, c, t, g, unknown or other
  misc_feature (432)..(432): n is a, c, g, or t
tcagtacgagtatgcacgaccggtgctcgatttagtgtgagtagtttgggtttggggagctctgggagaggagctccagccttgggattccccagctgtctccactcggtgatcggcactgaatacaggagactcaccagtggtaggtttggcttgagtcgttcgggttttccttgttgctttaaagttttaaaggtcgtccagttgtgaggtgcagcgtgggaggcgggccgggggagtcgttggtccgacggccgggttacgggggtcctagaacctcgtcgtgngactacgcctcgttacggtcctaccgttcgnggtcgtcctgtacgctagtcgcgtcgtcggccgcgngtccggttacgggagtcgtggtaggtggtaccgngtagtacgagactagactaacgtggtaccngactanactaatcngtcgtcggtagttacggtaaggaacgtccgtacgttaccgtaccgtacctaacgaagtaaagtagaaacgttaaccgaaagtaaccgttaacgtacgttacgtacctacgaaactaacgtaaccgaacgtacggttaacccgaaacggaaaaccggtacggtaaaccgggtccggttaaccgttaacggtttaacgtaccgttacgttaaaccgtccggtaaacggttaccgggttagttaaaccgtttaaggggtaccggtttttaagggggtacggtttaaccgggaaccggggtttaacccggggtaagggggttaccccgttaaaccggg

SEQ ID NO: 93057 - DNA, 730 bp, Homo sapiens
  misc_feature: GYAE6OF02IGIDD.18.78.H01.1.454.CMB.1.raw
  modified_base (657)..(657): a, c, t, g, unknown or other
  misc_feature (657)..(657): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacaggagactcaccatggagtttgggctgagcgttgggttttccccccttgttgtcttattttagtaaggtgtccagtgtgacgtgcagcgtggtggaggtcggtggggggaggtcgttcggtccgacggtcccggtcgggggggtcccgtgacgaccttcctccgtgtcgcgacggccccgtgctattcattctttaatagtttattggatgctacgtcggtccgccgaggccggtccgggggaacggggccgggaggtgggtcggaccaaacaataatgacaagagtaggaacgtaggaagaaagaactaagtagtaagactcgtggtagggaacggggacctaacgttcccgaaacctcgttaccgtaaccgaggaaacgaacccaaaacgtaaaccttaaaacgtaaaccttttacgtattaactccttaagaaacaaattacgaaaacccgtacgtaccctaacgaacggaacgggtacccgaaacgggtaaacccgaccggttagttggttaccgttaagttttacggnggttaacggaacggtaaaggtccggagtagggtaccgggtcgaacggggtaactaggtacccgggtaccgggg

SEQ ID NO: 93058 - DNA, 666 bp, Homo sapiens
  misc_feature: GYAE6OF02GN3SX.18.78.H01.1.454.CMB.1.raw
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
  modified_base (654)..(654): a, c, t, g, unknown or other
  misc_feature (654)..(654): n is a, c, g, or t
  modified_base (657)..(657): a, c, t, g, unknown or other
  misc_feature (657)..(657): n is a, c, g, or t
  modified_base (661)..(666): a, c, t, g, unknown or other
  misc_feature (661)..(666): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtgttaataactatgtctcctggtaccacagcaccaggcaaacgccccaaatcatanatttangatgtcgaagtatccggcccttcggtagggttttactaatccgtctttacgtctcggcctaccgaagttctggaccaaccgccggtccctcccgtagaaccctatcgtaccgtcgggccttccgagcgtaggacgggaccgagtcttagtactttacgtactgtcactgtaacattacgtaacacgcgtagcgtaacgtccaatctaaccgtttaccggtttacgaacggttccggaaaccgtaacggttcctacccgtacgtacggtaccgaccgacccggaaccgaacccaaacccctacgttacgtaaccgtccttcccgttaccccgtaccccttccctaacccgttaccgtacccgtttaccggacgttacgggcggtaccggacctacgggacccggtacggacggtaaccgacggttaagcgaancgncacnnnnnn

SEQ ID NO: 93059 - DNA, 315 bp, Homo sapiens
  misc_feature: GYAE6OF02FG2DG.18.78.H01.1.454.CMB.1.raw
  modified_base (291)..(291): a, c, t, g, unknown or other
  misc_feature (291)..(291): n is a, c, g, or t
  modified_base (297)..(315): a, c, t, g, unknown or other
  misc_feature (297)..(315): n is a, c, g, or t
tcagtacgagtatgcacgaccggtgctcgatttagtgtgagtagtttgggtttggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagccccaaggcccaaccccactgtcactctcgttcccaccctcctccattacctcgtactgacgcggctggcaaggcncatagnnnnnnnnnnnnnnnnnnn

SEQ ID NO: 93060 - DNA, 744 bp, Homo sapiens
  misc_feature: GYAE6OF02FUGMQ.18.78.H01.1.454.CMB.1.raw
  modified_base (233)..(233): a, c, t, g, unknown or other
  misc_feature (233)..(233): n is a, c, g, or t
tcagtacgagtatgcacgaccggtgctcgatttagtgtgagtagtttgggtttggggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacaggtcgatcaccatcctccgtgcactggaaccngacagtcgacgttggtgttaataactatgtctctaggtaccaacagacaccagaccaacgccccaaactcagtagtactttatagtacttgtacctaactaacgttccgacccgtacgtacggggtttactaagttccgtcttacgtcgtcggtctaccgtagtcgtacgacgtaaaccgtccggtacccttaccgtacgtacctacttccgtcgtacggtcctaccgtacggaccgtacgggtacggaaccgtacggtacgttagttaactttaacgtttagtccggaacgtacgtaccttaacgttaattaacgtaacctaaacgaccgtaaccgaacgttacctaaccgttacgttaaccgttaacgtttaccgttacggttaaccggtaaccggttacgggtaaacccgtaacgggttaaccctacccgggtaaccgttaccgggtaccgaacccggtacccgtaaacccggttaccccaaccccggttacgttaccgttaaccccg

SEQ ID NO: 93061 - DNA, 749 bp, Homo sapiens
  misc_feature: GYAE6OF02H16T7.18.78.H01.1.454.CMB.1.raw
  modified_base (186)..(186): a, c, t, g, unknown or other
  misc_feature (186)..(186): n is a, c, g, or t
  modified_base (215)..(215): a, c, t, g, unknown or other
  misc_feature (215)..(215): n is a, c, g, or t
  modified_base (711)..(711): a, c, t, g, unknown or other
  misc_feature (711)..(711): n is a, c, g, or t
  modified_base (729)..(729): a, c, t, g, unknown or other
  misc_feature (729)..(729): n is a, c, g, or t
  modified_base (740)..(740): a, c, t, g, unknown or other
  misc_feature (740)..(740): n is a, c, g, or t
  modified_base (744)..(744): a, c, t, g, unknown or other
  misc_feature (744)..(744): n is a, c, g, or t
  modified_base (746)..(746): a, c, t, g, unknown or other
  misc_feature (746)..(746): n is a, c, g, or t
  modified_base (748)..(748): a, c, t, g, unknown or other
  misc_feature (748)..(748): n is a, c, g, or t
tcagtacgagtatgcacgaccggtgctcgatttagtgtgagtagtttgggtttgggggctttgcctgggcccagtctgccctgactcaacctgcctccgtgtcgtgggtctcctggacagtcgatcaccatcgtcctgcactggaaccagcagtgacgttggtgttataactatgtctctgaccanagccaccaggcaaacgccccaaatcagtntatttatgatgtcagttactcggccctagtagggtttctaagtccgtctttcttcgtacggtcctaccgtaaggttccgtacgggaccaaccgtaccggtaccccttccccggtacgtaaaccctatttccccgttacggtccggggtccttacccggaaggtttccgtaggaacccggggttacggacccgggtacttacggtttaattttaaacgtttccggtacaccgtacggtacccttataaaccggtttactaaaacgaccgacggaaactttcggaaaacgtcccttaaaacccgttagtaaccggtttaacggtttacggaaccggttacgggaaccgtacggttaccgaccgttacgttacggacaccgaaccgaccgtacccgtaacccgcgtacaccgttactcgtacccgttccgtaccctcctaccgtaccaccgttaccgttacgtcggacggtaccgggcgttaaccggagacggtacccntaacgggtcaacggttcncgcgtacgacncacncncnc

SEQ ID NO: 93062 - DNA, 646 bp, Homo sapiens
  misc_feature: GYAE6OF02G2H5V.18.78.H01.1.454.CMB.1.raw
  modified_base (640)..(646): a, c, t, g, unknown or other
  misc_feature (640)..(646): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcaactaactccggccctcgaggggttttacctaagtcgcttctcttcggctaccgaagttccgtggaccaacgaccggcccttaccctcgaacctagtcctcgtgggcctccgaggctacggaggacgtggacggtcttacggaacttaacgttacgtcgtcccgtaggttccctaagttcgaacctagtcggacgtcgtggtaagttggttacgttatcgttcgttcgtactcggtagggacctacggtccgtaccgttctaagtccgaccgaacccgtaccggtccccgtaaccccttcgtcgtacctaccttccttcccgtcccccgtacccttccctaccgttacctaccgttaccgtacgacggtcggaccgggtcgtacggacgacggacgtacaagtcgatcnnnnnnn

SEQ ID NO: 93063 - DNA, 668 bp, Homo sapiens
  misc_feature: GYAE6OF02GT18Q.18.78.H01.1.454.CMB.1.raw
  modified_base (656)..(656): a, c, t, g, unknown or other
  misc_feature (656)..(656): n is a, c, g, or t
  modified_base (664)..(664): a, c, t, g, unknown or other
  misc_feature (664)..(664): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatccggccctcgtaggggtttactaatcgcttctctggtcctccaagtcgtggcaacaccggccctccctgaccatctcgtcgggcctccgaggctggagggacgaggctagtattattactgcagctacatactaacaagcaccgagctactcttactagtttcgttccgttacgggaaccgttacggggaaccctaaggtacccgtaacccgttccgtacgggtaccaaccggtaccccaaacggaccccctaaacccccgttcctcgttaccctaccgttaccgttcccgtttcccccgtaccccttcccttaccctacgttaacccttccggttaaccgtcggaaccgggtccggggtccgttacggggacccggtaacgggtcccggaaccgttaaggttaccggacacgcgtacngcatcgtnaacg

SEQ ID NO: 93064 - DNA, 321 bp, Homo sapiens
  misc_feature: GYAE6OF02GO0XY.18.78.H01.1.454.CMB.1.raw
  modified_base (132)..(132): a, c, t, g, unknown or other
  misc_feature (132)..(132): n is a, c, g, or t
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
  modified_base (288)..(288): a, c, t, g, unknown or other
  misc_feature (288)..(288): n is a, c, g, or t
  modified_base (295)..(298): a, c, t, g, unknown or other
  misc_feature (295)..(298): n is a, c, g, or t
  modified_base (301)..(321): a, c, t, g, unknown or other
  misc_feature (301)..(321): n is a, c, g, or t
tcagtacgagtatgcacgaccggtgctcgatttagtgtgagtagtttgggtttggggtttctaatcgcttctctggctccaagtctggcaacacggcctcctgaccatctctgggctccaggctgaggacgnggcctagattattactgcagcctcatatacgaagcagcagcactcaagtctggaactggaccaaggtcaccgtcaggtcagccaaggcccaaccctntgtcactctcgttcccncctcctcatacctcgtactggacgtcggctggactaacggcncgaatgnnnntannnnnnnnnnnnnnnnnnnnn

SEQ ID NO: 93065 - DNA, 684 bp, Homo sapiens
  misc_feature: GYAE6OF02GRV7P.18.78.H01.1.454.CMB.1.raw
tcagtacgagtatgcacgaccggtgctcgatttagtgtgagtagtttgggtttgggggggggtctcaggaggcagcgctctcgggacgtctccaccatggcctgggctctgctattcctcaccctcctcactcaggcacaggtcctgggcccagtctgccctgactcagcctgcctccgtgtcgtgggtctcctggacagtcgatcacatctcctgcactggaaccagcaggtcgtacgttggtaggttataacgttatcgtctccgtaggtaccaacacgccaacccgacggaccaaaccgacccccaaaactcatgtactttatgtatcgtactactaacgtcggcctacgtagggtttctaactcgtcgttctcgtcgtacttaccaagtcgtcggacaaccgacccggtcccctcccgtacgtacctactccgtcgtccgggcctaccgacggtcgtaggacggacggacggtctagtaatttacgttacgtcgacacgtacctataacgtactaaacgacaccaaccgacgtacctacgttcctacttacgttcgttaccgttacggtaaacccggttacgggtaacccggtaaccggttacccgtacccggtttaaccggtacggtacctaaccggaccccggaacccgggtaccccctaaccccgtactttacccgg

SEQ ID NO: 93066 - DNA, 714 bp, Homo sapiens
  misc_feature: GYAE6OF02GJ3DR.18.78.H01.1.454.CMB.1.raw
  modified_base (138)..(138): a, c, t, g, unknown or other
  misc_feature (138)..(138): n is a, c, g, or t
  modified_base (141)..(141): a, c, t, g, unknown or other
  misc_feature (141)..(141): n is a, c, g, or t
  modified_base (179)..(179): a, c, t, g, unknown or other
  misc_feature (179)..(179): n is a, c, g, or t
  modified_base (218)..(218): a, c, t, g, unknown or other
  misc_feature (218)..(218): n is a, c, g, or t
  modified_base (264)..(264): a, c, t, g, unknown or other
  misc_feature (264)..(264): n is a, c, g, or t
  modified_base (599)..(599): a, c, t, g, unknown or other
  misc_feature (599)..(599): n is a, c, g, or t
tcagtacgagtatgcacgaccggtgctcgatttagtgtgagtagtttggggtttggggggggggtctcaggaggcagcgctctcgggacgtctccaccatggcctgggctctgctattcctcacctctcactcagggnacnggtcctgggcccagtctgcctgactcaacctgcctcgngtctgggtctccgtggacagtccgatcaccatctccgtnctacgtcggaaccaggccagtggtacgttggtaggttataaacgtnttgtctccgtggtaaccaacacggacaccaggacaaacgaccccctaaactcaagtcgtatttaactggatactacaactaacgtccggtcctacgttaggggtttacctaacgttacgtccttacgttgttccgacgttaccgaacgttcgtacggtaccgaaaccgtccgggtacctcccgttcggaacctacggttcctcgttaggggtcccgtacgtacgggcggttacggaacgggaccgtaggggtccttaggtaacgttatttaacgttcgacgtacggtctaacgttaattaaccggtaacaaacggaccttaccgaagtacctacncgtttaacacggttcgttaccgtttaccgggaacttaccgggaacgtaacgggttaccgacccgttaccggtacgtccgacgtaccgaacgggcccctaacccggtatccgtacc

SEQ ID NO: 93067 - DNA, 843 bp, Homo sapiens
  misc_feature: GYAE6OF02IL0QW.18.78.H01.1.454.CMB.1.raw
  modified_base (197)..(197): a, c, t, g, unknown or other
  misc_feature (197)..(197): n is a, c, g, or t
  modified_base (200)..(200): a, c, t, g, unknown or other
  misc_feature (200)..(200): n is a, c, g, or t
tcagtacgagtatgcacgaccggtgctcgatttagtgtgagtagtttgggtttggggggggggtctcaggaggcagcgctctcgggacgtctccaccatggcctgggctctgctattcctcacctcctcactcgagggcacagggtcctgggcccagtctcgcctgactcgaactgcctcgtgtctggtctctgacngtnactcacatctctgctactgaccagcagtgtacggttggttagttactaactacgtgttccgttccgtacggtaaccaacgacgaccgtaacccgacggaacctaaaaccggacccccctaaaagtccaagttacgttaactttagtagtaacgttcggactaacggttaacgtccggtacctacgggttagggtttaacctacgttccgtactttcgtcgtacggtcctacgtaagtccgtacggaacctaacgtccgtcctaccgtacgtacctacgtcgtacggccgttacgtaccgtaggggtacccgttaagggaacgggttacgtacgggttacgttaacgtttaacgttacgtttaaccggtcggaccgttaacgaccgtttaacaaggtttaaaccgaactaaacgggttaccgaacgggtaacctaccgggtaaccttaaaccgtttaccgtaaaacggtttacccggttaaccggggtaaaccgggttacccgggtaaaccggtttaccgggtaaccccggtttaacccggttacccgggttaaacggttacccccggaacgtaaaccccccggtaaccggtaccccccttaaaaccccgggttcgttaacccggttaaccctttaaccccggg

SEQ ID NO: 93068 - DNA, 669 bp, Homo sapiens
  misc_feature: GYAE6OF02IGMY9.18.78.H01.1.454.CMB.1.raw
  modified_base (190)..(190): a, c, t, g, unknown or other
  misc_feature (190)..(190): n is a, c, g, or t
  modified_base (365)..(365): a, c, t, g, unknown or other
  misc_feature (365)..(365): n is a, c, g, or t
  modified_base (649)..(649): a, c, t, g, unknown or other
  misc_feature (649)..(649): n is a, c, g, or t
  modified_base (660)..(660): a, c, t, g, unknown or other
  misc_feature (660)..(660): n is a, c, g, or t
  modified_base (667)..(668): a, c, t, g, unknown or other
  misc_feature (667)..(668): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacngcacccaggcaaacgcccccaaactcatgtatttatgattgtcaagttaactccggcccttgtagggtttcaatcgcttctctgctccaagtctggcaacgcgcctccgtgacctatcctcggtcggcctccgacggtcgtaggacggtacgcggtacgtagtactttacgtacngcgacgtcctactaacttacaacgaacgtccaaccgtacgtacctaccgttcttaccgttatttccggttacgtaacggtaccggtaccgggaaaccgtacggtacccgttacccgttacgtacgtccgaacccgacccgaacccgacccctaacctcgtccttacctacctcccgttccgttccccctacccttaccctacgtaccgttaccgttacccgttacggtacggtaccgggtcggtaccgtacgggaccggtaacggcccgtaacgtagtaaccgntcgacgtacgngctcacnnc

SEQ ID NO: 93069 - DNA, 861 bp, Homo sapiens
  misc_feature: GYAE6OF02JCNIG.18.78.H01.1.454.CMB.1.raw
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagctgggtttccttgttgctattttaaaaggtgtccagtgtgaggtgcagctggtggaggtccgggggaggcttggtccagccgtgggggtccctgaaactctcctgtgcagcctctgggttccaccttcagtcggctctgcttatgcacgttcggggtcccgccgagggtccgtttacccggggaaagggtccgtgggaaggttcgggggtttacggacccgggttaagttttaaggaaacggtacgaaaaacggtaccgttaaaaccgtaacggttttaaaccggcccggtaaaccgtaaggtacccgtaaagttaacgttacgggaccgtttacgggtcccggtttaccgggggttaacgggtaaaacggggtaccggttaacggggtttaccccgtaaccccgggttacccgttaaccccgtaaaggttaaaacgtttaacggtaacgtttaaaccgaaaaacgggtaaaccgaacgggttaccgttaacgttccgtaacggtacctaaaacgtagaaaccgtacggtacccgtaaacggaaaaccggtacgggaaccgtaaccgggtacccgttagttaacgttaaccgttagtaaccgttaacggaacggtaggttaacgggtaagtttaacgtaagggtttagggggtaacggtttagtaccgggtaacgggttaaaccgggggggtacctttaaaccgggg

SEQ ID NO: 93070 - DNA, 819 bp, Homo sapiens
  misc_feature: GYAE6OF02JVBH5.18.78.H01.1.454.CMB.1.raw
  modified_base (109)..(109): a, c, t, g, unknown or other
  misc_feature (109)..(109): n is a, c, g, or t
  modified_base (688)..(688): a, c, t, g, unknown or other
  misc_feature (688)..(688): n is a, c, g, or t
  modified_base (718)..(718): a, c, t, g, unknown or other
  misc_feature (718)..(718): n is a, c, g, or t
tcagtacgagtatgcacgaccggtgctcgatttagtgtgagtagtttgggtttgggggctctgggagaggagctccagccttgggattcccagctgtctccactcggtnatcggcactgaatacaggagactcaccatgggtagtttgggctggaggtcgttcggggtttttccttggttcgtacttaagtttttaaaaacgggtcgttaccgtaggttggtaggtagggtgcgaggtcgttggggtgggacgggtccggggggaggtcgtttcgggtccacgggtccggttcgggggggtacccctaggtaacctccgtccgttgtcggacacgtccgttcggttcggggttacctaaccgttcgacgggttcggtcttccgttggtacttagttccggtaccgtccgggtttccgggccccggtaccggtacggtaccggttaccggggaaacggggtcgtacggggtgggttacgggggttacgtacccggttaagttaacgggacgtaaccggtaaacgaccgtaaacgtagggtaccgaccggactaggacttagtaaccgtgtccgtgtaccggggttacggaagggaacggttacggtacggtaccgttacccggtactaccggaaagtacgttaacgtacgttaaacgaacggacggtaacgtacgttatacgaacgtanaacgtaagactacggactaaacgggaaccnggaacgaccgtcgttacgaacttagacgtacgaggtacgtcgggttaactggtaacgttaggtacggtgttacggcggtaacgggacgggttactgtacgg

SEQ ID NO: 93071 - DNA, 720 bp, Homo sapiens
  misc_feature: GYAE6OF02FWBWC.18.78.H01.1.454.CMB.1.raw
  modified_base (231)..(231): a, c, t, g, unknown or other
  misc_feature (231)..(231): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (272)..(272): a, c, t, g, unknown or other
  misc_feature (272)..(272): n is a, c, g, or t
  modified_base (314)..(314): a, c, t, g, unknown or other
  misc_feature (314)..(314): n is a, c, g, or t
  modified_base (319)..(319): a, c, t, g, unknown or other
  misc_feature (319)..(319): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaactgcctcgtgtctgggtctcctggacagtccgatccgactatctcctgcacgtcggaacngcagtcgacgttggtgttanaactntgtctcgtggtaccanacgcaccgaggacaaaccgacccctaaatcatcgtaattagngtatntacaactacgtccggtccgtacggtcggggtccctaggaccgtattccgtacgtcggtacctacggtaagttccgcggacctaccgtcgaccggtccctacccgtcggacctaccgtcgtaacggtcgggtcgttacccgcgggtccgtaggaggtaacgtgggaacgtacggtataacgtttaacgttaccggtacgtaccgtaacgttacctaaggtacgaacgtacggtcggtaacggtaccgtagggttacggttacgtttacgtacgtttcgtttaccggtagggtaccgtttaccggggacggttaacccggtaacggttaccccgtaacggtttaccgtaacgttacccgaaacccggttacccgacccggttaaccccgttcccttaaccggg

SEQ ID NO: 93072 - DNA, 728 bp, Homo sapiens
  misc_feature: GYAE6OF02FJ7NZ.18.78.H01.1.454.CMB.1.raw
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagcgtgggttttccttgttgcttattttaaaggtgtaccagtgtgaggtgcgagctggtggaggtccgggggaggtcgttggtccgagccgtcgggggtccctagaactctccgtgtgcacgcctcgtcggttccaccttcgagtcggctctgtctagtcgtacacggttcgggtcccgaccgacgggtccggttaaccggggaacggggtcggtaggggtacgggttcggggttacgggtaccggttaagttaaggtaacgacgaaaacgtactaaacgagttacgacgacagactatagtagtctgggtcgtaggtaggaacggtgtacggtccgtaccgtcctaaccgaagtaaacgtgtaactaacgaaacgtaaccacggtacttacgtccgtaagactaaagacgaaccacgtaacgaaccgggtaaaccgacggaaccgtacgggtaacctttaggtaacttaacgtacgtaacgtacggtaacggtaacggtggttaacgttaagttagggtttaagggttaggtacgtacggggtaacccggggtaaacggggttacccgtaaccgg

SEQ ID NO: 93073 - DNA, 854 bp, Homo sapiens
  misc_feature: GYAE6OF02IXGCD.18.78.H01.1.454.CMB.1.raw
  modified_base (837)..(837): a, c, t, g, unknown or other
  misc_feature (837)..(837): n is a, c, g, or t
  modified_base (846)..(846): a, c, t, g, unknown or other
  misc_feature (846)..(846): n is a, c, g, or t
  modified_base (849)..(849): a, c, t, g, unknown or other
  misc_feature (849)..(849): n is a, c, g, or t
  modified_base (853)..(853): a, c, t, g, unknown or other
  misc_feature (853)..(853): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtgttataactatgtctcctggtaccaacagcaccgaggaccaaacgcccccaaactcagtgtatttatgtatcgtacgtaagtaacgtccgggccctacggtacggggtttactaactccggtctttacctcgtcgggtacctaccaagtccgtaggacctaaccgtccggtacccctcccggtacaccctacgttccgtcggttacgggcctccgaagggtcctagggacgggaggtaaccgggtcgtacgttaagttttacgttaaccggtggtacgacgttaccttactaacttaataaccggtaacgacgtacggaactaccgacctaacccgttaccgtaacggtttaccggttaaccggtaacccggtaacggggtaaaccctaacgggttaccccggtaacccggtttccgtaaacggtacccggaaccgtaacccccgggaaacccgtaaccccctaaaccccggttaaaccggttacctccccgtttaaacccgtttccgttaacccccgtttaaccccccgacccgtttacccccgttaaccttaacccgtttaccccggttacccgggttaaaccttaccgggtaaccggggttcccggggtaccgtaacgggggtaaccctacggggtacccgtccgtaaaccgggttaacgcaagggtccctanacgtcgtanacncgtnc

SEQ ID NO: 93074 - DNA, 779 bp, Homo sapiens
  misc_feature: GYAE6OF02JFLTB.18.78.H01.1.454.CMB.1.raw
  modified_base (267)..(267): a, c, t, g, unknown or other
  misc_feature (267)..(267): n is a, c, g, or t
tcagtacgagtatgcacgaccggtgctcgatttagtgtgagtagtttgggtttgggggctctgggagaggagctccagccttgggattcccagctgtctccactcggtgatcggcactgaatacgaggagactcaccatggagtttggctgagcttgggttttccttgttgcttattttaaaggtgtccagtgtgagtgcagtctggtggacggtcgggggagtcgttggtccagccgtcgggggtaccctgaactcgtcctgtgcngtcctgtcggtctacctgagtgtctcgtgtcgtagttcacgtcggttcgggtcccgccggtacgggtccggttaaccggggaagggtcgtgggtcgggttcgggggttcggaccgtttaggtaaaggaacgtaaccgaaaggtacctaacgtagttaccggactacgacgctaagtgtcgcgtacggtcggtagggtacggaaggttccggtaacggtcctaaccgttccgtaacgtaagtaaacgttgtacgttaaacgaaacgtaacggtacggagttacttacccggattaaaccgaaacgtacggtaaacgtaaccggacctaaaaacccggggaacgaacggtaccggttaaccgggtcccgtttaaaggtttaacgtaacgttaccggtaacggtaaccggttaagtacccgggttaaaggtactttaaccggttaggggtttaaggttaacggttacggtaccgggggtaaacggggttaacggggttacggtttacgaaccggg

SEQ ID NO: 93075 - DNA, 665 bp, Homo sapiens
  misc_feature: GYAE6OF02INSTW.18.78.H01.1.454.CMB.1.raw
  modified_base (650)..(650): a, c, t, g, unknown or other
  misc_feature (650)..(650): n is a, c, g, or t
  modified_base (656)..(656): a, c, t, g, unknown or other
  misc_feature (656)..(656): n is a, c, g, or t
  modified_base (663)..(663): a, c, t, g, unknown or other
  misc_feature (663)..(663): n is a, c, g, or t
tcagtacgagtatgcacgaccggtgctcgatttagtgtgagtagtttgggtttgggggctttgcctgggcccagtctgcccgtgactcaacctgcctcccgtgtcgtgggtctcctggacagtcgatcaccatctcctgcactcggaaccgagcagtgacgtttggtggttaataactatgttctccgtggtaaccaacagccacccgaggacaaaccgacccccaactcagtgtattttagtgtaatcggtacgtacgttaacgtccggacccttcggtaggggtttactaaacgtcgttcttcgtcgtacggtcctaccgtaacgtcgtacggacaaccgtacccggtccctaccgtacgacctacttcgtcgtcggtacctcgaggtaccagggtacgacggcgtacgtacgttacgtttactacgtagacgtcgtacctataacgttaactaacaacgtcacgacgagtactacgactcggtcgtacgaagtacggacgtacgtaccgtaccgtacgtcgactacgacgtaacccggtaccaacccgtctacgtactaccgtccgtccgttacccgtcctaccgtacctacgtaacgtcgtaacgtacggacggtccgcgtacggaccgtacgacgcgtatcagtnatcgancagcagnag

SEQ ID NO: 93076 - DNA, 664 bp, Homo sapiens
  misc_feature: GYAE6OF02IGOCR.18.78.H01.1.454.CMB.1.raw
  modified_base (646)..(646): a, c, t, g, unknown or other
  misc_feature (646)..(646): n is a, c, g, or t
  modified_base (650)..(650): a, c, t, g, unknown or other
  misc_feature (650)..(650): n is a, c, g, or t
  modified_base (657)..(657): a, c, t, g, unknown or other
  misc_feature (657)..(657): n is a, c, g, or t
  modified_base (663)..(664): a, c, t, g, unknown or other
  misc_feature (663)..(664): n is a, c, g, or t
tcagtacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcaccaggcaaacgcccccaaaactcatgactttatgatgtcagtaactcggccctcgagggttttactaatcgtctttctctggcctaccaagtctggaccaaccgaccggccttacccgcgtacctaacttcccgttacgtcgggtacccttaccggaggtccgtaggagggacggaggcgttaggtacttaacttcgtacgacctcgtacctagtacgtactaacgttaatcctagtacgtcggttacgggtcgggttacgtcgggacggacggtaccgacggtcgtcggacccggtggtacgggcgtaacgaccggtacggacgttccccggtcccccgttcgtacctccgttccgtcccgtaccctacccgttcccgtacttaccgtaccgttaccgtcgttcggacggtccggtacgtcgtaaccgcgggaccgtagtaacgtgtaccgntcgngcgcgcncgcgcnn

SEQ ID NO: 93077 - DNA, 823 bp, Homo sapiens
  misc_feature: GYAE6OF02H6TYZ.18.78.H01.1.454.CMB.1.raw
tcagtacgagtatgcacgaccggtgctcgatttagtgtgagtagtttgggtttgggagctctgggagaggagctccagccttgggattcccagctgtctccactcggtgatcggcactgaatacaggagactcaccatggagtttggctgagcgttgggttttccttgttgcttatttaaaaggtgtccagtgtgaggtgcagcgtagggtggacgggtaccgggggtaggtccgttcgggtaccgacggtcccgggttacggggggttccctaaggtaaaccttccgttccgttggtacgccgtacgtccgttcgttgggttcctaccgttcgtaaggtcggtcctacgtgacttaacgtcgtaccgtaacggttccgggtcccgaccggtacgggtaccggttaaaccgggggaaacggttccgtacggggtaacgggtttcggggttacgggtacccggtttaaaagttaacggaaacgaaacggttaaagaacccgttaaaacgtacgggttaccggaacgtaaccgaaggtacctaaagttacgtaacgtcgtccggtacggtacggtaggaaacggacgtacgttaccgtaccgtctaacgaaacgtaagtacgtaacttaagaaacgaacgacggtacgtaacgtcgtacaagaaacgtacgtaaacgaacctaccgaaacggaaaccggtacggaaccgtaccggtacctagttaaccgtagttacggaactaggaacggtaaggtagtaacgttaacgttggtaagggtacgttaccggtaccgggtaacgggtaaaccggggtacttaacggg

SEQ ID NO: 93078 - DNA, 826 bp, Homo sapiens
  misc_feature: GYAE6OF02IQJ33.18.78.H01.1.454.CMB.1.raw
tcagtacgagtatgcacgaccggtgctcgatttagtgtgagtagtttgggtttggggagctctgggagaggagctccagccttgggattcccagctgtctccactcggtgatcggcactgaatacaggagactcaccatggtagtttgggctgagtcttgggttttccttgttgtacttaattttaaaaggtgtccagtgtgaggtgcagcgtggtgggacggtccgggggaggcgttcggtccgaggtccggtcgggggtccctagaaaccttcctccgtgtcgacacgtccttcgttcggttcctaccttcgtacgtcggtccttcgtcgtctacgtcggccgtaccggtccgggtcccggtccggtacgggtacccgggttaccggggaaacggggtacggtagggtaccccccccgggttggggttccgggtacggttaacgttaacggaaacgtaacgtaaacggtaaccgtaaacgtaacggttaacggaccgtaacgacgtacgtaagttaacgtacgtccgtacggtacggttacgggtaacggtaaacgggtacgtaccggttaccgtaacccgttaccgtaccgtaaagtaaacgtagtaactaacgaaaacgaaccgaaccggtacgtaacgtactacgtaactaaacgtacgaacgaacgaaccgtaaacggaaaccggaacggaaccgaccggtacgttaacgttaacgttacgttacgtaacgtaacggtaacgtacggtaacggtaagttacgttaagggttacgggttaggttacggtacgggtaacgggtaaccggggtaacgtaacgg

SEQ ID NO: 93079 - DNA, 641 bp, Homo sapiens
  misc_feature: GYAE6OF02H61T7.18.78.H01.1.454.CMB.1.raw
  modified_base (260)..(260): a, c, t, g, unknown or other
  misc_feature (260)..(260): n is a, c, g, or t
  modified_base (337)..(337): a, c, t, g, unknown or other
  misc_feature (337)..(337): n is a, c, g, or t
  modified_base (503)..(503): a, c, t, g, unknown or other
  misc_feature (503)..(503): n is a, c, g, or t
tcagtacgagtatgcacgaccggtgctcgatttagtgtgagtagtttgggtttgggggggggtctcaggaggcagcgctctcgggacgtctccaccatggcctgggctctgctattcctcaccctcctcactcagggcacgagggtcctgggcccagtctcgccctgactcaacctgcctccgtgtctgggtctcctggacagtcgatcactatctctgcacgtggaaccagcagtcgtacggttggtagttaacaactntgtcctccgtacggtaaccaacgtacgacctaacccgaggaccaaaccgacccccaaactactatagtaactttaanagtacttcgtacaactacgtccggtacccgtacgtacgggtttactaatccgtcttctcgtcgacctactagtctacgacaacgtaccgccctccagacctactctccgtcggcctaccgaggtacgtggaacggtacgcgtacgtagttacttaacttacgtacngaactctaactataactacgaacgtaccacgtacgacctacgttactctaagtcgttacgtacgacgtacggaaccgtacgtaccgtaccgtaccgtacgacctaccgaccgtaaccgacccaaccgtcgtatacccg

SEQ ID NO: 93080 - DNA, 931 bp, Homo sapiens
  misc_feature: GYAE6OF02HPX10.18.78.H01.1.454.CMB.1.raw
tcagtacgagtatgcacgaccggtgctcgatttagtgtgagtagtttgggtttgggggctctggggagaggagctccagccttgggattcccagctgtctccactcggtgatcggcgactgaatacaggagactcaccatggtagtttgggctgagcgttgggttttccttgttgcttaagttttaaaaggtgtccagtcgtgaggtgcgagtcgtgggtcggaggtccgggggagtcgttggtccgagtccggtgggggtccctagaaacctcctccgtgtgctacggccttcgtacgggttcctaaccgtttcgacggtcggtaccttcgtacgtaccttagtccggtaaccgtaccggtaccgggtccccgaccggtaacgggttacccgggtttaaccgggggaaaacggggttccgttaaggggtacggggttacgggggtttaccgacccgggtttaaagttacgggaaacgtaaccgtaaacggtaccttaaacggtacggttaccgacgtaacgaggtactaagtacggtacgtcgttcggtacgggttacgggtaacggaaaaccgggtttccggtaacgggtttacccctaaccccggttaaccgttaaccggaacggttaaaacgttcggtaaacttaaacggaaaaaccggtaacggtaaaccggtaccgttaagtaccgtaacgaacttaaaacgtaccggaaaccgtaaccggtaaaccggtaaacggaaaacccggtacggaaacccggtaacccggtacggtttagttaacccgtttaactacgggttaaccgtaaggtaaccggttacggtaaggttacgtttaacgggttaagggtttaaggggttaacccgtttagggtaacccgggttaaaccgggggtaaacccgggggtttactacccgggttaaacgg

SEQ ID NO: 93081 - DNA, 801 bp, Homo sapiens
  misc_feature: GYAE6OF02JFO6M.18.78.H01.1.454.CMB.1.raw
  modified_base (562)..(562): a, c, t, g, unknown or other
  misc_feature (562)..(562): n is a, c, g, or t
tcagtacgagtatgcacgaccggtgctcgatttagtgtgagtagtttgggtttggggagctctggagaggagctccagccttgggattcccagctgtctccactcggtgagtcggcactgaatacaggagactcaccatggagtttgggctgagcttgggttttccttgttcgacttaagttttaaaaggtcgtccgtagtgtaggaggtgcgagtcgtggtggaggtccgggggaggtcgtggtccgaggtccggtcgggggttccctaggaacctcgtccgtggtcgtcgtacgtccgttcgttacgggttcctaaccgttcgaacggttcggtccttcgtcggtacttacgtacgtaccgtaaccggttcggggtcccggtaccgtaaccggggtccggtttaacccgggggaaagggtccggtaaagggtcgggttaggggttaccggtaacccggtttaaggtaaggtaacgaacgaaacggtacgtaaacgtacgggttacgacgacgtagacgtaacgtagtcgtacgtggtaccgtacggggtaagtaaacggngttaacgttacccggtacgttaccgaaccgtaaagtacgtagttactaacggaaaacgtaaccggtaggtacctagtacgtacgaataacgttacgactacgaccgtaaacggaaccgacggaacgtaccggtacgtacgtattaccggtacgtaacgaccgtaaaggtcggttagtaacgttacggttagggttacggttaagttaccggtcgggtaacggtacgggttacctaacgg

SEQ ID NO: 93082 - DNA, 685 bp, Homo sapiens
  misc_feature: GYAE6OF02FL4DL.18.78.H01.1.454.CMB.1.raw
  modified_base (398)..(398): a, c, t, g, unknown or other
  misc_feature (398)..(398): n is a, c, g, or t
  modified_base (412)..(412): a, c, t, g, unknown or other
  misc_feature (412)..(412): n is a, c, g, or t
  modified_base (421)..(421): a, c, t, g, unknown or other
  misc_feature (421)..(421): n is a, c, g, or t
  modified_base (486)..(486): a, c, t, g, unknown or other
  misc_feature (486)..(486): n is a, c, g, or t
tcagtacgagtatgcacgaccggtgctcgatttagtgtgagtagtttgggtttggggagctctgggagaggagctccagccttgggattcccagctgtctccactcggtgatcggcactgaatacaggagactcaccatggagtttgggctgagctgggttttccttgttgcttattttaaaaggtgtccagtgtgaggtgcagctggtggaggtccgggggaggcttggtccagccgtcgggggtccctcgaaactctctgtcgcagcctcgtgggttctaccttcgagtggtcctcgtgctagtgccgacgttcgggtcccgccgtacgggtccgttaccgggggaaagggcgtgggtaggtgggttcgccgttagttagaagacgaaagctaaanacggttacgccganagctatatncgtggacgtcgggtagaaacggcgtaggtccgaccgtcgtaccaagtactgtacttaaacgaaanaaccgacgggtacttacgtcgacgtacaaagtacaacgacgtaccgtaacgggaaaccgacggaaccgaaccgggtcgttaacggttagttacccgttagttacgtaacggtaacgtaaggttacgtacgttacgttaaggttcgggggtaatttccgggaccgtaacgggggttaacccgggggtaacttaacccggg

SEQ ID NO: 93083 - DNA, 688 bp, Homo sapiens
  misc_feature: GYAE6OF02GARW7.18.78.H01.1.454.CMB.1.raw
  modified_base (305)..(305): a, c, t, g, unknown or other
  misc_feature (305)..(305): n is a, c, g, or t
tcagtacgagtatgcacgaccggtgctcgatttagtgtgagtagtttgggtttggggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttatactatgtctcctggtaccacagcaccgaggcaaacgcccccaactcatgatttangatgtcagtaagtccgcctgtacgggtttactaacgttcgtcttcgtcgtcggtctaccaagttcctaggaccaacgccgggtccccttcccgtacgaaccctacttcccgttcgtcggggtaccctacccgacgggtccgtaagggacggggaacgtacgggtccttagtaacgttttacgttacgtcgaccgtacgtccttacgtaattaactaaccgtaacgaccaaccgtacgacctaaccttccttaactagttacgttaccgttaccgggacgttaccggggaaccgtaacgggttcccgtaacccggttccgttaacggtaccaaccggtacccgtaaaccggtaccccctaaccccgtaccgttacgtaaccccg

SEQ ID NO: 93084 - DNA, 637 bp, Homo sapiens
  misc_feature: GYAE6OF02JW7VE.18.78.H01.1.454.CMB.1.raw
  modified_base (233)..(233): a, c, t, g, unknown or other
  misc_feature (233)..(233): n is a, c, g, or t
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
  modified_base (389)..(389): a, c, t, g, unknown or other
  misc_feature (389)..(389): n is a, c, g, or t
  modified_base (432)..(432): a, c, t, g, unknown or other
  misc_feature (432)..(432): n is a, c, g, or t
  modified_base (462)..(462): a, c, t, g, unknown or other
  misc_feature (462)..(462): n is a, c, g, or t
tcagtacgagtatgcacgaccggtgctcgatttagtgtgagtagtttgggtttgggggggggtctcaggaggcagcgctctcgggacgtctccaccatcggcctgggctctgctattcctcacctcctcactcaggcacagggtctgggaccagtctgccctagactcagcctgcctcgtctctcgggtcctcctaggatggtcgatcacccatctcctgacacgtggaaccngcagtcgaacgttggtgttanaatctgtctctgtccanagcncncggacaacgacccaacgtcatcgtatactagactgtacaaccgtagtccgaccgttacgtaggtttcacttgtaccttctcgtcggtcctacgtactcgtacggacctaacncccggtcctacccgtcgcctacttccgtcgtacggccgttacncggtaacgttcgggaccggaagaccgggtntacggttactttaacgtgtaccgtcaggtacctactaccttaaacgacgaaaccggttccaaacgtcggtacctacttcccgttatccgttactcggtagtaacccgttcggaacggtaccgtagtaccggtctaacgggacttaccgacccgacgaccctaccggattaccccg

SEQ ID NO: 93085 - DNA, 737 bp, Homo sapiens
  misc_feature: GYAE6OF02FZG76.18.78.H01.1.454.CMB.1.raw
  modified_base (311)..(311): a, c, t, g, unknown or other
  misc_feature (311)..(311): n is a, c, g, or t
tcagtacgagtatgcacgaccggtgctcgatttagtgtgagtagtttgggtttggggagctctgggagaggagctccagccttgggattccccagctgtctccactcggtgatcggcactgaatacaggagactcaccatggagtttgggctgagctgggttttccttgttgcttattttaaaaggtgtaccagtgtgaggtgcagcgtggtggaggtccgggggagcgttcggtccaggccggtgggggtccctaggtaaacctcgtcctgtcgcacgccttcgtggttccaccttcgagtcggcttcgngccttgtgcctcgtcggggtcccgccgtaggtccgttaccggggaaggcgtagggaggttgggtcgtaccgttagtaggaacacgaacgacgtaagtacggttacgctacgacgacatagtcgctcggcggtacggaaggaacggtcgtacggtttccgtacccgtctaccgaaagtaacgtactacttaagaaaccgtacaacggtcgtaatcctacggaactaaagtacgtaacgaaccgtaccgtaaacggaaacccggaagggaccctaaccgggtacgttaacggttacctttaacggtacgttaaccggtaacggtaccggttaagggttaacggtaaccgtttaaggtaacgggttttaggggtaacctttaaccgggtacggtaaaccggggggttaaccggggttaccttaaccggg

SEQ ID NO: 93086 - DNA, 826 bp, Homo sapiens
  misc_feature: GYAE6OF02H88KZ.18.78.H01.1.454.CMB.1.raw
  modified_base (215)..(215): a, c, t, g, unknown or other
  misc_feature (215)..(215): n is a, c, g, or t
tcagtacgagtatgcacgaccggtgctcgatttagtgtgagtagtttgggtttggggagctctgggagagagctccagccttgggattcccagctgtctccactcggtgatcggctactgaatacaggagctcacatggtagtttgggctgagtcgttggttttccttgttcgtacttagttttaaaaggtctaccgtagtagtggaggttgcgngtcggttagggtgggtacggggtacggggggtcggtcgtttacggtaccgtcggtcccgggttcggggggttaccctagtaaaccgtccttcgttcggtcgacacgttccgtacgttcgggttaaccttcccttagacggttcggactcgtacgtacgttagtcggtaaccgtacgttccggggtaccccgtacggtacgggtccgggttaaccgggaaacgggtccggttacggggtaggtttcggggggtaaccggtcccggttttaaggttaaacgtaaccgggaaacttaaacggtacgtaaacgtaacggtaccgaacggtagacgtaacctaggtactcgtcgtacggtacggttacggtaaggaaacgtcggtacggtttaaccgtaccgttcgtaaacaacgtaattacgtaaacgtacgtaaaccgaaaccgtaccgttacggttactaacggtacaaccttaagaccgtaaacgttagaacccgtaaagaaccgtagggtacccgtaacggtgttaaaccgtacgtacgttaccgtagtacgagttacggacttaagttaccgtaggtcggttatacggtaggaccgggtagggtctacgg

SEQ ID NO: 93087 - DNA, 513 bp, Homo sapiens
  misc_feature: GYAE6OF01B05V5.43.55.E11.1.454.CMB.1.raw
  modified_base (489)..(489): a, c, t, g, unknown or other
  misc_feature (489)..(489): n is a, c, g, or t
  modified_base (507)..(507): a, c, t, g, unknown or other
  misc_feature (507)..(507): n is a, c, g, or t
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcacatcagcagcctgcagcctgatgattttgctaacttattactgaccaacaatatgatttcttggccgtggacgttcggaccaagggaccaacggtagaaatacaaacggtactagtcggcnggcacctatctatcttcnttcccg

SEQ ID NO: 93088 - DNA, 516 bp, Homo sapiens
  misc_feature: GYAE6OF01CQ6XO.43.55.E11.1.454.CMB.1.raw
  modified_base (414)..(414): a, c, t, g, unknown or other
  misc_feature (414)..(414): n is a, c, g, or t
  modified_base (506)..(506): a, c, t, g, unknown or other
  misc_feature (506)..(506): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccggcagtcagagtattagtagctggttggcctggtatcagcagaaccaggaaagccctaggtcctgatctataaggcatctaattagaaagtgggtccattaaggttcagcggcagtggatcgtgggacagagtttactctcaccatcagcagctgcagcctgatgtattttgctaactttattactgacccaaanaattatgtatttcgttggtccgttggtacgttcggaccgagggaccacgtagaaatacgaaaacgtctagtcggcagcacctatcctgtctntacgttcccg

SEQ ID NO: 93089 - DNA, 564 bp, Homo sapiens
  misc_feature: GYAE6OF01DQ9ND.43.55.E11.1.454.CMB.1.raw
  modified_base (273)..(273): a, c, t, g, unknown or other
  misc_feature (273)..(273): n is a, c, g, or t
  modified_base (358)..(358): a, c, t, g, unknown or other
  misc_feature (358)..(358): n is a, c, g, or t
  modified_base (409)..(409): a, c, t, g, unknown or other
  misc_feature (409)..(409): n is a, c, g, or t
  modified_base (538)..(538): a, c, t, g, unknown or other
  misc_feature (538)..(538): n is a, c, g, or t
tcagtgtgagtagtcacgaccggtgctcgatttagcactcgcacgttgggtttgggggagtcagacccagtcaggacacagcatggacatgagggtccccgctcagctcctgggctcctgctgctctggctcccaggtgccaaatgtgacatccagatgacccagtctccttccaccctgtctggatctgtaggagacagagtcaccatcacttgccgggccagtcagagtattagtagctggttgcctggtatcagcagaaaccagggaaancccctaggttcctgatctataaggcatctaatttagaaagtggggtaccataaggttcagcgcagtgatctggacagagtttacnctcaccatcagcagcctgcagcctgtatgaattttgactaactttattacngtacccaaactaacttatagtaatttccgttgggcccgttgggacgtttcgggaccgtaaggggtaaccctaacggttacgggaaaattacgaaaacgtaacctaggtacgggtctacgactaaccctnttaccttagttcttcctaattccccg

SEQ ID NO: 93090 - DNA, 584 bp, Homo sapiens
  misc_feature: GYAE6OF01B7GYZ.43.55.E11.1.454.CMB.1.raw
  modified_base (272)..(272): a, c, t, g, unknown or other
  misc_feature (272)..(272): n is a, c, g, or t
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccggcagtcagagtatagtagctggttggcctggtatcagcagaaaccagggaacncccctaggtcctgatctataagcatctaattagaaagtgggtaccattaaggtcagtcggcagtgatcgtgggacagtagtttactctcacatcagcagctgcacgctgatgtattttgactaacgttatactcgacctaaactaattacgttagtaactttcgttacgggaccgttagggtaccgtttcgggaaccgtaaacgggaacccgtaaaggtacggtaaaacgtaccgtaaaacggtaaccgttaggtacgggctacgtaacccgaaccgtacttactacggtttccttacgtaactttcccccg

SEQ ID NO: 93091 - DNA, 534 bp, Homo sapiens
  misc_feature: GYAE6OF01DVA8Y.43.55.E11.1.454.CMB.1.raw
  modified_base (276)..(276): a, c, t, g, unknown or other
  misc_feature (276)..(276): n is a, c, g, or t
  modified_base (364)..(364): a, c, t, g, unknown or other
  misc_feature (364)..(364): n is a, c, g, or t
  modified_base (421)..(421): a, c, t, g, unknown or other
  misc_feature (421)..(421): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaancccctaggttcctgatctataaggcatctaattagaaagtgggtacccattaaggttcagcggcagtggatctgggacagagtttacnctcaccatcagcagcctgcagcctgatgtaattttgactaactttatactgaccaanaatatgatttcttggccgtggacgtttcggaccaagggaccaaacggtggaaaactcgaaaacgaccgttaggacggctaggccaaccctataccttggtccttcgattcccc

SEQ ID NO: 93092 - DNA, 534 bp, Homo sapiens
  misc_feature: GYAE6OF01C7F1W.43.55.E11.1.454.CMB.1.raw
  modified_base (365)..(365): a, c, t, g, unknown or other
  misc_feature (365)..(365): n is a, c, g, or t
  modified_base (520)..(520): a, c, t, g, unknown or other
  misc_feature (520)..(520): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggcagtcagagtattagtagctggttggcctggtatcagcagaaaccagggaaaagcccctaggttcctgatctataaggcatctaatttgaaaagtgggtacccattaaggttcagcgcagtggatctggggacagagtttacntcaccatcagcagcctgcagcctgattgattttgctaatttattacctgaccaaacaattatgtaatttcttggccggttggaccgtttcgggaccctaaggggaacctaaacggtagaaaactcaaaacgaacttgtaggctagccacattctnttcttcattccccg

SEQ ID NO: 93093 - DNA, 511 bp, Homo sapiens
  misc_feature: GYAE6OF01CSMB4.43.55.E11.1.454.CMB.1.raw
  modified_base (363)..(363): a, c, t, g, unknown or other
  misc_feature (363)..(363): n is a, c, g, or t
  modified_base (505)..(506): a, c, t, g, unknown or other
  misc_feature (505)..(506): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaattagaaagtgggtccattaaggtcagcggcagtggatcgtgggacaggagtttacnctcaccatcagcagcctgcagcctgatgtattttgctaacttattactgaccaacaatatgtattcgttggccgttggaccgttcggaccaagggaccaacggtggaaactcgaaacgactgtaggctgcacatctgtcttnnttccg

SEQ ID NO: 93094 - DNA, 570 bp, Homo sapiens
  misc_feature: GYAE6OF01C7LMO.43.55.E11.1.454.CMB.1.raw
  modified_base (240)..(240): a, c, t, g, unknown or other
  misc_feature (240)..(240): n is a, c, g, or t
  modified_base (274)..(274): a, c, t, g, unknown or other
  misc_feature (274)..(274): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttcaccctgtctggatctgtaggagacagagtcaccatcacttgccgggccagtcagagtatagtagntggttggcctggtatcagcagaaccagggaaacncccctaggtcctgatctataggcatctaatttagaaagtgggtaccagttaaggtcagcgcagtgatcgtgggacngtagtttacnctacacctatcagtcacgtcctgactagcctgacttgtatttcgactaactttatacctgaaccaactaatattcgtatttcgttgggccgttagggtaccgtttaccgggaccgtaacgggtaacccgtaaacggtaggaaaactcggaaaacgtaaccgtggtacggctacgacccactacgttctagttaccttcgtaacttccccg

SEQ ID NO: 93095 - DNA, 516 bp, Homo sapiens
  misc_feature: GYAE6OF01BF6ZJ.43.55.E11.1.454.CMB.1.raw
  modified_base (508)..(508): a, c, t, g, unknown or other
  misc_feature (508)..(508): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttggccgggccagtcagagtattagtagctggttggcctggtatcagcaagaaaccagggaaacgcccctaggttcctgatctataaggcatctaattagaagtgggtccattaggtcagcgacagtggatcgtgggacagtagtttactctcacatcagcagcctgcagcctgatgtatttgactaacttattactcgaccaaataatatgtattcgttggcgttggacgttcggaccgaagggaccaaggtagaaatacgaaacgacgtagtgctgacacgtatctagtctntcgtaccc

SEQ ID NO: 93096 - DNA, 500 bp, Homo sapiens
  misc_feature: GYAE6OF01CC6F6.43.55.E11.1.454.CMB.1.raw
  modified_base (472)..(472): a, c, t, g, unknown or other
  misc_feature (472)..(472): n is a, c, g, or t
  modified_base (493)..(493): a, c, t, g, unknown or other
  misc_feature (493)..(493): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtcctccttccaccctgtctggatctgtaggagacagatcacatcacttgccggcagtcagagtattagtagctggttggctggtatcagcagaaaccagggaacgccctagtcctgatctatagcatactaattagaagtgggtacctagttaaggtcagcggcaggtgatcgtggacagtagtttactctcacatcagcagcctgcagctgatgtatttgactaattacttactgaccaacaatatgtattcgtggtccgtggacgttcgacgacggaaccagacgaatacaaacggtactggngctgacacgtactctgttctncgttccc

SEQ ID NO: 93097 - DNA, 561 bp, Homo sapiens
  misc_feature: GYAE6OF01BWXBS.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtgggtacccagttaaggttcagcggcaggtggatcgtgggacagagtttactctcaccatcagcagcctgcagcctgatgtattttgactaacttattacctagaccaaactaatatgtatttcgttggccgttaggtacgtttccgggaccgaacgggaaccaacggtaggaaaactaccgaaaacgtaacgttaggtacgggtacctaggaccaacctatccgttagtcctttcgacttcccc

SEQ ID NO: 93098 - DNA, 532 bp, Homo sapiens
  misc_feature: GYAE6OF01A63SB.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccgagggaaacgcccctaggtcctgatctataggcatctaatttagaaagtggggtacctattaaggttcagcggcaggtggagtcgtgggactagagtttactctcaccatcagcagcctgcagcctgatgtatttgactaacttattactgaccaactaatatgtatttcttggtccgttggtaccgttcgggaccgaagggaccaacggtaggaaaactccgaaacgtacgtgtaggctgaccactatctgtcttctatcccg

SEQ ID NO: 93099 - DNA, 611 bp, Homo sapiens
  misc_feature: GYAE6OF01CUBYF.43.55.E11.1.454.CMB.1.raw
  modified_base (199)..(199): a, c, t, g, unknown or other
  misc_feature (199)..(199): n is a, c, g, or t
  modified_base (375)..(375): a, c, t, g, unknown or other
  misc_feature (375)..(375): n is a, c, g, or t
tcagtgtgagtagtcacgaccggtgctcgatttagcactcgcacgttgggtttgggggggagtcagacccagtcaggacacagcatggacatgagggtccccgctcagctcctggggctcctgctgctctggctcccaggtgccaaatgtgacatccagatgacccagtctccttccaccctgtctggatctgtagganacagagtcaccatcacttgccgggcagtcagagtattagtagcgtggttggcctggtatcagacaagaaaccgagggaaacgccccgtaggttcctgatctataaggcatactaattaggaagtcgggtacctagttaacggtcagcggcagtggatcgtgggacagtagtttacnctacacatcagcagcctgcagtcctagtatgttatttcgacttaaactttacttaccgtacgaacctaaactaattagtacgttactttccggttacgggtcccggttagggtaccggttccgggaacccgtaacggggtaaccctaaacggtaggtaaaacgtaccgaaaacggtaacgttggtacggtctacgtaccaacctacttacctgtttaccctcgttacttacccccg

SEQ ID NO: 93100 - DNA, 521 bp, Homo sapiens
  misc_feature: GYAE6OF01ER4Y2.43.55.E11.1.454.CMB.1.raw
  modified_base (515)..(515): a, c, t, g, unknown or other
  misc_feature (515)..(515): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtgggtccattaaggtcagcgcagtggatctgggacagagtttactctcacatcagcagcctgcagcctgatgatttgactaacttattactgaccaataatatgattcgttggccgttggacgttcggaccgaagggaccaaacggtaggtaaactacgaaaacgtaacgtagtaggctgacacctatctagttcttcnttcccg

SEQ ID NO: 93101 - DNA, 540 bp, Homo sapiens
  misc_feature: GYAE6OF01C7IGN.43.55.E11.1.454.CMB.1.raw
  modified_base (276)..(276): a, c, t, g, unknown or other
  misc_feature (276)..(276): n is a, c, g, or t
  modified_base (336)..(336): a, c, t, g, unknown or other
  misc_feature (336)..(336): n is a, c, g, or t
  modified_base (360)..(360): a, c, t, g, unknown or other
  misc_feature (360)..(360): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcaagaaccagggaaancccctaggttcctgatctataggcatctaattagaaagtgggtaccattaaggtcagcgnagtgatcgtggacagtagtttacnctcacctatcagcagcctgcagcctgatgtaatttcgactaactttattactgtaccaactaattatgtatttcgttcggtccggttggtaccggttcggaccgtagggaacctaacggtaggaaacttacgaaaacggtactggtacggctcgaccactatcgtgtcctctacttcccg

SEQ ID NO: 93102 - DNA, 748 bp, Homo sapiens
  misc_feature: GYAE6OF01A6W3O.43.55.E11.1.454.CMB.1.raw
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtcctcctccacctgtctggatctgtaggagacagagtccaccatcacgttcggcccgggccagtcagtagttattagtagtcgttggttcggccgttggtatcgagacaaacggaaaccgaagggaaccgtccccgttaggttcctagtactacctaagtaacggctatacttaaagtttaaggaaggttcgggtaccctaagttaacggtcgacggcggacgtaggtggactcggtagggaactaggttacgtttacctccgtaccaacctactacgacgaccacgtccctgaccgtacgtcccgttagtacgttagttagttttacgaaccttaaactttacgttaacctacgtaaccctaaagttaacttaacgttagttaacgttttccggttaccgggttacccgggttacgggttacccgggttacccgggaacccggtaaacggggtaacccgtaaacgggttaacgggtaaaaccgttaaccggaaaaaccggtaaccggttagggtaccgggtcctacggaccctaaccgttacttaccggtttaccgttcctttacccgtacgtttcccccg

SEQ ID NO: 93103 - DNA, 604 bp, Homo sapiens
  misc_feature: GYAE6OF01A7FSN.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatcgtgggacagagtttactctcaccatcagcagcctgcagcctgatgtattttggggactaactttactttactacgtacctaaactaataattagtaactttacgttcgggtccggttcgggtaccggtttacgggacccgtaacgggtaacccgtaaacggtacgggtaaaacgttaccgtaaaacggtaaaccgttaggtacggtacgtcggaccaacccgtactaccttacgttacctttcgtacttaccccg

SEQ ID NO: 93104 - DNA, 723 bp, Homo sapiens
  misc_feature: GYAE6OF01C9BLP.43.55.E11.1.454.CMB.1.raw
  modified_base (103)..(103): a, c, t, g, unknown or other
  misc_feature (103)..(103): n is a, c, g, or t
  modified_base (411)..(411): a, c, t, g, unknown or other
  misc_feature (411)..(411): n is a, c, g, or t
  modified_base (490)..(490): a, c, t, g, unknown or other
  misc_feature (490)..(490): n is a, c, g, or t
tcagtgtgagtagtcacgaccggtgctcgatttagcactcgcacgttgggtttggggggagtcagacccagtcaggacacagcatggacatgagggtccccgntcagctcctggggctcctgctgctctggctcccaggtgccaaagtgtgacagtccaaggatcgacccagtcctccttccaccctgtctggatctgtaggagacagagtcacatcacttgccggcagtcagagtattagtgcgtggttcggcctggtatcgagaccaagaaaccgtagggaaacctccccgttaaggttcctaggattacgtaagtaaggacctagttacttaaagttttaaggaaacggttcgggtacctaagttaagggtcaggtcgacaggtgatcgtagggacagtacgtttacnctcaacctatacacgcacgtcctagaccgacgtcctagtacttagttaactttacgaacttaactttaattaccgttanaaccctaaagtattaagtacgttacgttttacggttaccggtaccggttacggtacccgggtttaccgggaacccgtaaacggggtaacccgtaaacgggttaaacgggtaaaaacctaccgtaaaaaaccgggttacgttaaccgggttacggtcccgttaacggtaacccctaaacccgttaacggtttacccgttagtttacccctttttaaccacccgttttacccccg

SEQ ID NO: 93105 - DNA, 601 bp, Homo sapiens
  misc_feature: GYAE6OF01EAW4I.43.55.E11.1.454.CMB.1.raw
tcagtgtgagtagtcacgaccggtgctcgatttagcactcgcacgttggggtttgggggggagtcagacccagtcaggacacagcatggacatgagggtccccgctcagctcctggggctcctgctgctctggctcccaggtgccaaatgtgacatccagatgacccagtcctccttccaccctgtctggatctgtaggagacagagtcaccatcacttgccggccagtcagagtattagtagctggttggcctggtatcagcagaaaccagggaaacgccccgtaggttcctgactctataaggcatactaattagaagtgggtacctattaaggtcagcggcagtggatcgtagggacagtacgttactctacaccatcagcagcctgcacgtctgtatgtatttcgacttaactttatactcgacctaactaatatagtatttaccgttgggtaccgttacgggtaccggtttcgggaccgtaaacggggacctaaaacggtacgggaaaacttaaccgaaaaccggtacgttaggtacgggtcctacggacccaacccgttacgttaccgttagttccgtttctacgtttacccccg

SEQ ID NO: 93106 - DNA, 585 bp, Homo sapiens
  misc_feature: GYAE6OF01CCXZG.43.55.E11.1.454.CMB.1.raw
  modified_base (404)..(404): a, c, t, g, unknown or other
  misc_feature (404)..(404): n is a, c, g, or t
  modified_base (459)..(459): a, c, t, g, unknown or other
  misc_feature (459)..(459): n is a, c, g, or t
tcagtgtgagtagtcacgaccggtgctcgatttagcactcgcacgttgggtttgggggggagtcagacccagtcaggacacagcatggacatgagggtccccgctcagctcctggggctcctgctgctctggctcccaggtgccaaatgtgacatccagatgacccagtcctccttccaccctgtctggatctgtaggagacagagtcaccatcacttcggcccgggccagtcagtagtattagtagcgttgggttggcctggtatcagacgaacgaaaccgaagggaaacgccccgttaggttccctggatactataaggacatactaagttagaaaggttcgggtacctagttaaggttcaggcggcgtaggtggtatcggtagggactaagtacgtttacnctacactatcagtcacgcctagcagcgtgattgtatttcgacttaacttactacncgaacaatatatgtattcgtcggtcgttacggtaccggtacgaccggaacggaacctaacggtaagtaaactaacgaaacgtacgtggtacgcgtcgaccacctattctcgttctcgtccttcccg

SEQ ID NO: 93107 - DNA, 614 bp, Homo sapiens
  misc_feature: GYAE6OF01ALK8P.43.55.E11.1.454.CMB.1.raw
  modified_base (364)..(364): a, c, t, g, unknown or other
  misc_feature (364)..(364): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtgggtccattaaggttcagcggcagtggatcgtgggacagagtttacnctcaccatcagcagcctgcagcctgattgattttgactaaactttattacctgtacccaaacaataattcgtaatttaccgttcgggcccgttgggtaaccgtttcgggacccgaaacggggtaaccctaaacggttacgggaaaaacttacccgaaaaacggtaacccgttagggtacgggtacccgttacggaccctaaccccgtaacgttaccttacggtttaccctttccgtaacctttacccccg

SEQ ID NO: 93108 - DNA, 561 bp, Homo sapiens
  misc_feature: GYAE6OF01CEG2A.43.55.E11.1.454.CMB.1.raw
  modified_base (525)..(525): a, c, t, g, unknown or other
  misc_feature (525)..(525): n is a, c, g, or t
  modified_base (543)..(543): a, c, t, g, unknown or other
  misc_feature (543)..(543): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaacgcccctaggttcctgatctataggcatctaatttagaagtgggtacccagttaaggtcagcggcaggtggatcgtaggggacaggtagttttactctacaccatcagcacgcctgcagcctgatgtatttgactaactttacttactgaccctaataattatagtactttcgttaggccgttgggtaccgttcggaccgaacgggtacctaaacggtcggaaaactacgaaaacgtacgtaggtcggtcncgtacaccgtatccgttnttccttctactttccccg

SEQ ID NO: 93109 - DNA, 612 bp, Homo sapiens
  misc_feature: GYAE6OF01AX1F3.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttcgccgggcagtcagagtattagtagctggttggcctggtatcagcaagaaaccagggaaacgcccctaaggttcctgatctataaggctatactaatttagaaagtgggtacctaattaaggttcagcggcaggtgatcgtagggacagtagtttactctcacatcagcagcctgcagcctgatgtattttgacttaactttattactacgacctaaactaattatagttaatttccgttcgggtacccgttagggtaccggtttaccgggacccgtaaacggggtaaccctaaacgggtaaggtaaaactaaccgtaaaacggtaacgttaggtacggcttacggaccctaaacccgtattacccgttgtttaccctttcaaccgttttcccccg

SEQ ID NO: 93110 - DNA, 566 bp, Homo sapiens
  misc_feature: GYAE6OF01CSPSW.43.55.E11.1.454.CMB.1.raw
tcagtgtgagtagtcacgaccggtgctcgatttagcactcgcacgttggggtttggggggagtcagacccagtcaggacacagcatggacatggagggtccccgctcagctcctggggctcctgctgctctggctcccaggtgaccaaatgtgacatccagatcgaccctagtccttccttccaccctgtctggatctgtaggagacagagtcaccatcacgttggccggcagtcagagtattagagctggtgctggtatcagacaagaaaccgagggaacgcccgtaggttcctgactactagtaagctatacttaagttaagaaaggtcgggtacctaagttaaggtacaggcggactaggtaggtagtcgtagggaactagtagtttactctacaaccatcagcacgtcctgacagtctagtattagtatttgaacttaacttatacacgaactaatatatgtacttcgtggccgtaggtacgtcggacgaaggaccgaagtagaaactacgaaacgtacgtgtcggctacgaccaacctattctacttccttctacgttccc

SEQ ID NO: 93111 - DNA, 621 bp, Homo sapiens
  misc_feature: GYAE6OF01B6U0U.43.55.E11.1.454.CMB.1.raw
  modified_base (197)..(197): a, c, t, g, unknown or other
  misc_feature (197)..(197): n is a, c, g, or t
  modified_base (412)..(412): a, c, t, g, unknown or other
  misc_feature (412)..(412): n is a, c, g, or t
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtagganacagagtcacatcacgttcgccggccagtcaaggtagtattagtagcgttggttggcctggtatcgagacaagaaaccgagggaaccgcccgttaggttcctagactcgtaagtaacggctaattacgttaaagtttaggaaaggttcggggtaccctaagttaagggttcaggcgtacgtaggtggtatcgtagggactaaggttacgtttacnctaccaaccatacgacgtcacgtcctggaccagtccgtagtacttaggttatttttcgaacttaacgtttatactacgaacctaatagtactgtatttcgtggtccgtagtaccggttcgacgaagggtaacccaaggtacgaaaacgtaccgaaacgtacgtggtacggcttaggaccctactacgttctagtccttacgtcttcccg

SEQ ID NO: 93112 - DNA, 551 bp, Homo sapiens
  misc_feature: GYAE6OF01BSG59.43.55.E11.1.454.CMB.1.raw
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
tcagtgtgagtagtcacgaccggtgctcgatttagcactcgcacgttggggtttgggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagcgtggttggccttggtatcagacaagaaaccgagggaaacgcccctaggttcctgatctanaaggcatactaattagaagtgggtacctagttagtcagcgnagtgatcgtgggacagtagttactctacaccatcagcacgcctgcacgcctagattgtaatttcgactaactttatactcgaccaaataatatgtactttcgtcggccgttaggtaccgttcggaccgaacgggaaccaaggtacgaaactacgaaacgtacgtggaggtcacgaccaccgtatcttagttccttctcgttccccg

SEQ ID NO: 93113 - DNA, 588 bp, Homo sapiens
  misc_feature: GYAE6OF01E1SR5.43.55.E11.1.454.CMB.1.raw
tcagtgtgagtagtcacgaccggtgctcgatttagcactcgcacgttgggtttgggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaacgcccctaggttcctgatctataggcatctaattagaagtgggtccattaaggtcagcggcaggtggatcgtgggacagagtttactctcaccatcagcagcctgcagtcctgatgtattttgactaactttattactcgacccaaactaattatagtacgtttacgttcgggtccggttagggtaccggtttcgggaccgtaaacgggggtaacccgaaacgggttacgggtaaaactacgaaaaccggtaaccgttagggtcgggctacggtaccaccgtacttaccttagttccttcgtacttaccccg

SEQ ID NO: 93114 - DNA, 533 bp, Homo sapiens
  misc_feature: GYAE6OF01EHIMJ.43.55.E11.1.454.CMB.1.raw
  modified_base (278)..(278): a, c, t, g, unknown or other
  misc_feature (278)..(278): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcaagaaaccagggaaacncccctaggttcctgatctataaggcatctaatttagaaagtgggtccattaaggtcagcgcagtggatcgtgggacagtagtttactctcacatcagcagcctgcagcctgatgtattttgactaacttattactgaccaactaatatgtatttcgttggccgttaggtaccgttcggaccgaacgggaccaacggtaggaaactacgaaacggtaactaggtggctgaccacctatctagttcttcattccccg

SEQ ID NO: 93115 - DNA, 533 bp, Homo sapiens
  misc_feature: GYAE6OF01BZF8J.43.55.E11.1.454.CMB.1.raw
  modified_base (340)..(340): a, c, t, g, unknown or other
  misc_feature (340)..(340): n is a, c, g, or t
  modified_base (414)..(414): a, c, t, g, unknown or other
  misc_feature (414)..(414): n is a, c, g, or t
  modified_base (428)..(428): a, c, t, g, unknown or other
  misc_feature (428)..(428): n is a, c, g, or t
tcagtgtgagtagtcacgaccggtgctcgatttagcactcgcacgttgggtttggggggagtcagagccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaacgcccctaggttcctgatctataaggcatctaattagaaagtgggtccagttaaggttcagcggnagtggatcgtgggacagtagtttactctcaccatcagcagcctgcagcctgatgtatttgactaacttattacngtaccaatatagtntattcgttggccgtggtaccgttcggaccaagggacctaacggtaggaaactacgaaaccggtagtaggtcggctacgactacctattcctagttcccttctacc

SEQ ID NO: 93116 - DNA, 558 bp, Homo sapiens
  misc_feature: GYAE6OF01BBM8A.43.55.E11.1.454.CMB.1.raw
  modified_base (400)..(400): a, c, t, g, unknown or other
  misc_feature (400)..(400): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcaagaaccagggaaacgcccctaggttcctgatctataggcatctaattagaagtgggtcccagttaagtcagcgcagtgatcgtggacagtagttactctcacatcagcagcctgcagcctagatgtatttgctaattntactgaccaataatatgtatttcgttagggtccgttaggtaccgttcggaccgaacgggtaccaacggtaggaaaactaccgaaaacggtaacgttaggacgggtaccttacggacctaacccgtacttaccgttagtccctttacgactttcccccg

SEQ ID NO: 93117 - DNA, 555 bp, Homo sapiens
  misc_feature: GYAE6OF01BWVHB.43.55.E11.1.454.CMB.1.raw
  modified_base (519)..(519): a, c, t, g, unknown or other
  misc_feature (519)..(519): n is a, c, g, or t
  modified_base (533)..(533): a, c, t, g, unknown or other
  misc_feature (533)..(533): n is a, c, g, or t
tcagtgtgagtagtcacgaccggtgctcgatttagcactcgcacgttgggtttggggggagtcagacccagtcaggacacagcatggacatgagggtccccgctcagctcctgggctcctgctgctctggctcccaggtgccaaatgtgacatccagatgacccagtctccttccaccctgtctggatctgtaggagacagagtcaccatcacttgccgggccagtcagagtattagtagctggttggcctggtatcagaagaaacgaacggaaggaccctacggttcctcgatctactaaggcgatactaatttagtaaagtagggtccgtacttaaaggttactagacggacgagtaggagtacttgggacgagtagtttaactctcaccatctagcagctcgacgagctgatgattttgtacaacttattatacgaccaacaataatgattcgtggtccgtaggtacgttacgcaagggaccgaacgtaggtaactacaaacgaaccgtgtgcgtnacaaccgactcttntacgttctacgtccttaccccg

SEQ ID NO: 93118 - DNA, 618 bp, Homo sapiens
  misc_feature: GYAE6OF01BSORO.43.55.E11.1.454.CMB.1.raw
  modified_base (371)..(371): a, c, t, g, unknown or other
  misc_feature (371)..(371): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagcgtggttggcctggtatcagcagaaaccagggaacgcccctaggttcctgactctataggcatactaattagaagtcgggtacctagttaaggttcgagcggacagtggatcgtaggacagtagtttacnctacacatcagcagctgcagctgatgtatttgactaacttattactcgacctaactaattacttagtacgtttcgttacgggtccggttacgggtaccggtttaccgggaccggtaaacggggtaacccgtaaacgggttaccggtaaaacgtaaccgtaaaaaccgggtacgttacgggtacgggtaccgttacgacccgtaacccgtacttaccttaggtttccttaccgtaccgtttacccccg

SEQ ID NO: 93119 - DNA, 520 bp, Homo sapiens
  misc_feature: GYAE6OF01CA2SS.43.55.E11.1.454.CMB.1.raw
  modified_base (360)..(360): a, c, t, g, unknown or other
  misc_feature (360)..(360): n is a, c, g, or t
  modified_base (371)..(371): a, c, t, g, unknown or other
  misc_feature (371)..(371): n is a, c, g, or t
tcagtgtgagtagtcacgaccggtgctcgatttagcactcgcacgttgggtttgggggggagtcagacccagtcaggacacagcatggacatgagggtcccccgctcagctcctggggctcctgctgctctggctcccaggtgccaaatgtgacatccagatgacccagtctccttccaccctgtctggatctgtaggagacagagtcaccatcacttgccgggccagtcagagtatagtagctggttggcctggtatcagcaagaaaccaggaaacgcccctaggtcctgatctataagcatctaattagaaagtgggtccaataaggttcagcgcagtgatcgtggacagagtttacnctcaccatcancagcctgcagcctgatgattttgactaacttatactcgacaaactaatatgtattcgttggcggtgacgttcggaccgaacggaccaagtaggaaataacgaaacgaacgtagacggcgtagacgaacctatacttgtcttcattcccg

SEQ ID NO: 93120 - DNA, 566 bp, Homo sapiens
  misc_feature: GYAE6OF01A95PQ.43.55.E11.1.454.CMB.1.raw
  modified_base (556)..(556): a, c, t, g, unknown or other
  misc_feature (556)..(556): n is a, c, g, or t
tcagtgtgagtagtcacgaccggtgctcgatttagcactcgcacgttggggtttgggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcaagaaaccagggaaacgcccctaggttcctgatctataaggcatctaatttagaaagtgggtacctagttaaggtcagcggacagtggatcgtgggacagtagtttactctacaccatcagcagcctgcagcctgatgtattttcgactaactttattactgacctaaactaatatagtatttcgttgggacccgttagggtaaccgttcggaaccgaagggaaccaaaggtaggaaaactaccgaaaacggtactggtaggctacgacaacccgtattcgttagttccttcncgttaccccg

SEQ ID NO: 93121 - DNA, 563 bp, Homo sapiens
  misc_feature: GYAE6OF01BF3BN.43.55.E11.1.454.CMB.1.raw
  modified_base (295)..(295): a, c, t, g, unknown or other
  misc_feature (295)..(295): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccggccagtcagagtattagtagctggttggcctggtatcagcaagaaaccgaggaacgccctaggttcctgatctanagcatactaattagaagtgggtacctagttaagtcagcgcagtggatcgaggactagtagtttactcgtacaccatcagcagcctgcagtcctgtatgtatttcgactaactttatactcgacctaataattagtagtaacgttcgttacgggtccgttacggtaccggttcggaccgtaaacggggacctaacggtaaggtaaacctaacgaaacgtacgtggtacggtactcgaccacgtacttcgttcgtcttctacgttccccg

SEQ ID NO: 93122 - DNA, 813 bp, Homo sapiens
  misc_feature: GYAE6OF01B70KY.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagacgtcaccatcacttcggccggcagtcagagtattagagcgtggttggcctaggtatcgagacgaaagaaaccgaagggaaaccgtccccgtaggttccctagtacttacgtaagaacggtctaattacttaaagtttaaggaaacggttcggggtaccctaagttaacgggttacacggacggtacgaaggttacggtaagttcggtaacggggtaactaacgggttaacgttttaacctacccgttacctaaacctaacgttaccaacggtactaacggtccctaggtccgaacgtccgttaagtacgtttaacgttaacgtttttacggaacctttaaacgttttaacgtttaccgtaacgtaacctaaaacgttaatttaacgttagtttacgtttaccgggttaccggtaccgggttaccggggttaacccgggtttacccgggaaacccgggtaaaccggggtaaacccgtaaaaccggttaacgggtaaaaaccgttaaacggtaaaacccggtaacggttacggtaaccgggtccgtaaccggtaacccttaccgtaaactttccggtttaacctttccgttacccgttaaccgtttccccgg

SEQ ID NO: 93123 - DNA, 652 bp, Homo sapiens
  misc_feature: GYAE6OF01B2G4S.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggcagtcagagtattagtagctggttggcctggtatcagcaagaaaccgaggaacgccccgtaggttcctagatctagtaaggctatactaattaggaaaggttcgggtacctaagttaaggttcagcggacagtggatcgtgggactaggtattactctacacatcacgtacacgcctgcacggtctagtacttgtattttacgacttaactttagttactacgtaacctaaactaattagttacgttactttcgttaccgggaccggttacgggtaaccggtttaccgggaacccgtaaacggggtaaacccgtaaacgggttaacgggtaaaaaccttaaccggaaaaccggtaaacgttagggtacggtacctaccggtaacctaacccgtagttaccgttacgttttcctaccgttcgttacccccg

SEQ ID NO: 93124 - DNA, 554 bp, Homo sapiens
  misc_feature: GYAE6OF01CSEL7.43.55.E11.1.454.CMB.1.raw
  modified_base (275)..(275): a, c, t, g, unknown or other
  misc_feature (275)..(275): n is a, c, g, or t
  modified_base (334)..(334): a, c, t, g, unknown or other
  misc_feature (334)..(334): n is a, c, g, or t
  modified_base (359)..(359): a, c, t, g, unknown or other
  misc_feature (359)..(359): n is a, c, g, or t
  modified_base (528)..(528): a, c, t, g, unknown or other
  misc_feature (528)..(528): n is a, c, g, or t
tcagtgtgagtagtcacgaccggtgctcgatttagcactcgcacgttgggtttggggggagtcagacccagtcaggacacagcatggacatgagggtccccgctcagctcctgggctcctgctgctctggctcccaggtgccaaatgtgacatccagatgacccagtctccttccaccctgtctggatctgtaggagacagagtcaccatcacttgccggccagtcagagtattagtagcgtggttggcctggtatcagcaagaaccagggaacncccctaggtcctgatctatagcatactaattagaaagtgggtaccagttaagtcagcgnagtgatcgtggactagtagtttacnctacacctatcagcagcctgacagcctagtattgtatttgactaactttatactgacctaaatattaatgtactttcgttacgggtccgttaggtaccgttccggaccgtaagggaccctaaggtaggaaaactcgaaaacggtactggtacggtctacgacctacctnttacgttgtaccttcgtacttccccg

SEQ ID NO: 93125 - DNA, 511 bp, Homo sapiens
  misc_feature: GYAE6OF01CH49Q.43.55.E11.1.454.CMB.1.raw
  modified_base (274)..(274): a, c, t, g, unknown or other
  misc_feature (274)..(274): n is a, c, g, or t
  modified_base (370)..(370): a, c, t, g, unknown or other
  misc_feature (370)..(370): n is a, c, g, or t
  modified_base (425)..(425): a, c, t, g, unknown or other
  misc_feature (425)..(425): n is a, c, g, or t
  modified_base (432)..(432): a, c, t, g, unknown or other
  misc_feature (432)..(432): n is a, c, g, or t
  modified_base (504)..(504): a, c, t, g, unknown or other
  misc_feature (504)..(504): n is a, c, g, or t
tcagtgtgagtagtcacgaccggtgctcgatttagcactcgcacgttgggtttgggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattgtagctggttggcctggtatcagcaagaacagggaancccctaggtcctgatctataggcatctaatttagaaagtggggtaccctagttaaggttcaggcggcaggtggatcgtagggacaggtagtttacnctcacatcagcagcctgcagcctgatgtatttgactaactttatactgacctaanatatgtnttcgtggccgtgtacgtcgcgaggaccagtggaaactacaaacgtactggtacgctagcacgtatctgtctntctcccg

SEQ ID NO: 93126 - DNA, 744 bp, Homo sapiens
  misc_feature: GYAE6OF01CSE05.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtcctccttccaccctgtctggatctgtaggagacagagtcaccatcacttcggccggccagtcagagtattagtagcgtggttcggcttggtatcgagacgaagaaaccgagggaaaacgccccgtaaggttcctagtaactctaataacggctaatacttaaatttagaaagttcgggtacctaagttaaaggttcaggcgtcaggtgtatcgtagggacagtacgtttactcgtacaactatcgacgtcacggtcctagaccgtagtcccttaggtaattcgtttaaagttttcgtaaccttaaacgttttaactttaaccgtaccgtaaccctaaaattaaacgttaatttacggtttaacgtttccggtttacgggtaccccgggttacggggttaacccgggtttacccgggaaccggtaaaccggggtaacccgtaaaacgggtaaccggggtaaaaaactacccggaaaaaacggtaaccggttacggtaacgggtcccgtacggtaaccccttaacccgtacgttttaccgttacggtttacctttacccgtaacgttttaccccccgg

SEQ ID NO: 93127 - DNA, 601 bp, Homo sapiens
  misc_feature: GYAE6OF01E1Q0M.43.55.E11.1.454.CMB.1.raw
  modified_base (303)..(303): a, c, t, g, unknown or other
  misc_feature (303)..(303): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatcgacccagtcctccttccaccctgtctggatctgtaggagacagagtcaccatcacttgccgggccagtcagagtattagtagctggttggcctggtatcagacagaaaccgagggaacgccctaggtcctgactctataagntatactaattagaaagtgggtacccattaaggtcagcgcagtgatcgtggacagtagtttactctacaccatcagcagcctagcagtctgtatcgtatttgactaacttattactacgtaacctaaanaatagtntaatttcgtcggtaccggttaggtaaccggtttcggaaccgaaaggggtaaccctaaaacgggttacggtaaaacgtacccgtaaaaacggtaaccgttaggtacgggtcctacgaacccgtaacctacgttcttacgttcccgtttacacgtttacccccgg

SEQ ID NO: 93128 - DNA, 631 bp, Homo sapiens
  misc_feature: GYAE6OF01E351W.43.55.E11.1.454.CMB.1.raw
  modified_base (388)..(388): a, c, t, g, unknown or other
  misc_feature (388)..(388): n is a, c, g, or t
tcagtgtgagtagtcacgaccggtgctcgatttagcactcgcacgttgggtttggggggagtcagacccagtcaggacacagcatggacatcgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaacgcccctagttcctgatctataaggctatactaatttaagaaaggttcggggtacctaagttaaggttcaggcggacaggtggatcgtgggacagtacgtttactctacaacntacagcagcctgcagcctagtattgtattttcgacttaactttattacctcgaacctaaactaattacttagtactttcgttacgggtccggttaggggtaccggtttaccgggaacccgtaaacggggtaaccctaaacgggtacgggtaaaaactaaccggtaaaacggtaacgttagggtacggtcgtaccgaacccgtaccgtacttccgttacggttcctttccgtactttccccccg

SEQ ID NO: 93129 - DNA, 541 bp, Homo sapiens
  misc_feature: GYAE6OF01BRI80.43.55.E11.1.454.CMB.1.raw
  modified_base (427)..(427): a, c, t, g, unknown or other
  misc_feature (427)..(427): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcaagaaaccagggaaagcccctaggttcctgatctataaggcatactaattagaaagtgggtaccagttaagtcagcgcagtggatcgtgggacagtagtttactctacacatccagcagcctgcagcctgatgtattttgctaacttatactgaccaaataatatntattcgttggtcgtcggtacgttcggaccgaacgggaccaacggtagaaaactacgaaacggtacgtggtaggtccgtagaccacctagtcttaggttccttcgtacttccccg

SEQ ID NO: 93130 - DNA, 575 bp, Homo sapiens
  misc_feature: GYAE6OF01DSR17.43.55.E11.1.454.CMB.1.raw
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
  modified_base (366)..(366): a, c, t, g, unknown or other
  misc_feature (366)..(366): n is a, c, g, or t
  modified_base (547)..(547): a, c, t, g, unknown or other
  misc_feature (547)..(547): n is a, c, g, or t
tcagtgtgagtagtcacgaccggtgctcgatttagcactcgcacgttggggtttggggggagtcagacccagtcaggacacagcatggacatgagggtccccgctcagctcctggggctcctgctgctctggctcccaggtgccaaatgtgacatccagatcgacccagtctccttccaccctgtctggatctgtaggagacagagtcaccatcacttgccggccagtcagtagtattagagctggttcgctggtatcagcagaacagggaaancccgtaggttccngatctatagcatctaattagaaagtcgggtacctagttaaggttcaggcgcaagtggatcgtgggactagtagtttacnctacacctatcagcacgctgacagcctagattgtatttcgataacgtttatactacgactaaactatattgtaactttcgttcggccggttgggtaaccgttcggaacccggaagggtaacctaaacgggttagaaaacttacgtaaaaccggtagtagggtcgtagccgtaccaaccgtnttacttggtaccttcgtacttacccccg

SEQ ID NO: 93131 - DNA, 508 bp, Homo sapiens
  misc_feature: GYAE6OF01A2SUX.43.55.E11.1.454.CMB.1.raw
  modified_base (413)..(413): a, c, t, g, unknown or other
  misc_feature (413)..(413): n is a, c, g, or t
  modified_base (502)..(502): a, c, t, g, unknown or other
  misc_feature (502)..(502): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggtcctgatctataaggcatctaattagaaagtgggtccattaggtcagcggcagtggatcgtgggacagagtttactctcacatcagcagcctgcagcctgatgtatttgactaacttatactgaccaanatatgatttcgtggccgtggtacgttcggaccgaaggaccaagtaggaaactacaaacgctagtggctgaccactatctagtccttgtntccccg

SEQ ID NO: 93132 - DNA, 678 bp, Homo sapiens
  misc_feature: GYAE6OF01CF6UX.43.55.E11.1.454.CMB.1.raw
  modified_base (246)..(246): a, c, t, g, unknown or other
  misc_feature (246)..(246): n is a, c, g, or t
  modified_base (395)..(395): a, c, t, g, unknown or other
  misc_feature (395)..(395): n is a, c, g, or t
  modified_base (410)..(410): a, c, t, g, unknown or other
  misc_feature (410)..(410): n is a, c, g, or t
tcagtgtgagtagtcacgaccggtgctcgatttagcactcgcacgttggggtttgggggagtcagacccagtcaggacacagcatggacatgagggtccccgctcagctcctggggctcctgctgctctggctcccaggtgccaaatgtgacatccagatgacccagtctccttccacctgtctggatctggtaggagacagacgtcaccatcacgttgccgggaccagtcagagttattagtagngtggtcgcctggtatcgagacaacgaaacgagggaacctccccgtaggttcctagtactcgtaagacggtactagttacttaaagtttacggaaaggttcggggtacctaagtttaaggtcgaggcggtcagtggacgttcgagggtanaggtaacgtttaccncgttacaccgtatacagaccgacgtcctacggacgtaaccgtcctaggtactttagtacgttttacgactaaactttacttaacctacgtaaaccctaagtaatttagtacgttacgtttacggttaccgggtaccggttacgggtaaccggtttacccgaaccgggtaacgggaacccgtaaaggtacggaaacttaaccggaaacgtacgttaggtcggtactacgaccttaactcctttagtccttacgttccgtaccgttcccg

SEQ ID NO: 93133 - DNA, 758 bp, Homo sapiens
  misc_feature: GYAE6OF01DBH8W.43.55.E11.1.454.CMB.1.raw
tcagtgtgagtagtcacgaccggtgctcgatttagcactcgcacgttggggtttggggggagtcagacccagtcaggacacagcatggacatgagggtccccgctcagctccgtggggctcctgctgctctggctcccaggtgccaaatgtagacatccagatcgacccagtcctccttccacctgtctggatctgaggagacagatcacatcactgccggacagtcagtagtattagtagcgttggttcggccgtggtatcgaacgacgaaacggaaaccgacggggaaaccgtccccgttaagggttccctaggtaattaccgttaagtaacggtactaattacgtttaaagtttaaggtaaaacgggttcgggttacccttaaaggtttaacgggttacgaacgggtccggtacgtacgggtaggtacgttacggtaacggggtacctaaggttaacgtttactaccgtacctaacctacgtacgacgtcgtaacggtcctcggtaccgtaacggtccgtaggtaacgtttaggttaacgttttacggaacctttaaacgtttacttaaccgtacgaaccctaaagtaacttacgtagtttacgtttacggtcgggtaaccgttacgggtaccggttaccgggaaccggtaaacgggtaaccgtaacggtaaaggtaaacctaacggtaaacggtacgttaggtacggtcgtacgaccctacgtacttaccgttatcccgttactccgttccccg

SEQ ID NO: 93134 - DNA, 864 bp, Homo sapiens
  misc_feature: GYAE6OF01EE6OG.43.55.E11.1.454.CMB.1.raw
  modified_base (537)..(537): a, c, t, g, unknown or other
  misc_feature (537)..(537): n is a, c, g, or t
  modified_base (544)..(544): a, c, t, g, unknown or other
  misc_feature (544)..(544): n is a, c, g, or t
tcagtgtgagtagtcacgaccggtgctcgatttagcactcgcacgttggggtttgggggggagtcagacccagtcaggacacagcatggacatggacgggtccccgctcagctccgtggggcctcctgctgctcgtcggcctcccgaggtcgaccaaagtgtagacactccgagactcgaccctagtccttcccttccctaccccttggtcgtaggtacttcgtagggtaacgggaagacgaaggtacgtaccaaccgtaacttccgtaccggttccgggcccgggacctacggtactaaggtaagttaagtttaacggcggttccggtttgggtaccggtaccgttaggtactacgaacgaacgaaaaccggaaaacccggtaacgggaaccgtccccggttaggttacccgtagtacttaccgtaagtaacggacttacgtaacgttaagttaacgggtaacggttccgggtaaccttaaggttaacggtcgaggcggacgtagggtgacgtggacggtaactaggttacttacnctaccanacgtcgacgcgacgtaccgtgcgtacgtctagtacttagttacgttacgtaacttaacctttacgtaccgtacgtaacctaacgttaacgtacgtttacgttaccgtttaccgggttacgggttacccgggttacgggtaccggtttaacccgggaacccgggtaaaacgggtaaccggtaaaccgggtaaccggtaaaaccgttaaaccggttaaaacggtaccggttaagggtacccggtacgtacccggtaaacctaacccgtttaaccgttacccggtttaactaccccgttttacccgtaacccgttttaccccg

SEQ ID NO: 93135 - DNA, 549 bp, Homo sapiens
  misc_feature: GYAE6OF01DIA67.43.55.E11.1.454.CMB.1.raw
  modified_base (276)..(276): a, c, t, g, unknown or other
  misc_feature (276)..(276): n is a, c, g, or t
  modified_base (375)..(375): a, c, t, g, unknown or other
  misc_feature (375)..(375): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccaggtcagagtattagtagctggttgcctggtatcagcagaaaccagggaaancccctaggttcctgatctataaggcatctaatttagaaagtgggtaccagttaaggttcagcggcaggtggaatcgtaggggactaggtagttttaacncttcaccatcagcagcctgcagcctgtattgtattttgactaacgtttattacctgacctaaacaattatgtaatttcgttgggccgttggacgttcggaccaagggaccaaacggtgaaactacgaaacgtaactggtcggctgacacctatcttgttcttcgactttccccg

SEQ ID NO: 93136 - DNA, 594 bp, Homo sapiens
  misc_feature: GYAE6OF01B0XHP.43.55.E11.1.454.CMB.1.raw
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (335)..(335): a, c, t, g, unknown or other
  misc_feature (335)..(335): n is a, c, g, or t
tcagtgtgagtagtcacgaccggtgctcgatttagcactcgcacgttgggtttgggggggagtcagacccagtcaggacacagcatggacatgagggtccccgcgtcagctcctggggctcctgctgctctggctcccaggtgccaaatgtgacatccagatgacccagtctcccttccaccctgtctggatctgtaggagacagagtcaccatccacttgccgggccagtcagagttatagtagctggttggcctggtatcagcagaaccagggaagcccctaggttccngatctataggnatctaagttagaagtgggtaccctagttagtcngcggcagtgatgtgggactagtagttctctcactatcagcagcctgcgagcctagatgtatttcgacttaactttattactctaacaactaattatagtacgtttccgttgggtccgtagggtaccgttaccgggaccgaaacggggaaccgttaacggtagggtaaaacctaccgtaaaacggtacgtagggtacggtacgtcggtaacctaacccgtacgttccgttacggttcccttttacgcttttaccccccgg

SEQ ID NO: 93137 - DNA, 602 bp, Homo sapiens
  misc_feature: GYAE6OF01DAVDN.43.55.E11.1.454.CMB.1.raw
  modified_base (285)..(285): a, c, t, g, unknown or other
  misc_feature (285)..(285): n is a, c, g, or t
  modified_base (344)..(344): a, c, t, g, unknown or other
  misc_feature (344)..(344): n is a, c, g, or t
tcagtgtgagtagtcacgaccggtgctcgatttagcactcgcacgttgggtttgggggggagtcagacccagtcaggacacagcatggacatgagggtccccgctcagctcctggggctcctgctgctctggctcccaggtgccaaatgtgacatccagatgacccagtcctccttccaccctgtctggatctgtaggagacagagtcaccatcactgccggcagtcagagtatagtgctggtggctggtatcagacaagaaaccaggaacgcccctaggttccngatctataaggcaatacttaattagaaaggtcgggtaccctagttaacggtcagcgganagtggatcgtagggacaaggtatttactctacaccatcagcacgtcctgaccagtcctgtacttagtattttcgactaaactttacttactcgaacctaaataattgtcgtaacttttcgtacgggtaccggttacgtaccggttaccgggaacctaacggggaacctaaacgggtaggaaaacttcgaaaacgttaaccgtggtacggtctacggtaccaaccgttagttaccctgtttaccttcgtcgttaccccg

SEQ ID NO: 93138 - DNA, 1041 bp, Homo sapiens
  misc_feature: GYAE6OF01DUA8R.43.55.E11.1.454.CMB.1.raw
  modified_base (103)..(103): a, c, t, g, unknown or other
  misc_feature (103)..(103): n is a, c, g, or t
  modified_base (127)..(127): a, c, t, g, unknown or other
  misc_feature (127)..(127): n is a, c, g, or t
tcagtgtgagtagtcacgaccggtgctcgatttagcactcgcacgttgggtttggggggagtcagacccagtcaggacacagcatggacatgagggtccccgntcagctcgtgggctcctgctgctntggctcccaggtgaccaaagtgtagacatccagatcgaccctagtcctccttccacctgtctggattcgtaggtaggacgtacgagtacgtaccacctatccgtacgttcggcccggtccaggtacaggtaagttagttaggtacgtcgttgggttcggccgttaggtactcgagacgaaacgaaaccggaacgggtaaaccgtccccggttaggttcccgtagtacgttacgtaagtaacggtactacgttaacgttaaagttaacgggtaaacgggtttccgggttaacccttaaaggtttaacgggtacgacgggtaccggtacggtaaggtacggtaacggttaccgggtaacggggtaaccgttaacgggtttaaccgtttttaacccgtacccgttaaaccccgtaaaccccgttaacgttaaccccgggaacgtaacccggtaacccggttaccccggtaacgggtaacccccgtaaacccggggttccccggtttaaaggtttaaaccgttttaacgggttttaaaccgtttttttaccgggtaaaacccttttaaaacccgggttttttaaaccctttaaacccggttaacccggttaaaccctttaaaaccgtttaaacgtttaacgtttaaccggtttaccggtttttaacccggggttaccggggtttacccgggggtttaaccggggttaaccccgggtttaacccgggggaaaccccggttaaaccggggggtaaacccgttaaaccgggttaaaacgggttaaaaacccggttaaaccggtaaaaacccgggtttaccgggttacgggttacccgggttacccgtaacccgggtaaccccttacgttaaccggtttccgttaaccgtttacccggtttaccctacccggttttaccccg

SEQ ID NO: 93139 - DNA, 694 bp, Homo sapiens
  misc_feature: GYAE6OF01EUBDP.43.55.E11.1.454.CMB.1.raw
  modified_base (204)..(204): a, c, t, g, unknown or other
  misc_feature (204)..(204): n is a, c, g, or t
tcagtgtgagtagtcacgaccggtgctcgatttagcactcgcacgttgggtttggggggagtcagacccagtcaggacacagcatggacatgagggtccccgctcagctccgtggggcctcctgctgctctggctcccaggtgccaaatgtgacatccagatcgacccagtcctcccttccaccctgtctggatcgtgtagganacagatccacctatccacgttcggccggccagtcagtagtattagtagcgttggttcggcgtggtatcgagacgaagaaaccgagggaaccgtcccgttaggttcctagtactacgtaagtacggactaatacttaagtttaaggtaaaggtcgggttacctaaggttaacggttcgaggacggtacgtaggtggtagtcggtagggaactaggttaacgtttacctactaccgtaacctagtacgacgacgtacgcctgaccgacgtcctaggtattaggttatttcgaaccgtttaactttacgttaccgtacgtaacctaattaacttatacgttacgtttaccgtcgggtcggttacgggtaccggtttaccggaaccgtaaccgggaactaacgggtaacgtaaacgtaaccgtaaacggtacgttaggtacggtcgtaccgaccgtacctacttcgttaccgtttccttacgtcccgttacccg

SEQ ID NO: 93140 - DNA, 686 bp, Homo sapiens
  misc_feature: GYAE6OF01D36HE.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctgggctcctgctgctctggctcccaggtgccaaatgtgacatccagatgacccagtctccttccaccctgtctggatctgtaggagacagagtcaccatcacttgccggccagtcagagtatagtagcttggtggcctggtatcagcaagaaaccgaagggaaacgtccccgtaggttcctgtatactagtaagctatacttaattaaggtaaacggttcgggtaccctaagttaacggttcgacggcggtacgtaggtaggagtcggtaggggtaactaggtaacgtttacctctacctacctagtaccaagtcacgtccgtcgaccacgtcctgtatacggttaattttcggaaccttaaacgtttactaacgtacgtaaccctaaactactaatacgttacgtttccggttcgggtaccccggttaggggttacccggtttacccgggaaccgtaaacggggaaccgttaaacggtaaggtaaaaccgtaacgtaaaacggtaccgttaggtaggtccctaaggccccttaaacgtcgtttcctacgttacctttcccacgtttaccccccg

SEQ ID NO: 93141 - DNA, 807 bp, Homo sapiens
  misc_feature: GYAE6OF01CJ5A0.43.55.E11.1.454.CMB.1.raw
  modified_base (104)..(104): a, c, t, g, unknown or other
  misc_feature (104)..(104): n is a, c, g, or t
tcagtgtgagtagtcacgaccggtgctcgatttagcactcgcacgttgggtttgggggggagtcagacccagtcaggacacagcatggacatgagggtccccgntcagctcctgggctcctgctgctctggctcccaggtgccaaatgtgacatccagatgaccagtctccttccaccctgtctggatcgtgagagacagagtcaccatccacttcggccggcagtcagtagtattgagcgtggttcggctggtatcagacaagtaaaccgagggtaaaccgtccccgtaggttccctaggtaacgttacgtaacgtaaggactaattaaccgtttaaaagtttaaggtaaaacgggttccgggggttaaccccttaaggtttaaacggggtttaccaagggttaccggacggtaagggtcggtaacgttacggtacgggtaactacggttacgttttaccgtacctacccgtaacctactacgtaacgccgtaacgtccgtcgtacgtacggtaacccgttgtaaacgtttcgtttaaacgttttcgaacccgttaaagttttaccgtaaccgtaccgaaccttaaaggaactttaagtgttaaccgtttacggttacccggggtacgggttacggttacccggggtttaaacccggacccgggtaacgggtaaaacccgtagggttaaaccggtaaacgtaaacccggaaaaccgttaaccgggtacggtacggcccggtttaccgtaacccgaaactttcccgtttacggtacccgtttaacttaccctaccggtttaaccccc

SEQ ID NO: 93142 - DNA, 642 bp, Homo sapiens
  misc_feature: GYAE6OF01DB1MR.43.55.E11.1.454.CMB.1.raw
  modified_base (105)..(105): a, c, t, g, unknown or other
  misc_feature (105)..(105): n is a, c, g, or t
  modified_base (142)..(142): a, c, t, g, unknown or other
  misc_feature (142)..(142): n is a, c, g, or t
  modified_base (186)..(186): a, c, t, g, unknown or other
  misc_feature (186)..(186): n is a, c, g, or t
  modified_base (193)..(193): a, c, t, g, unknown or other
  misc_feature (193)..(193): n is a, c, g, or t
  modified_base (277)..(277): a, c, t, g, unknown or other
  misc_feature (277)..(277): n is a, c, g, or t
  modified_base (291)..(291): a, c, t, g, unknown or other
  misc_feature (291)..(291): n is a, c, g, or t
  modified_base (515)..(515): a, c, t, g, unknown or other
  misc_feature (515)..(515): n is a, c, g, or t
tcagtgtgagtagtcacgaccggtgctcgatttagcactcgcacggttggggtttggggggagtcagacccagtcaggacacagcatggacatgagggtccccgntcagctctggggctcctgctgctctggctcccaggtnccaaatgtgacatccagatgacccagtctcctccacctgtctgntctgagngacagagtcaccatcacgttgccgggtcaggtcagtagtattagtagcgtggttgctggtatcagacagaaaccgagggaaacncccgtaaggttccngtactctaataaggctatactaaattaagaaacgtgggtaccctaagtaaggtctagacggacgtaagtgggtaatccgttaggggaaactacggtaacgttttactaccgtacgaaacctacttacaacgggtacaacgttccgtacaccggtaacgtacccgtagtaagttacgtaagtttttcaacctaagtttaactacgttacgaacaaactaattagntaacgtttcgttacggaccgttagtacggtttcggaaccaacggggtacaaacgttaggaaacgttacgaaaacgacgttaggtacgcgttacggacaactattacgtattacctcgtaaccgttcc

SEQ ID NO: 93143 - DNA, 620 bp, Homo sapiens
  misc_feature: GYAE6OF01EU1NC.43.55.E11.1.454.CMB.1.raw
  modified_base (421)..(421): a, c, t, g, unknown or other
  misc_feature (421)..(421): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttggccggccagtcagagtattagagcgtggttggcctggtactcagacaagaaaccaagggaacgccccgtaggttcctgatctaagtaggctaatacttaagtttaagaaaggttcggggtaccctaagtttaacggttcgaggcggactaggtggatcgtagggaataacgtagttactctacacctatacagcagtcctgacncgcctgattgtatttacgactaactttacttactcgaaccctaaataacttattagtactttcgtacgggtccggttacgggtaccggttacggaccgaaacgggtacctaaacggtaaggaaacgtaccgaaaacggtacgtgggttcgacgttacgaccgtaacctacgttactacgtttccttatccgtttacccg

SEQ ID NO: 93144 - DNA, 634 bp, Homo sapiens
  misc_feature: GYAE6OF01DGS9C.43.55.E11.1.454.CMB.1.raw
  modified_base (199)..(199): a, c, t, g, unknown or other
  misc_feature (199)..(199): n is a, c, g, or t
  modified_base (369)..(369): a, c, t, g, unknown or other
  misc_feature (369)..(369): n is a, c, g, or t
tcagtgtgagtagtcacgaccggtgctcgatttagcactcgcacgttgggtttgggggggagtcagacccagtcaggacacagcatggacatgagggtccccgctcagctcctggggctcctgctgctctggctcccaggtgccaaatgtgacatccagatgacccagtctccttccaccctgtctggatctgtagganacagagtcaccatcacttgccgggccagtcagagtattagtagcgtggttggcctggtatcagcaagaaaccagggaaacgcccctaggttcctagatctataaggcatctaattagaaagtgggtaccattaaggtcagcggcagtggatcgtgggacagtagtttacnctcacatcagtcagtcctgctacgccttgacttgtattttcgacttaaactttattacctacgtaacctaaactaattacttaggtaacttttccggttacgggttcccggttaggggtaacccggtttacccgggaacccggtaaacggggaacccgtaaacggttacgggaaaaccttacggaaaaaccggtaacgttaggtacgggtcctacggaccctaacccgtattacccggttcgtttacccttctacgtttaccccc

SEQ ID NO: 93145 - DNA, 762 bp, Homo sapiens
  misc_feature: GYAE6OF01BMNDY.43.55.E11.1.454.CMB.1.raw
  modified_base (101)..(101): a, c, t, g, unknown or other
  misc_feature (101)..(101): n is a, c, g, or t
  modified_base (182)..(182): a, c, t, g, unknown or other
  misc_feature (182)..(182): n is a, c, g, or t
tcagtgtgagtagtcacgaccggtgctcgatttagcactcgcacgttgggtttgggggagtcagacccagtcaggacacagcatggacatgaggtccccgntcagctcctgggctcctgctgctctggctcccaggtcgccaaatgtgacatccagatgacccagtctccttccacctgtcnggatcgtagtaggagacagagtccaccgatcacgttcgcccgggccagtcaggtagttattagtagcgttggttacgccttaggtactcgagtcaagaaaccgagggaaaccgccccttaggttcctagtactacgtagtaacggactaattacttaaagtttaacggaaacggtttcggggttaaccctaagttttaaacggttcgacggttccggtactaacggttaggaacgttcggtacggggacttaaacggtacgtttttaacctacgtacccgtaacgacgttacgacgaccgtacgtacccgtagaccgtacgtcccgtaggtaccttaggtttacgtttaccgaaccgtttaactttaaccttacgtaccgtaacctaaaccgttattaacgttaacgttacccgtttacggtttacgggacccggttacgggtaacccggtttaccgggaaccgtaaaccggggaacctaaacgggttaaacgtaaactaacccggtaaacgttacgttacggtacgggcctacggaccgtaaccttcgtactttaggacctttaccgtccgttaccccg

SEQ ID NO: 93146 - DNA, 827 bp, Homo sapiens
  misc_feature: GYAE6OF01COL1U.43.55.E11.1.454.CMB.1.raw
  modified_base (102)..(102): a, c, t, g, unknown or other
  misc_feature (102)..(102): n is a, c, g, or t
tcagtgtgagtagtcacgaccggtgctcgatttagcactcgcacgttgggtttgggggagtcagacccagtcaggacacagcatggacatgagggtccccgntcagctccgtggggctcctgctgctctggctcccaggtgccaaatgtgacatccagatgacccagtcctcccttccaccctgtctggatctgtaggagacagatcacatcacttcggccggcagtcagagtattagagcgttggttcggcctggtatcagacaagaaacgacggaacgccccgtaggttcccagtactactagtaacggtcaatttacgttaaagtttaacggtaaaacgggttccggggttaaccctaaagttttaacgggtttaccgaaggtccgggtacggtaaggttacgggtaagttaccggttaacgggggtaaccgttaacgggtttaaaccgtttttacccgttacccttaacccgaaaccctaacgttaccgaacggtacccgtaacggtcccgttacggaccccgtaacgggttcccgttagggttaaacgtttacggtttaaacgtttttccggaaaccctttaaaacccgttttaacgtttaacccgtaaccggttaaacccctaaacgtttaaacgttaagtttacgtttaacgtttccggtttaccgggtcccggttagggtaacccggtttacgggaacccggtaagggtaaccccgtaaaggttaacggaaaaccgttaaccgaaaccggtaacgtggttaccggactccgaccgtaacccttagttcccttacggttccttaccgtacctttaccccg

SEQ ID NO: 93147 - DNA, 611 bp, Homo sapiens
  misc_feature: GYAE6OF01AHPEB.43.55.E11.1.454.CMB.1.raw
  modified_base (346)..(346): a, c, t, g, unknown or other
  misc_feature (346)..(346): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (443)..(443): a, c, t, g, unknown or other
  misc_feature (443)..(443): n is a, c, g, or t
  modified_base (462)..(462): a, c, t, g, unknown or other
  misc_feature (462)..(462): n is a, c, g, or t
tcagtgtgagtagtcacgaccggtgctcgatttagcactcgcacgttgggtttggggggagtcagacccagtcaggacacagcatggacatgagggtccccgctcagctccgtggggctcctgctgctctggctcccaggtgccaaatgtgacatccagatcgacccagtcctcccttccaccctgtctggatcgtgaggagacagacgtcaccatctacgttcggcccgggccagtcaaggtagttagttaggtacgtcggttgggttcggccgttagggtactacgagaccgaacgaaaacccggagggaaacccgtccccgttaggttcctagtactcgtaanaacggctattactaagtttaaggaaggttcggtacctagttagtcagcggactagtggatcggaggactaggtacttactcncactncgagcacgcngcacgtctagtatacgttntttagaccttattagtccacgactaactaatcgtacgttagttccggtcggtacgtccggtacggtccgaacgaacggacgtaagtagaaactacgtaaacggtctaggcgtactgtacccactcgttcttacctcttcctcgttcccc

SEQ ID NO: 93148 - DNA, 569 bp, Homo sapiens
  misc_feature: GYAE6OF01B423F.43.55.E11.1.454.CMB.1.raw
  modified_base (415)..(415): a, c, t, g, unknown or other
  misc_feature (415)..(415): n is a, c, g, or t
tcagtgtgagtagtcacgaccggtgctcgatttagcactcgcacgttgggtttgggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggcagtcagagtattagtagctggttggcctggtatcagcaagaaaccgagggaaacgcccctaaggttcctgactcgtataaggcattactaatttaggaaagtggggtaccctagttaaggttcaggcggcagtggatcgtgggacagtagtttactctacacatcagcacgcctgcagcctgatgtatttnacttaacttatactcgaccaaataatattagatttcgtacgggtccgttggtaccgttcggaccgaacgggtacccaacgggtagaaactaccgaaacggtacgttaggtcgtacgtcgacctaacctgttacctagttccttctcgttccccg

SEQ ID NO: 93149 - DNA, 873 bp, Homo sapiens
  misc_feature: GYAE6OF01B8J76.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctgggctcctgctgctctggctcccaggtgaccaaatgtgacatccagatcgacccagtcctccttccaccctgtctggatcgtaggtaggacacagacgtccacatccacgttcggccgggcagtcaggtagttaatagtagtcgttggttcggccgttggtactcgaagtacgaaacgaaaaccggagggaaaccgtccccgtaggttccctagtattaccgtaagtaaggactaagttacttaaagttaggaaacggttcggggtaaccctaagttaacggttcgacggtaccgggacgtaaggtacggtacgtcggtaagggtaccgtaaagtttacgtttacctaccgtaaccaaccgtagtacgaacggtacgacggtccctagaccgtaaccgtcgttagtaacgtttagttacttttacggaaccttaacgttttaacgtaaccgtacgtaaacccttaaacgttaaacgtttacgttacgtttaccgtttacgggttacccgggttaccgggttaaccgggtttaacccgggttacccggtaaaccccggggttaaacgggaaaaccccggttaaaacggggttaaacggtaaaaacccgttaaaccgggtaaaaaccgggttaaccgggttaacgggtttaccgggaaacccggtttcccggtaaaaacccggttaccccgttaaccggtttacccggtttaacccttttaccccgtttaaacccggttaccccgtttttaaacccccccggg

SEQ ID NO: 93150 - DNA, 644 bp, Homo sapiens
  misc_feature: GYAE6OF01CZ6SW.43.55.E11.1.454.CMB.1.raw
  modified_base (382)..(382): a, c, t, g, unknown or other
  misc_feature (382)..(382): n is a, c, g, or t
  modified_base (420)..(420): a, c, t, g, unknown or other
  misc_feature (420)..(420): n is a, c, g, or t
  modified_base (436)..(436): a, c, t, g, unknown or other
  misc_feature (436)..(436): n is a, c, g, or t
tcagtgtgagtagtcacgaccggtgctcgatttagcactcgcacgttgggtttggggggagtcagacccagtcaggacacagcatggacatggagggtccccgctcagctccgtggggctcctgctgctcgtggctcccaggtgccaaatggtacacatccagatcgaccctagtcctccttccaccctgtctggatcgtgtaggagacagactcaccattccacgttcggccggcctaggtcaaggtattattaaggtgcctgggttacgcgtggtactcgagacaagaaccggtaaggaaaccgtccccgtaggttccaggtactacgtagaacgctaattactaaagttaacggaagtcgggtaccaagtttacggacnggacggctagtggactcgtagggaatagtacgttctanacccgaacgctacganccgtacgacctgacacgtctaggtactagttagttacacgtttaacttatacgtactaactaacttaatcttagtcttcgtcggtaccgtggtaccgttacggaaccgacgggtaacctaaggttaacgaaacgttaacgaaaccggtacgttaggacggttacacggtcctaaccggtcttacgtatttaccctgtaccctttcccg

SEQ ID NO: 93151 - DNA, 789 bp, Homo sapiens
  misc_feature: GYAE6OF01EY211.43.55.E11.1.454.CMB.1.raw
  modified_base (200)..(200): a, c, t, g, unknown or other
  misc_feature (200)..(200): n is a, c, g, or t
tcagtgtgagtagtcacgaccggtgctcgatttagcactcgcacgttgggtttggggggagtcagacccagtcaggacacagcatggacatgagggtccccgctcagctcctgggcctcctgctgctctggctcccaggtgccaaatgtgacatccagatcgacccagtcctcccttccaccctgtctgatctgtagganacagatcaccatcacgttcgccggcagtcagtagttattagtagtcgtggttcggcctggtactacgagacaaacgaaaccgaacgggaaccgtccccgttaaggttcccgtagtacttacgttaacgtaacggactaagttaacgtttaaaagttttaaggtaaacggttaccgggggtttaaccccttaaaggttttaaaccggttacggtaacggtcggtaccgtaggttacggtacgttacggtaggggaacgttaggttaacgtttaccgtacctaccgtaacctagtacgacgtaccaacgtccgtacgtacgacgtccgtagtaacgttagttacgtttacgtaactttaaactttacttaaccgtacgtaaacccaaattaatttacgtaacgttcgtttaccggtccgggttaccgggttacggttaacccggttacccgggtaacccggtaaacgggtaacccgtaaacgggtaaccgtaaaaccgtaaaccggtaaaaccgtacggttaggtacggtacctaaccggacctaaaccgttcgttacgttaccgtttccttacccgtaccgtttaccccg

SEQ ID NO: 93152 - DNA, 718 bp, Homo sapiens
  misc_feature: GYAE6OF01C8X2J.43.55.E11.1.454.CMB.1.raw
  modified_base (163)..(163): a, c, t, g, unknown or other
  misc_feature (163)..(163): n is a, c, g, or t
  modified_base (481)..(481): a, c, t, g, unknown or other
  misc_feature (481)..(481): n is a, c, g, or t
  modified_base (657)..(657): a, c, t, g, unknown or other
  misc_feature (657)..(657): n is a, c, g, or t
  modified_base (702)..(702): a, c, t, g, unknown or other
  misc_feature (702)..(702): n is a, c, g, or t
tcagtgtgagtagtcacgaccggtgctcgatttagcactcgcacgttggggtttgggggggagtcagacccagtcaggacacagcatggacatggacgggtccccgctcagctccgtggggcctcctgctgctctggctcccgaggtcgaccaaatggtgacnctcgagatcgaccctgttcctccttccaccttgtctggatcgtggtacggagacgagtacgtccacctatccgtacgttcgggcccggctaggtcgaaggtagttaagtttaggtacgtcggttcgggttcggtaccgttaggtatccgaacggacaaaccggaaaccggtaacgggaaccgtccccgttacggttccgtagtactacgttaagaagtctaagttacttaagttaacgaacgggttccgggtaacctagtttaacggcgacggcgagtggtacggtactggtacggaactaacggttacgttttaccncgtacctacgtactcgaacgtcgaccgtcgaccgtcgacgtcgttaagtctaagtttcgtttcgaaccctttaatttaccctacaattaacccgtaaatacgtttcgttacgtcgttcggtaccgggttcgtaccgggtccgttaacgggacccggtaacgaacgtaaccggtaanaaacccgtggaaacgtgtagtcgacgtcaccgttactcgttactnttacctgtccttcccg

SEQ ID NO: 93153 - DNA, 678 bp, Homo sapiens
  misc_feature: GYAE6OF01EAOY9.43.55.E11.1.454.CMB.1.raw
  modified_base (201)..(201): a, c, t, g, unknown or other
  misc_feature (201)..(201): n is a, c, g, or t
  modified_base (473)..(473): a, c, t, g, unknown or other
  misc_feature (473)..(473): n is a, c, g, or t
  modified_base (530)..(530): a, c, t, g, unknown or other
  misc_feature (530)..(530): n is a, c, g, or t
  modified_base (655)..(655): a, c, t, g, unknown or other
  misc_feature (655)..(655): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatcgacccagtcctccttccaccctgtctggatcgtgtagganacgagacgtcaaccatccgacgttcggcccgggacctagtcaagtagttaattagtagtcgttgggttacgccgttggtatcagactaaacgaacgaacgggaaaccgtccccgtaaggtttccctaggtactacgtaagtaacgactattaccgttaaagttacggaaggttcggtaacctaagttacggtcaggcgacgtagtggtactggtacgactaggtcttaactccgtacacctatacgacgtcacgaccgtgaccgacgtcgtnttagtacgttactttcaaccgttaatttacctacacgtaacccaagtattaaccgtnttacgttcggttacggaccggttacggtacccggtaacggtacccgaaacgggtaaccgtacgtaaaggtaaaccctaacgtaaaccggtgtagggactccgtacaccgttacctattacccggntttaccccgtatcccgttacccg

SEQ ID NO: 93154 - DNA, 690 bp, Homo sapiens
  misc_feature: GYAE6OF01EM2MF.43.55.E11.1.454.CMB.1.raw
tcagtgtgagtagtcacgaccggtgctcgatttagcactcgcacgttgggtttgggggggagtcagacccagtcaggacacagcatggacatgagggtccccgctcagctcctggggctcctgctgatctggctcccaggtcgccaaatgtgacactccagatcgacccagtcctcccttccaccctgtctggatcgtgtaggagacagacgtcaccatcactcgccggcagtcagagtagttagtacgtcgtggtcggcctggtatcagcaacgaaacgaaggaacgccccgtagtacctgatacgtagagactatacttaagttaaggtaaggtcggggttaccttaagaacggttacgacggcggacgtagtaggtacgtcgtagggacgtagtacgtttactcctacaccgactacgacgcctacgcccgtagtacgacggtccgtagtacttacggttactttaccgtaactttaacctttacgttaaccctcgtaaaccaacttaatacttacgttacgttcggttaccggtccgggttacggtaccgggttaccggaaccggtaacgggaaccgtaacggtaacgttaaaccgtaacgaaaaccggtcgtaacgggttacggccgtacggtacctaccgtacgttacccttacgttaacccttcgttaaccctttcccccggg

SEQ ID NO: 93155 - DNA, 911 bp, Homo sapiens
  misc_feature: GYAE6OF01DJWZB.43.55.E11.1.454.CMB.1.raw
  modified_base (106)..(106): a, c, t, g, unknown or other
  misc_feature (106)..(106): n is a, c, g, or t
  modified_base (142)..(142): a, c, t, g, unknown or other
  misc_feature (142)..(142): n is a, c, g, or t
  modified_base (656)..(656): a, c, t, g, unknown or other
  misc_feature (656)..(656): n is a, c, g, or t
  modified_base (773)..(773): a, c, t, g, unknown or other
  misc_feature (773)..(773): n is a, c, g, or t
  modified_base (900)..(900): a, c, t, g, unknown or other
  misc_feature (900)..(900): n is a, c, g, or t
tcagtgtgagtagtcacgaccggtgctcgatttagcactcgcacggtttgggtttggggggagtcagacccagtcaggacacagcatggacatgacgggtccccgntcagctccgtgggctcctgctgctcgtcggctcccnggtgaccaaagtgtgacaactccgagactcgaccctagtccctcccttcccacccgttggtccgtaggtactcgttaggtaagggaacgaaccgaggacgttaccaaccctacgttcccgtaaccggttccggccccggggtcctaaacggttccgtaaaggtaaaggtttaaacgtttaaggggtacggtccggttttggggttccggtacccgttacggttaactaccgaaacggaaccgtaaaaacggtaaaacccgggaaacggggtaaaaccccgttcccccggtttacgggtttccctaaggttaaccgttaacgttaaacggtaacggtaccgtaaacgttttaaccgtttaaaaagggtttaaacgggttaaaaccggggtttccggggttaaaacccccgtttaagggttttaaaccgggttaccggacgggtaacccggtacggtttaaggggtaccggtacgttccgggtaacgggtaacgttaagtttaaccggtttacccnccgtaacccgtaccgtacgtcgaacgtccgaagtccgttcggaagttaccgtcgtaagttgtaacgtttactttacggaacctttaagttccgttacaaccgtacctaaattacgtnttcggtcctttagggtccggtacggttcggtccgggtaacgaacgaacgggtaacttaacgggactaaacctacggtaaactggttggaggttccacccttgaaccttagttccgttatacccgttntacccgtaccc

SEQ ID NO: 93156 - DNA, 960 bp, Homo sapiens
  misc_feature: GYAE6OF01D4YMC.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctccgtggggcctcctgctgctctggctcccgaggtgaccaaatgtgacatccagatcgacccagtcctccttccacccttgtctggatcgtaggtaggagacagacgtaccaccatctacgttcggcccgggaccagtcgagtagttattaggtacgcgttggttcggccgttggtactcgaaggacaaacggaaaaccgaagggaaaccgtcccccgttagggtttacctaggtactacgttaagtaacggctaagttacttaaaggtttaaggtaaacggttccggggtacctaaaggttttaacgggtacgacggtccgggtacgtagggttacgggtaacgttcggtaggggtaaacctacgggtttaaaccgttttaaccccaccccgtaacctaacgtaccgacggtacccgtaacgggtccccttaggacccgtaacggtacccgttaggttactttacggtttaacgtttttaccggtaaacccttttaaaccgttttaaaccgttttaaccgtaacccggtaaaacccctttaaaacgttaaacgttttaacgttaaacgggttttaaccggtttttaccgggttacccgggggttacccggtttaaccgggggttaaccccggtttaacccgggggaaaccccgggttaaaaccggggtaaccccggttaaaacggggttaaacgggttaaaaacccgttaaacccggtaaaaaccgggttaaccggttacggggttacggggaaccctcccgggttaaaccctaccccggttaaacgttttccccgttaccgggtttacccctttaccccggttaacccgtttccccccggttaacccccg

SEQ ID NO: 93157 - DNA, 815 bp, Homo sapiens
  misc_feature: GYAE6OF01A4EPX.43.55.E11.1.454.CMB.1.raw
  modified_base (240)..(240): a, c, t, g, unknown or other
  misc_feature (240)..(240): n is a, c, g, or t
  modified_base (465)..(465): a, c, t, g, unknown or other
  misc_feature (465)..(465): n is a, c, g, or t
  modified_base (496)..(496): a, c, t, g, unknown or other
  misc_feature (496)..(496): n is a, c, g, or t
  modified_base (527)..(527): a, c, t, g, unknown or other
  misc_feature (527)..(527): n is a, c, g, or t
  modified_base (533)..(533): a, c, t, g, unknown or other
  misc_feature (533)..(533): n is a, c, g, or t
tcagtgtgagtagtcacgaccggtgctcgatttagcactcgcacgttgggtttggggggagtcagacccagtcaggacacagcatggacatgagggtccccgctcagctccgtggggctcctgcctgcctcgtcggcctaccccgaggttcgaccaaaagttggtacgaactactccaggatcgaaccctacgttcctccccttacccacccgttgtccttagtatccgtaggtaggaanaccaagtcgtaccaactagtcctacgttcggcccggctaggctagaacgttataggagtcgttggtcgccgtagtactacgagacaaacggaaccgaaggtaaccggacccttcggtacctagtacttacgtagtaacgtaactacttaacgttaaagttaacggtaacggttcgggtaaccttaagtaaacgggtttcaacggtcggtaacggaggttaacggngttacggacgaagtacgtttaactttaaccnccgtactaacgacgttacgaccgtagtaccnccgtanaaccgacggtacttagggctttaacggttctttaggaacctttaagtttaccctaaacgtcaaacccttaaataagttaccgttaggttaaccgtttcggttaccccgggaggttttacccgggaacgggtttacccctaaacccggggaaagggtcccgtaaacgggtaaaccgttaaaaggtacccccgtaaaaggttcccggggtagtttacggaccgtttaccgaaacctaccccgttagtcccgttttaaagtcccttaaccgtcctttaacccccg

SEQ ID NO: 93158 - DNA, 698 bp, Homo sapiens
  misc_feature: GYAE6OF01A9YJY.43.55.E11.1.454.CMB.1.raw
  modified_base (106)..(106): a, c, t, g, unknown or other
  misc_feature (106)..(106): n is a, c, g, or t
  modified_base (145)..(145): a, c, t, g, unknown or other
  misc_feature (145)..(145): n is a, c, g, or t
  modified_base (336)..(336): a, c, t, g, unknown or other
  misc_feature (336)..(336): n is a, c, g, or t
tcagtgtgagtagtcacgaccggtgctcgatttagcactcgcacggttggggtttggggggagtcagacccagtcaggacacagcatggacatgacgggtccccgntcagctccgtgggcctctgctgctgtggctcccgaggtncaaagtgtgacatccagtagtcgaccctagtcctccgttcccaccctgtctggtatcgtagtaggagacagacgtccactatccgtacgttcggaccggcaggtacagttagttacttagtaggtcttggggtcgccgttaggtactcgagacaacgaacgagggaacctcccgtagttcagtactcgtanacgctaagttactagttaacggacggtcggtcctaggttaacgtcgaggccgagtacgtaggcttacggagataacggttcttaccgactactaaccgtagtcgagtcctacgccgtagccgtacgtcgtacgtatttacggttactttacgacctttaaatcgttacacgtaactaactagtacgtagtcgtttaccggtaccggtacggtagggttaccggtaccggtaacgggaacccggttaaacgaacggttaaaccggtaaacgtaaaccgttaaaccggtaccggttaggtacccggacggttacccaacgttacgtacgtttaccttggttacccttttcccgacgttcccccg

SEQ ID NO: 93159 - DNA, 728 bp, Homo sapiens
  misc_feature: GYAE6OF01BBHW0.43.55.E11.1.454.CMB.1.raw
  modified_base (204)..(204): a, c, t, g, unknown or other
  misc_feature (204)..(204): n is a, c, g, or t
tcagtgtgagtagtcacgaccggtgctcgatttagcactcgcacgttgggtttggggggagtcagacccagtcaggacacagcatggacatgagggtcccccgctcagctcctggggcctcctgctgctctggctcccaggtgccaaatgtgacatccagatcgaccctagtcctcccttccaccctgtctgatctggtagganacagacgtcaccatcacgttcggccggcagtcagtagtattagtagcgtggttcgccgtaggtatcagacaacgaaaccgagggaaccgtccccgtaggttacctagtactataacgtaaggctagtacttaagtttaaggaacggttcgggtaccctaagttaacggtcgacggtcggtacgtaggtacgtacgtcggtagggtaaccgtaaggttacgtttaaccctccgtaccgaacctagtacgacgccgaccgtcccgtacgacgtcgtacccgtagtacgttgttaactttacgaactttaactttaactaccgtacgtaacctaaacgtacttaagttacgttactttaccggtccggtaccgggttaccgggttaccgggttaccccgggaaacggtaaccgggtaaccgtaaacgggtaaccgtaaaactaacggtaaaaccggtacgttcggtaccggtcctacggtaccaacccgtacgttccgttagttccctttcgtaacccgtttccccg

SEQ ID NO: 93160 - DNA, 719 bp, Homo sapiens
  misc_feature: GYAE6OF01A4GLA.43.55.E11.1.454.CMB.1.raw
  modified_base (105)..(105): a, c, t, g, unknown or other
  misc_feature (105)..(105): n is a, c, g, or t
  modified_base (695)..(695): a, c, t, g, unknown or other
  misc_feature (695)..(695): n is a, c, g, or t
tcagtgtgagtagtcacgaccggtgctcgatttagcactcgcacggttggggtttggggggagtcagacccagtcaggacacagcatggacatgagggtccccgntcagctcctggggctcctgctgctctggctcccaggtgccaaatgtgacatccagatcgacccagtctccttccacctgtctggatctgtaggagacagactcacctatcacgttcgccggccagtacagtagttattagagcgttggttggccttggtatcgtaagacaacggaaaaccgagggaaaccgccccgtaggttccctaggtacttctaagtaacggctaattacttaaagttttaaggaaacggttcggggttaccctaagttttaaacgggtccgaaggccggtacgtaggtaggagttacggtagggaacctaaggttaacgtttaacctcgttaaccgaaccgtagtaccaacggtacgtaaccggtccttacggaccgtacgtaccgttaggtaagtttaggtaaacttttacgaacctttaaaccttttagtaccttaccggaactaaacttaattacgttagtaccttttacggtccgggtaccgttagggtaacccgttccggaaccggtaacgggaaccctaaggtaccgaaaataccggaaaacgtcgtaggtacggctaccggaacacgtnttccgtattctcgtcgttaccccg

SEQ ID NO: 93161 - DNA, 671 bp, Homo sapiens
  misc_feature: GYAE6OF01EEPQG.43.55.E11.1.454.CMB.1.raw
  modified_base (103)..(103): a, c, t, g, unknown or other
  misc_feature (103)..(103): n is a, c, g, or t
  modified_base (204)..(204): a, c, t, g, unknown or other
  misc_feature (204)..(204): n is a, c, g, or t
  modified_base (338)..(338): a, c, t, g, unknown or other
  misc_feature (338)..(338): n is a, c, g, or t
  modified_base (655)..(664): a, c, t, g, unknown or other
  misc_feature (655)..(664): n is a, c, g, or t
  modified_base (666)..(666): a, c, t, g, unknown or other
  misc_feature (666)..(666): n is a, c, g, or t
  modified_base (668)..(671): a, c, t, g, unknown or other
  misc_feature (668)..(671): n is a, c, g, or t
tcagtgtgagtagtcacgaccggtgctcgatttagcactcgcacgttgggtttggggggagtcagacccagtcaggacacagcatggacatgagggtccccgntcagctcctggggctcctgctgctctggcctcccaggtgccaaatgtgacatccagatcgaccctagtcctccttccaccgtgtctggatcgtagtagganacgagacgtaccacctatccgtacgttcggccggaccagttcagtagttagtagtacgcgttggtcgactgtacacgaagacaaggaaaccgaggaaccgtacccgttagttccagtacttacgtaaagtacgntaacttacgttaaagttaggaggttcgggtacctaaggtttacgtcaggtcgaactggtacgactacggaggtaactacgttacgttctaccgactaccggtactacgtacgaccgacgtaccgtacgtacgtacgtacgttaacgtacgttaacgttacgttaccgttaacttaacctttaacgttaccgtaaccgtaacctaaacgttaacgtttaacgttacgttacgtttacggttaccggttacgggttacggttaccggtaccgggtaaccggtaaccgggtaaccgtaacggtaaacgtaaaaccggttnnnnnnnnnnanannnn

SEQ ID NO: 93162 - DNA, 768 bp, Homo sapiens
  misc_feature: GYAE6OF01CCJ46.43.55.E11.1.454.CMB.1.raw
  modified_base (199)..(199): a, c, t, g, unknown or other
  misc_feature (199)..(199): n is a, c, g, or t
tcagtgtgagtagtcacgaccggtgctcgatttagcactcgcacgttgggtttgggggagtcagacccagtcaggacacagcatggacatgagggtcccccgctcagctcctggggctcctgctgctctggctcccaggtgccaaatgtgacatccagatcgacccagtcctccttccacctgtctggatcgtgagganacgagacgtcaccagtcacgttcgccggcagtcgagtagtatagtagcgttggtgcctggtatcgagcgaacgaaaccgagggaaaccgtccccgtaaggtttccctaggtactactaagtaacggtacctacttaacgttaaagttttaaggaaacgggttcggggttaacccctaagtttaaacgggttcaacgggcggtacgaaggttcgggtaacttcgggtacgggtaagtaacgttaagtttttaacctacccggtttaccaaaccctaacgttaccgaacggttccgaaccggcccgtttaggacctaaccggtacccgtagtaacgtttggttaactttttacggaaccctttaaactttaacgtttaacccggtactaacccaaaatttaattaacgttcgtttaagtttcccggttacggtacccgggttacgggtaccggttaacccggaccggaaacggtaaccgtaaacggttacggtaaaacgtaaccgaaaccgtacgttaggtcggtacacgtccaacccgttattacttacgttcctccgttacgttccccc

SEQ ID NO: 93163 - DNA, 838 bp, Homo sapiens
  misc_feature: GYAE6OF01AE8J3.43.55.E11.1.454.CMB.1.raw
  modified_base (105)..(105): a, c, t, g, unknown or other
  misc_feature (105)..(105): n is a, c, g, or t
  modified_base (129)..(129): a, c, t, g, unknown or other
  misc_feature (129)..(129): n is a, c, g, or t
  modified_base (216)..(216): a, c, t, g, unknown or other
  misc_feature (216)..(216): n is a, c, g, or t
tcagtgtgagtagtcacgaccggtgctcgatttagcactcgcacggttggggtttggggggagtcagacccagtcaggacacagcatggacatgagggtccccgntcagctcgtgggctcctgctgctntcggctcccgaggtgaccaaatgtcgacactccgaagatcgaccctagtccttccttcccaccgttgtcgtggatcgtaggtagganacgagtacgtccaactacgtctacgttcggcccgggactaggtctaaggtacgtttaagttagtacggtccggttaggttcggtccgtaggttacaccggtaagacgaaaccgtaaaaccggaacgggtaaccgttcccccggttaagtttaccgtagtaacttaacgttaacggtaacggtacttaactttaacgtttaaaggtttaacggtaacgggttcggttaaacccgtaagtttacggttacgacggtacggacgtaggttacggtacgttacggaacgggtacgtaacgtttaacgtttccgtaccgtaacctaacgtactaccgacggtactacgacgtacgtacacggttactaggttacttagttacgttttacgaactttaacttacgtaaacgtacgtaaccgtaaattgttaattacggtttacttcccggttacggggaccgtttaaccggggttacgtaacccggggaaaccgtaacgggttaaccaaaaccgggttagtaaaaaccttaccgggaaaaccgttagggtccttacggacccgttaccgacgtttaaacccgttacggtttccgttcctttaaacccgtggttcccctttaaccccgg

SEQ ID NO: 93164 - DNA, 848 bp, Homo sapiens
  misc_feature: GYAE6OF01CCRSX.43.55.E11.1.454.CMB.1.raw
  modified_base (206)..(206): a, c, t, g, unknown or other
  misc_feature (206)..(206): n is a, c, g, or t
tcagtgtgagtagtcacgaccggtgctcgatttagcactcgcacgttgggtttggggggagtcagacccagtcaggacacagcatggacatgagggtccccgctcagctccgtgggctcctgctgctcgtggcctcccgaggtcgccaaatgtgacatccagatcgaccctagtcctccttcccacctgtctggatcgtgtagganacgagatcacatcacgtcggccggccagtcaagtagttatagtagtcgttggtcggtctggtatacgagacgaacgaaaccgaagggaaccgtccccgttaggtccgtagtacttacgtaagtaaggtactaacgttacgttaaagtttaacggaaacggttaccggggtacccttaaaggtttaacgggtttcgaacgggtccgggtacgtaaggtacgggtaacgttcgggtaacgggtaacttaacgggttaaccgttttaacctaccgttaaccaaccgtattaccgaagtacccgaacgtcccgtagtacccgtacgtacccgttaggttaagttacgtttaagttttacgacctttaaaacgtttacgttaaccgtaaccgtaacctaaaacttaagtttaacgttcggtttaacgttttcgggtacccgggtaccggtttaacggggtaaccccggtttaccggaaacccgggtaaacgggtaaaccccgtaaaacgggttaaacgggtaaaaaccttaaacccgtaaaaacgggttaaccggttagggttacgggtaccctaaccggtaccccttaaacgttaccgtttaccggttttacctttccttaaacccccggtcttttaccccccggg

SEQ ID NO: 93165 - DNA, 735 bp, Homo sapiens
  misc_feature: GYAE6OF01CZBDR.43.55.E11.1.454.CMB.1.raw
  modified_base (112)..(112): a, c, t, g, unknown or other
  misc_feature (112)..(112): n is a, c, g, or t
  modified_base (542)..(542): a, c, t, g, unknown or other
  misc_feature (542)..(542): n is a, c, g, or t
  modified_base (556)..(556): a, c, t, g, unknown or other
  misc_feature (556)..(556): n is a, c, g, or t
  modified_base (694)..(694): a, c, t, g, unknown or other
  misc_feature (694)..(694): n is a, c, g, or t
  modified_base (713)..(713): a, c, t, g, unknown or other
  misc_feature (713)..(713): n is a, c, g, or t
tcagtgtgagtagtcacgaccggtgctcgatttagcactcgcacggtttggggtttgggggggagtcagacccagtcaggacacagcatggacatggacgggtccccgctcncgctccgtggggctccgtgctgctctcggcctcccgaggtcgaccaaagtgtcgaacactccgagactcgacccgtacgtcccttcccttccctcccttgttcgtacggtacttacgtaggtaaggaacgacgaacggtaaccgtccaaccacttaccgtacgttccggccggacctacgtacgtaaggtaagttaagttaggttacggtcgttcgggttcggaccgttggtactacgaacgaacgaaacggaaaccggacgggaaacccgttcccgtaacgttccgataacgtacgtaacgtaagctaacttacgttaagttttaacgggaacggttacggtaaccttaaggttaacggtcaggtcggacgtaaggtggtacgtcggtaggacgtaggtaactttcctactacgactacgtacacgacncgtcgtacggtacncgtacgtagtcttaagtctttacgactttaaattctacgtacaactaactattagttcgttacgtgttcggtccggttacgggtacccgtacgggaacccgagggtaaccaacggtaaactacggaaccaagtacggnggtacgcgtcacgttactntcctgttcctacgtccgtaccc

SEQ ID NO: 93166 - DNA, 845 bp, Homo sapiens
  misc_feature: GYAE6OF01B91YZ.43.55.E11.1.454.CMB.1.raw
  modified_base (210)..(210): a, c, t, g, unknown or other
  misc_feature (210)..(210): n is a, c, g, or t
tcagtgtgagtagtcacgaccggtgctcgatttagcactcgcacgttgggtttggggggagtcagacccagtcaggacacagcatggacatgagggtccccgctcagctcctggggcctcctgcctgctctggcctacccaggtcgaccaaatgtgacatccagatcgaccctagtcctccttccaccctgtctggactcttggacgganacagctaccacatcacgttcggcccggaccagtcagtacgttataggagtcgttgggttacggccttaggttacacgagaccgaacgaaacccggaacgggtaacccgtccccgttaggttccctaagacgttacgtaagtaacggtactaacgtttaacttaaaggttttacggtaaaccggggtttaccgggttaaccccgttaaaggttttaagggttaccagggtaccggtacgtaagggttcgggtacttacgggtaggggtaaccttaagggttaacttttaccctacccgtacgtaacctaggttaaccaccggttacgaaccgtccgttcggaactaaccggttccttaaaggtacgtttacgtttaaccgttttaccggtaaccttttaaacgttttacgtaacccgttaccggtaaacctaaacgttaagtttaacggttacgtttaaacccgttttccgggtaccggggttaccgggtttaaccggggtcccgtttaaccgggaacccgggtacgtaaaaccgggtacgttaaaggaaaccgttaaaccgaaaccggtcggttacgacggtacctaccgcgtaacccttgtacccggttattacccgttcttacccgttccccg

SEQ ID NO: 93167 - DNA, 934 bp, Homo sapiens
  misc_feature: GYAE6OF01EFYNQ.43.55.E11.1.454.CMB.1.raw
  modified_base (239)..(239): a, c, t, g, unknown or other
  misc_feature (239)..(239): n is a, c, g, or t
tcagtgtgagtagtcacgaccggtgctcgatttagcactcgcacgttgggtttgggggaggcttgatacagccgggggggtccctgagactctcctgtgtagcctctggattcacctttaacgaactatgaccatgacctgggtaccgaccaggctaccgaagggaaggggctaggagtcgggtctacagtaaataagtaggagtgctggaccactactttatcgacagacttccgtanagtggccggttacacgtactcctcaagacgtaacaacttaccgaaaagaaacctaccggaccgtttaggtacgttcgttacgacctaaaagtacgaacgaacgtccgttaacggaggaaccgaacccggtaaaaggaacccgtaccggtaaccgttaacggttaacttaacgttggtacgacggtaacggacggtcggttaccgggaaagtcgttaaacggtacgttaagttttaacgtaacgttaggtttacgtttacggacgtacctttaaacgtaaccttacgttaaccgtttacggttttaacggggtaccgttaccgggttccgggaaaaccggggtttaacccggggaacccgttaaaccggggttacccgttaaccccgttccgttaacccccttaaacggaccgccccgttaaacccccgtaacccgggaaacgggttcccccaaacggtttccggtttcccccctaccccggttaacggggccccttaaccccgttcgaacccggtaccgaaccggggtacttaaccccaaccccgttcccgggaaaggaccgacccgtaacggttaaccggacccggggttaccctacggggtccgaccccggttacggttcccgggtaaaacgttaaccccgggaaacctttaccccgttaacccaaacccgttaacccgttaaccaacccggg

SEQ ID NO: 93168 - DNA, 629 bp, Homo sapiens
  misc_feature: GYAE6OF01DEVJL.43.55.E11.1.454.CMB.1.raw
  modified_base (402)..(402): a, c, t, g, unknown or other
  misc_feature (402)..(402): n is a, c, g, or t
tcagtgtgagtagtcacgaccggtgctcgatttagcactcgcacgttgggtttggggggagtcagacccagtcaggacacagcatggacatgagggtccccgctcagctccgtggggcctcctgctgctctggctcccaggtgccaaatgtgacatccagatgacccagtcctccttccaccctgtctggatctgtaggagacagacgtcaccatcacgttgcccgggccaggtcagagttattagtagcgtaggttggccctggtatcagacaacgaaaccgagggaaacgcccctaggttcctagacttcaataggcatacttaagttaggaaagtggggtaccctagttaacggttcaggcgacgtacgtaggactcgtagggacaggtacgtttaacnctacgacctatcagcacgctcgacacgcctaggatgtaatttcgactaacgtttactacgtcgacctaaactatagtagtactttcgtacggtcgttaggaccggttacggaccgtaacgggaacccttaacgggtaggtaaaacctacgtaaaaccgggtaactgggttacggacccgtggacccaaccttagttaccctagttacccttcgtacgtttacccccg

SEQ ID NO: 93169 - DNA, 516 bp, Homo sapiens
  misc_feature: GYAE6OF02G3K5X.43.55.E11.1.454.CMB.1.raw
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtgggtccattaaggtcagcggcagtggatctgggacagagttactctcaccatcagcagcctgcagcctgatgattttgctaacttattactgaccaactaatatgtatttcttggccgttggacgtttcggaccgaaagggaaccaacgtaggaaactacgaaacgtaactagtaggctagacaccatctgtcttcatcc

SEQ ID NO: 93170 - DNA, 495 bp, Homo sapiens
  misc_feature: GYAE6OF02HI2VI.43.55.E11.1.454.CMB.1.raw
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcgccaagggaccaacgtggaatcaacgaactgtgctgcacatctgtcttcatcc

SEQ ID NO: 93171 - DNA, 497 bp, Homo sapiens
  misc_feature: GYAE6OF02FG52C.43.55.E11.1.454.CMB.1.raw
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctagtcctgatctataaggcatctaatttagaaagtggggtcccattaaggttcagcggcagtggatctgggacagagttactctcaccatcagcagcctgcagcctgatgattttgctaacttattactgccaacaatatgattcttggccgtggacgttcggccaagggaccaacgtgaatcaaacgaactgtggctgcaccatctgtcttcattcc

SEQ ID NO: 93172 - DNA, 503 bp, Homo sapiens
  misc_feature: GYAE6OF02II52E.43.55.E11.1.454.CMB.1.raw
  modified_base (364)..(364): a, c, t, g, unknown or other
  misc_feature (364)..(364): n is a, c, g, or t
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttacnctcaccatcagcagcctgcagcctgatgattttgctaacttattactgaccaacaatatgattcttgccgtggacgttcggccaaggaccaacgtgaactacaaacgaactagtggctgacacatctgtcttcattccc

SEQ ID NO: 93173 - DNA, 495 bp, Homo sapiens
  misc_feature: GYAE6OF02FJACN.43.55.E11.1.454.CMB.1.raw
  modified_base (459)..(459): a, c, t, g, unknown or other
  misc_feature (459)..(459): n is a, c, g, or t
  modified_base (474)..(474): a, c, t, g, unknown or other
  misc_feature (474)..(474): n is a, c, g, or t
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagccccctagttccctgatctataaggcatctaatttagaaagtggggtcccattaaggttcagcggcagtggatctgggacagagtttactctcaccatcagcagcctgcagcctgatgattttgctaacttatactgacaaacatatgattcttggccgtggacgttcggccaaaggccaacgngaatcaacgaactgngctgcacatctgtcttcatcc

SEQ ID NO: 93174 - DNA, 553 bp, Homo sapiens
  misc_feature: GYAE6OF02HN55F.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatcgtgggacagagtttactctcaccatcagcagcctgcagcctgatgtattttgactaacttattactgaccaaacatatgtatttcttggccgttggtaccgttcgggaccgaaagggacccaacggttacggaaactaccgtaaaacggtaactaggtcggacgttcgacctacctacttcgttacggttcttaccacttcccg

SEQ ID NO: 93175 - DNA, 536 bp, Homo sapiens
  misc_feature: GYAE6OF02IMQ9F.43.55.E11.1.454.CMB.1.raw
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaattagaaagtgggtccattaaggtcagcgcagtggatcgtgggacagagtttactctcaccatcagcagcctgcagcctgatgtattttgctaacttattactgaccaacaatatgtattcttggccgttaggtaccgttcggaccgaaagggaccctaacggtaggaaacttaccgaaacggtaacttaggtcggtctacggacaccattcctgttcttacgacttcccg

SEQ ID NO: 93176 - DNA, 607 bp, Homo sapiens
  misc_feature: GYAE6OF02JKBZT.43.55.E11.1.454.CMB.1.raw
  modified_base (248)..(248): a, c, t, g, unknown or other
  misc_feature (248)..(248): n is a, c, g, or t
  modified_base (499)..(499): a, c, t, g, unknown or other
  misc_feature (499)..(499): n is a, c, g, or t
  modified_base (531)..(531): a, c, t, g, unknown or other
  misc_feature (531)..(531): n is a, c, g, or t
tcagtgtgagtagtcacgaccggtgctcgatttagcactcgcacgttgggtttgggggagtcagacccagtcaggacacagcatggacatgaggtcccgctcagctcctgggctcctgctgctctggctcccaggtgccaaatgtgacatccagatgacccacgtcctccttccaccctcgtctgatctgtaggagacagagtcaccatcacttgccgggccagtcagagtatagtagtactggttcngggtccgtcggtagtacacgacgacggaaaccgaacgggaaacggaccccgtaacggttaccgttacgtacgtacgttactaaaggtacgtaacttacgttaactttaagtaaacggtacgggttacccgtaacgttaaggttacgtacgacggtcgagtaggtagtacgtaggtacgagagttacgtactacaccactacacgacacgacgtacgacagactacgtatagtatttagtactaacttattnaaccttacgtactaactaactacttacgtagnttaccgtttacgggtaccggttacgggtaaccggttaccgggtacccggtaaccgggtaccggtaaaccgtaacgg

SEQ ID NO: 93177 - DNA, 538 bp, Homo sapiens
  misc_feature: GYAE6OF02IOPBL.43.55.E11.1.454.CMB.1.raw
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaattagaaagtgggtccattaaggttcagcgcagtgatcgtggacagagtttactctcaccatcagcagcctgcagcctgatgatttgactaacttattactgaccaaataatatgatttcgttaggccgttggtaacgtttccgggaccgaaagggaaccctaacggtagggaaatcgaaaacggaacttggtacggtctaggaccaacctattcctggtccttcattccccg

SEQ ID NO: 93178 - DNA, 516 bp, Homo sapiens
  misc_feature: GYAE6OF02FIS5H.43.55.E11.1.454.CMB.1.raw
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgatttgactaacttattactgccaacaatatgtattcttggcccgttggaccgtttcgggacctaaagggaccaacgtggaaatcgaaacgtaactagtaggctgcaccatctgtcttcattccc

SEQ ID NO: 93179 - DNA, 515 bp, Homo sapiens
  misc_feature: GYAE6OF02JHKIO.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaattagaagtgggtccattaaggttcagcggcagtggatcgtgggacagtagtttactctcaccatcagcagcctgcagcctgatgtattttgactaacttattactgaccaacaatactgatttcgtggtccgtggacgttcgaccgtaagggaccaagtgaactcaaacgtaactggtcggctgcaccagttctgtcttctattcccg

SEQ ID NO: 93180 - DNA, 571 bp, Homo sapiens
  misc_feature: GYAE6OF02JBOSF.43.55.E11.1.454.CMB.1.raw
  modified_base (425)..(425): a, c, t, g, unknown or other
  misc_feature (425)..(425): n is a, c, g, or t
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcaagaaaccagggaaacgcccctaggttcctgatctagtaagcatctaattagaagtgggtaccagttaaggtcagcggcagtggatcgtgggacagtagtttactctcaccatcagcagcctgcagcctgatgtattttcgactaactttattactcgacctaanaatatgtattcgttcggccgttggtacgttccggaccgtaaacgggaccctaacgtaggtaaactaccgaaaaccggtaacgttggtacggtccgttacgaccgaaccgttacgttccgttacgttccttacgtacctttaccccg

SEQ ID NO: 93181 - DNA, 568 bp, Homo sapiens
  misc_feature: GYAE6OF02GY40E.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtccattaaggtcagcggcagtggatcgtgggacagagtttactctcaccatcagcagcctgcagcctgatgtattttgactaactttattactgacctaaactaatatagtatttcgttggtccgtggtaccgtttcgggaccgtaaacgggaaccctaaacgggtacggaaactaccgaaaacggtaacgtaggtacggtaccgtacgacctaaccgtacttccgttacgttcttacactttcccg

SEQ ID NO: 93182 - DNA, 560 bp, Homo sapiens
  misc_feature: GYAE6OF02I0PWK.43.55.E11.1.454.CMB.1.raw
  modified_base (338)..(338): a, c, t, g, unknown or other
  misc_feature (338)..(338): n is a, c, g, or t
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttcaccctgtctggatctgtaggagacagagtcaccatcacttgccgggccagtcagagtattagtagctggttggcctggtatcagcagaaacccagggaaagcccctaggttcctgatctataaggcatctaatttagaaagtgggtaccattaaggtcagcggnagtgatctgggacagtagtttactctcaccatcagcagcctgcagcctgatgattttcgctaacttattactgccaaacaatatgtaacttcgttggaccgttgggtaccgtttcggaccgtaaacggggaccaacgggttaggaaactacgaaaaccggtaacttacggtgggtacctacggtaccaccgtaagtccgttaggtcccttactacgtttccc

SEQ ID NO: 93183 - DNA, 533 bp, Homo sapiens
  misc_feature: GYAE6OF02F8HHQ.43.55.E11.1.454.CMB.1.raw
  modified_base (333)..(333): a, c, t, g, unknown or other
  misc_feature (333)..(333): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtgggtcccattaagttnagcggcagtggatcgtgggacagtagtttactctcaccatcagcagcctgcagcctgatgtattttgactaactttattactgaccaaactaattatgtattcgttggccgttggtaccgtttcggaccgaaacgggaccaacgtaggaaatacgaaacgtaactggtacggactgactaccatcgtgtcttacattccc

SEQ ID NO: 93184 - DNA, 597 bp, Homo sapiens
  misc_feature: GYAE6OF02G425T.43.55.E11.1.454.CMB.1.raw
  modified_base (382)..(382): a, c, t, g, unknown or other
  misc_feature (382)..(382): n is a, c, g, or t
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgactatccagatgacccagtctccttccacctgtctggatcgtgtaggagacagacgtcgaccatcacgttgcccggcagtcagagtattagtagcgttggttcggcctggtatcagcaagaaaccagggaaacgccccgtaggttcctagactctaataaggctagtactaagttagaaagtgggtacctattaaggttcagcggacagtggatcgtgggacagtagtttacnctacacatcagcacgctgacagcctgaactgtatttacgactaaacttatttactacgaccaaataatatacgtatttccgttaggtacccgttaggtaaccggtttcgaaccggtaaacggaaccgtaacggtaaggaaacgtacgtaaaaccggacgttaggtaggtaccttagacctaccttagtccgttacggtccttacgtacttacccg

SEQ ID NO: 93185 - DNA, 514 bp, Homo sapiens
  misc_feature: GYAE6OF02IN7BD.43.55.E11.1.454.CMB.1.raw
  modified_base (286)..(286): a, c, t, g, unknown or other
  misc_feature (286)..(286): n is a, c, g, or t
  modified_base (329)..(329): a, c, t, g, unknown or other
  misc_feature (329)..(329): n is a, c, g, or t
  modified_base (364)..(364): a, c, t, g, unknown or other
  misc_feature (364)..(364): n is a, c, g, or t
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcacatcacttgccgggccagtcagagtattagtagctggttggcctggtatcagcagaaaccaggaaacgccctaggttccngatctataagcatctaatttagaaagtgggtaccattaagttnagtcgcagtggatcgtagggacagtagtttacgtntcaccatcagtacagcctgcagcctgatgtatttgactaactttatactcgacaaacatatgattctggccgtggtaacgttcgacctaagggaacctagtagaatacgaagtaacgtagtgctcgacaccatccttgtacttcattccg

SEQ ID NO: 93186 - DNA, 575 bp, Homo sapiens
  misc_feature: GYAE6OF02G49IO.43.55.E11.1.454.CMB.1.raw
  modified_base (277)..(277): a, c, t, g, unknown or other
  misc_feature (277)..(277): n is a, c, g, or t
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcaagaaaccagggaaacncccctaggttcctgatctataaggcatctaattagaaagtgggtaccagttaaggtcagcggcagtggatcgtagggacagtagtttactctacaaccatcagcagcctgcagcctgatgtattttgactaactttattacctgaccaaactaattatgtaatttcgttcggaccgttggtaaccgtttcggaccgtaaagggaacccgtaaaggtacggtaaactacgaaaacggtaaccgttaggtacggactacggaccgaaccctagttccgttagttccttacacctttcccg

SEQ ID NO: 93187 - DNA, 599 bp, Homo sapiens
  misc_feature: GYAE6OF02HCZYS.43.55.E11.1.454.CMB.1.raw
  modified_base (245)..(245): a, c, t, g, unknown or other
  misc_feature (245)..(245): n is a, c, g, or t
  modified_base (295)..(295): a, c, t, g, unknown or other
  misc_feature (295)..(295): n is a, c, g, or t
tcagtgtgagtagtcacgaccggtgctcgatttagcactcgcacgttggggtttgggggagtcagacccagtcaggacacagcatggacatgagggtccccgctcagctcctggggctcctgctgctcgtggtcgtcccaggtgccaaagtgtgacatccagtatgacccagtctccttccaccctgtctggatctgtaggagacagagtcaccatcacttcgccgggccagtcagagtattagngctggttgcctggtatcagcagaaaccgagggaaacgcccctaggttccnggtactctagtaacggcatactaaagtttagaaaggtcgggtacctagttaacggtcaaggcggacaggtggaatcgtagggactagtagtttactctacacatcagcagcctgcagcctagatgtatttcgacttaacttatacacgaccaactatatgtactttcgtaggtccgttaggtaccgttaccggaccgaaacgggtaaccgaacggtacggtaaactaccgaaaacggtaccgttaggtacggtactacggacctaaccgtagttaccgttaggttccttactacgttaccccgg

SEQ ID NO: 93188 - DNA, 672 bp, Homo sapiens
  misc_feature: GYAE6OF02HU8AW.43.55.E11.1.454.CMB.1.raw
  modified_base (198)..(198): a, c, t, g, unknown or other
  misc_feature (198)..(198): n is a, c, g, or t
  modified_base (297)..(297): a, c, t, g, unknown or other
  misc_feature (297)..(297): n is a, c, g, or t
  modified_base (336)..(336): a, c, t, g, unknown or other
  misc_feature (336)..(336): n is a, c, g, or t
tcagtgtgagtagtcacgaccggtgctcgatttagcactcgcacgttgggtttggggggaggtcagacccagtcaggacacagcatggacatgagggtccccgctcagctcctggggctcctgctgctctggctcccaggtgccaaatgtgacatccagatgacccagtctccttccacctgtctggatctgtagganacagagtcaccatcacttgccggcagtcagagtatagtagctggtggcctaggtatcagcaagaaaccagggaaacgcccgtaaggtcctgactactanaagcatactaatttagaaagtgggtacccattaagtgancggcgagtggaatctagggactagacgtttactctctaccatcagcaacgctcgacacgtacctagtactagtattttaggtaccaaacttttaaacttactcgtaacccaaactaaactttaaatagttaactttaacccgtttgggtaccccgggttaggtaaccggtttacggttaccccggaaacgggtaaacccgggtaacgtaaacccgggtaaaggtaaacctaaaaccggaaaacggtttaccgtaagggtacccggtttaacgaccggaaaccgttaacccgtaccgtttaaccgttttaccgttacgttaaccgttttaacccccg

SEQ ID NO: 93189 - DNA, 506 bp, Homo sapiens
  misc_feature: GYAE6OF02H6YXW.43.55.E11.1.454.CMB.1.raw
  modified_base (493)..(493): a, c, t, g, unknown or other
  misc_feature (493)..(493): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaagcccctaggttcctgatctataaggcatctaatttagaaagtggggtcccattaaggtcagcggcagtggatctgggacagagtttactctcaccatcagcagcctgcagcctgatgtattttgactaacttattactgaccaaacaatatgtattcgttaggccgtggacgttcggaccgaagggaccaagtcgaatcgaaacgatagtggctgcacntctgtcttcatcc

SEQ ID NO: 93190 - DNA, 544 bp, Homo sapiens
  misc_feature: GYAE6OF02FQDXM.43.55.E11.1.454.CMB.1.raw
  modified_base (428)..(428): a, c, t, g, unknown or other
  misc_feature (428)..(428): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttggccgggccagtcagagtattagtagctggttggcctggtatcagcagaaaccagggaaagcccctaggttcctgatctataaggcatctaatttagaaagtggggtcccattaaggttcagcggcaggtggatcgtgggacagtagtttactctcaccatcagtcagcctgcagcctgatgaatttgactaactttatactgaccctaaanaactatagtatttcgttggccgttggaccgtttcgggacccaaacgggaccaacggtggaaactcgaaaacggtaactaggtacggcttgacacctatcctacgtcttcattcccg

SEQ ID NO: 93191 - DNA, 590 bp, Homo sapiens
  misc_feature: GYAE6OF02GRZ57.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcaagaaaccagggaaacgcccctaggttcctagatctataaggcatactaatttagaaagtgggtaccagttaaggtcagcgcagtgatcgtgggacagtagtttactctcacatcagcagcctgcagcctgatgtattttgactaacttattactacgacctaaataatattgtaactttcgttacgggtcccgttagggtaccgtttccgggaacccgtaaacggggaaccctaaacgggttaggtaaactaccgtaaaacggtacgttaggtacgggtctacggacctaaccgtacttccgttcggttacctttaccactttccccg

SEQ ID NO: 93192 - DNA, 553 bp, Homo sapiens
  misc_feature: GYAE6OF02HKNSN.43.55.E11.1.454.CMB.1.raw
  modified_base (289)..(289): a, c, t, g, unknown or other
  misc_feature (289)..(289): n is a, c, g, or t
  modified_base (333)..(333): a, c, t, g, unknown or other
  misc_feature (333)..(333): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttccngatctataaggcatctaattagaagtgggtccattagtcagcgnagtggatcgtgggacagtagtttactctcaccatcagcagcctgcagcctgatgtatttgctaattattactgaccaaacaatatgtactttcgttggccgttgggaccgtttcggaccgtaacgggaacctaacggtaggaaacttacgaaaaccggtaacgtacggttaggtacctacggaccaaccgtagtccgttagtcctttaccactttccccg

SEQ ID NO: 93193 - DNA, 708 bp, Homo sapiens
  misc_feature: GYAE6OF02J0JJ8.43.55.E11.1.454.CMB.1.raw
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagcgttggttcggccgtggtactcctagcagaaacccgagggtaaacgccccgttaggttccctagatacctaataacggctagttacttaaagtttaggaaaacggtcggggttacccctaagtttaacggtttcgacggtacggacgtaggttagggacttcggtaggggacctaggtaaggttttaacctctacctaacccgtattaccgaaggtcctaaccgccttacggactacccggaccgttgtaagttacgttattttacggaccttaactttaacgttaccgttacgtaccctaaaacaacgtttattacgtattttaccggttaggtaccccggtaggtaccggtttaccggacccgtaaaggtaacccgtaacggttaggaacttaccgtaaaacggtcttaggtacggaccgttacgaaccgtactacgtacgttacgtactttaccgaccttacccg

SEQ ID NO: 93194 - DNA, 511 bp, Homo sapiens
  misc_feature: GYAE6OF02F7FPO.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtacccattaaggttcagcggcagtggatctgggacagagtttactctcaccatcagcagcctgcagcctgatgattttgctaactttattactgaccaacaatatgattcttggccgttggacgttcggccaaagggaccaacgtaggaaatcaaacgtactggtaggctgcacatctgtcttcattccc

SEQ ID NO: 93195 - DNA, 584 bp, Homo sapiens
  misc_feature: GYAE6OF02GZPXL.43.55.E11.1.454.CMB.1.raw
  modified_base (431)..(431): a, c, t, g, unknown or other
  misc_feature (431)..(431): n is a, c, g, or t
tcagtgtgagtagtcacgaccggtgctcgatttagcactcgcacgttgggtttggggggagtcagacccagtcaggacacagcatggacatgagggtccccgctcagctcctgggctcctgctgctctggctcccaggtgccaaatgtgacatccagatgacccagtctccttccaccctgtctggatctgtaggagacagagtcaccatcacttgccggccagtcagagtatagtagctggttggcctggtatcagcaagaaaccgaggaaacgcccctaggttcctgatctaataaggcatctaattagaaagtgggtccattaaggttcagcggcagtgatcgtaggacagtacgtttactcgtacaccatcagcgagccctgcgaagtcctgattgattttcgacttaacttattactgacctaaanaattatactagttccgttacggccgttagggtaccgttacgggaccctaaacgggaacctaaacggtacggtaaataccggtaaaacgtaacggtaggttcggactcggacctaaccgtacttaccgttgttaccctttcaaccgtttccccg

SEQ ID NO: 93196 - DNA, 561 bp, Homo sapiens
  misc_feature: GYAE6OF02IB6W5.43.55.E11.1.454.CMB.1.raw
  modified_base (364)..(364): a, c, t, g, unknown or other
  misc_feature (364)..(364): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggcagtcagagtattagtagctggttggcctggtatcagcagaaaccagggaaacgcccctaggttcctgatactataaggcatctaatttagaagtgggtccagttaaggtcagcggcagtggatcgtggacagtagtttacnctcaccatcagcagcctgcagcctgatgtattttgactaactttattactgaccaaactataattgtatttcgttcgggtaccgttgggtaccggtttcggacccggtaaagggaacccgaacggttacggaaacttacgaaacgtaacgtcggtaggccttagccaacctagtccttcggttcttccgacttcccg

SEQ ID NO: 93197 - DNA, 620 bp, Homo sapiens
  misc_feature: GYAE6OF02J10R7.43.55.E11.1.454.CMB.1.raw
tcagtgtgagtagtcacgaccggtgctcgatttagcactcgcacgttgggtttgggggtaggtcagacccagtcaggacacagcatggacatgagggtccccgctcagctcctgggctcctgctgctctggctcccaggtgccaaatgtgacatccagatgacccagtctccttccaccctgtctggactctgtaggagacagagtcaccatcacttgccgggccatcagagtattagtagctggttggcctggtatcagcagaaacagggaagccctaggtcctgatctatagcatactaatttagaagtgggtacccagttaaggtcaggcgacgtagttggattcgagggaacagtagtttactctctaaccgaatcgtaagcgaagtccctggcctaggccctagtactgtaacttttgaacctaacctttataccttgaaccctaaataaacgttattacgtaatttccgtttaggacccgtggtaccggtttacgaacccgaaagggtaccgttaaacgggtagtaactacgtaaaaccggaacgttaggttacgggacttaccggacctaaaccgtcgtacccgtttagtaccctttccgtacgtttaccccc

SEQ ID NO: 93198 - DNA, 500 bp, Homo sapiens
  misc_feature: GYAE6OF02H61NU.43.55.E11.1.454.CMB.1.raw
  modified_base (287)..(287): a, c, t, g, unknown or other
  misc_feature (287)..(287): n is a, c, g, or t
  modified_base (342)..(342): a, c, t, g, unknown or other
  misc_feature (342)..(342): n is a, c, g, or t
  modified_base (472)..(472): a, c, t, g, unknown or other
  misc_feature (472)..(472): n is a, c, g, or t
  modified_base (485)..(485): a, c, t, g, unknown or other
  misc_feature (485)..(485): n is a, c, g, or t
tcagtgtgagtagtcacgaccggtgctcgatttagcactcgcacgttggggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcaagaaaccaggaacgccctagtccngatctatagcatctaattagaaagtgggtccattaggtcagcggcagtggatcgngggacagtagtttactctacaccatcagcagcctgcagcctagatgtatttgactaactttattactgaccaaactatatgtattcgtggtccgtggtacgttcggcaaggaccagtagaatacaaacgntgagctagcaacntctgtcttcattccc

SEQ ID NO: 93199 - DNA, 568 bp, Homo sapiens
  misc_feature: GYAE6OF02HFAYB.43.55.E11.1.454.CMB.1.raw
  modified_base (277)..(277): a, c, t, g, unknown or other
  misc_feature (277)..(277): n is a, c, g, or t
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
  modified_base (423)..(423): a, c, t, g, unknown or other
  misc_feature (423)..(423): n is a, c, g, or t
tcagtgtgagtagtcacgaccggtgctcgatttagcactcgcacgttgggtttgggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccggccagtcagagtattagtagctggttggcctggtatcagcagaaaccagggaaacncccctaggttcctgatctataaggcatctaatttagaagtgggtacccagttaaggtcagcggcaggtgatcgnggacagagtttacnctcaccatcagcagcctgcagcctgatgtatttcgactaatttacttactgacctaanatatgtatttcgtaggccgttggtaccgttacggacccgtaaagggaccctaaggtacggaaataccgtaaaacggtaccttagggtacggtccgtacggtacccaaccgtacgttccttacggttcctttaccactttcccccg

SEQ ID NO: 93200 - DNA, 619 bp, Homo sapiens
  misc_feature: GYAE6OF02JXW1R.43.55.E11.1.454.CMB.1.raw
  modified_base (257)..(257): a, c, t, g, unknown or other
  misc_feature (257)..(257): n is a, c, g, or t
  modified_base (351)..(351): a, c, t, g, unknown or other
  misc_feature (351)..(351): n is a, c, g, or t
  modified_base (389)..(389): a, c, t, g, unknown or other
  misc_feature (389)..(389): n is a, c, g, or t
  modified_base (435)..(435): a, c, t, g, unknown or other
  misc_feature (435)..(435): n is a, c, g, or t
tcagtgtgagtagtcacgaccggtgctcgatttagcactcgcacgttgggtttgggggaggtcagacccagtcaggacacagcatggacatgagggtccccgctcagctcctgggctcctgctgctctggctcccaggtgccaaatgtgacatccagatgacccagtctccttccaccctgtctggatctgtaggagaccagagtcaccattcacttgccgggccagtcagagtattagtagctggttgcctggtancagcagaaccaggaacgcccctagttcctgatctataaggctatactaagtttaagaaagtcggggtaccctaattaacggttcacggtcgganaggtaggactcgtagggactagtacgtttactcgtacnctatcagccagccctgacacgctgatgtattttgacttaaacgttntttacgactacctaaatatagttgttacttacgttacggccgttacgggtaccgttacgggtaccaaaccgggtaacctaccggtaagaaacgttccaaaaccggtacgttcggttagggaacccttacgggaccttaacccgaggtttaccttacggttacccttttaccgacctttccccgg

SEQ ID NO: 93201 - DNA, 548 bp, Homo sapiens
  misc_feature: GYAE6OF02F5PYN.43.55.E11.1.454.CMB.1.raw
  modified_base (528)..(528): a, c, t, g, unknown or other
  misc_feature (528)..(528): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccggccagtcagagtattagtagctggttggcctggtatcagcaagaaaccgagggaaacgccccgttaggttcctgatctaataaggcatactaaatttaaggaaaggtcgggtaccctaagttaaggttcaggcggcaggtggatcgtgggactagtagtttactctacaccatcagcacgcctgccagcctgatgtatttgactaacttattacctgacctaaataatatgtaattcgttcggccgtggtacgttcggaccaagggaccaagtagaactacgaaacgaactggtagctacgacacgtnttctcgtacttcacttcccg

SEQ ID NO: 93202 - DNA, 690 bp, Homo sapiens
  misc_feature: GYAE6OF02JP89O.43.55.E11.1.454.CMB.1.raw
  modified_base (231)..(231): a, c, t, g, unknown or other
  misc_feature (231)..(231): n is a, c, g, or t
tcagtgtgagtagtcacgaccggtgctcgatttagcactcgcacgttgggtttggggggaggtcagacccagtcaggacacagcatggacatgagggtccccgctcagctcctgggctcctgctgctctggctcccaggtgccaaatgtgacatccagatgacccagtcctccttccaccctgtctggatctgtaggagacagagtcaccatcacttgccggccagtcagngtatagtgctggttgcctggtatcagcagaaccaggaaacgcccctaggttccctagactctaataaggctatacctaagtttagaaacgtcggggtaccctatttaacggttccaggtcggactaaggtaggtataccgtggggaaccaggtagttttaccgtcttaccaccgtattccaagaccgtagtccctagacgaacgtcccttaggacttaggttaactttttcgaccgttaaactttaacggttttacctacggacccctaaagtaaaacttcgttaacgtaacgtttttccgttacgggttcccggttaaggggttaccccggtttaaccggtaccggtaaaccgggtaaccgtaaaccggttacggtaaacgtaccgtaaaaccggtaacggttcgtacgggtacctacggtaccaaccgttattccgtattaccgtttcaacttcccg

SEQ ID NO: 93203 - DNA, 822 bp, Homo sapiens
  misc_feature: GYAE6OF02JN6QI.43.55.E11.1.454.CMB.1.raw
tcagtgtgagtagtcacgaccggtgctcgatttagcactcgcacgttgggtttgggggtaggtcagacccagtcaggacacagcatggacatgagggtccccgctcagctcctggggctcctgctgctctggctcccaggtgccaaatgtgacatccagatgacccagtctccttccaccctgtctggtactcctgtaggacgaccagtacgtccaaccgattccaacgttcggacccggggtcccaaggtacctaaggtacgttaatttaacggtaggtccgttggggttcggtacccgttggggtaattccgaacggtaccgtaaacggtaaaaccccgagggggaaaaaccgtcccccggtaacggttttacccgtaggtacttacgttaaccgttaagggaccttacggttaaactttaaacggttttaaacggtaaacggggttccggggtaaaccctttaacgggtttaacgtttacggacggtaccggtaacgtagggttaggtacgttacggttacgggaacgtaggttttaaccgtttaccgttagtaacccgaaccgttagtaccggtaaccgaccgaacgttcccgaggttacccgaacgtccgtagtaacgtttgttacctttacggaaccttacgttaacttttaccgaccgtaaactaacctaattacgtacgttagtttaccgtggtaccggtggtaccggttacgtaccggaaaccggaacgtaaccggtaacgtaatacccgaaacgtacgttacggtgtacgtaccgtacctaacacgttactcgtacttcccgatttaccccg

SEQ ID NO: 93204 - DNA, 537 bp, Homo sapiens
  misc_feature: GYAE6OF02HO5GO.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctaataaggcatctaatttagaaagtgggtccattaaggttcagcgcagtggatcgtgggacagagtttactctcaccatcagcagcctgcagcctgatgtatttgactaactttattactgaccaactaatatgtattcgttggccgttggacgtttccgggaccgaaagggaccaacgtaggaaactcgaaaacggtaactggtacggactcgactaaccatccttgttaccttcattccccg

SEQ ID NO: 93205 - DNA, 532 bp, Homo sapiens
  misc_feature: GYAE6OF02FI6W2.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaacgcccctaggttcctgatctataaggcatctaatttagaaagtgggtaccattaaggttcagcggcagtgatcgtgggacagtagtttactctcaccatcagcacgctgcacgcctgatgtattttgctaacttattactgaccaacaatatgtattcgttggccgttggtacgttccggacctaaacgggaccaacggtaggaataccgaaacgtaacgtagtcggactgacacctagtcctgtcttcacttcccg

SEQ ID NO: 93206 - DNA, 832 bp, Homo sapiens
  misc_feature: GYAE6OF02HMDD8.43.55.E11.1.454.CMB.1.raw
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtcctccttccacctgtctggatctgtaggagacagagtcacatcacttgccgggcagtcagtagtattaggtagtcgtgggttcggccttggtatacgagtcgaacggaaaccgaaggggaaaccgtccccttaaggggttccctacggtaattcgttaagtaacggactaacttaaccgttaaagttttaagggtaaaacgggttacgggggttacccctaaaggttttaaacggtttccgaacgggtaccgggtacgtaacgggttacgggaacgtttaccggtacgggggtaaaccgtaaagggtttaccgttttaaccgtaccgttaacccgtaaacccgtaacgttaaccggtaacgggttaccgtaaacccgggtcccggtttaacgcccgggtaaaccgtcccgtttaaggtaacgtttacgttaacgttttcggaaacctttaacgtttaacttacccgtagtaacccgaaattaaactttacggttaacgtaccgttttcggttacccgggttaccggtacgggttaaccgttccgggtaaaccggaaacgggttacccgtaaaggttacggtaaaccgttacgaaaccggtaacggtggtacggaaccgttcgaccgttacgactttccggtacgtttccgtactacgttaccccg

SEQ ID NO: 93207 - DNA, 600 bp, Homo sapiens
  misc_feature: GYAE6OF02G3ZNG.43.55.E11.1.454.CMB.1.raw
  modified_base (362)..(362): a, c, t, g, unknown or other
  misc_feature (362)..(362): n is a, c, g, or t
  modified_base (438)..(438): a, c, t, g, unknown or other
  misc_feature (438)..(438): n is a, c, g, or t
tcagtgtgagtagtcacgaccggtgctcgatttagcactcgcacgttgggtttgggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggcagtcagagtattagtagctggttggcctggtatcagcaagaaaccagggaaacgccccgtaaggttcctgatactagtaaggctattactaagtttagaaaggtcggggtaccctaagttaaggttcaggcggctagnggtatcgtagggacaggtacgtttactctcaccatcagcagcctgcagctagattgtatttgactaattattactnacctaaactaatattgtaatttccgtagggtccgtaggtaccgttacgggaccgtaaacgggtaacctaagggttacggaacgttaccgaaaacggtaacgttaggtacggaccgtacgtaccctaacctgttccgttagtttacttaccgtacttaccccg

SEQ ID NO: 93208 - DNA, 697 bp, Homo sapiens
  misc_feature: GYAE6OF02HFV5G.43.55.E11.1.454.CMB.1.raw
  modified_base (392)..(392): a, c, t, g, unknown or other
  misc_feature (392)..(392): n is a, c, g, or t
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccacctgtctggatctgtaggagacagagtcacatcacttgccgggccagtcagagtattagtagctggttgcctggtatcagcaagaaaccacgggaaacgtccccgtaaggttcctgatactaagtaacggcagtacttaaagtttaagaaagttcggggtacctaagttaacggttcaagcggactaggtgattacgtgggacaagtacgtttacnctacaccatcgagtacacgtcctgacacgtcctagtaacgtgtaattttacgacttaaactttagttaaaccttcgaacctaaaactaaattaacgttgttaactttacccgtttcggggtacccgttaacgggtaaccggtttacccgggtaaaccgaaaccgggtaaaccccgtaaaagggttaaccgtaaaacgttaaccgaaaaacccggtaacgtacggtaacgggtacctttaaccgaccggttaaacccttaacgttaccgtttaacggttaccctttaacggtaccctttaccccgg

SEQ ID NO: 93209 - DNA, 647 bp, Homo sapiens
  misc_feature: GYAE6OF02FZ8X9.43.55.E11.1.454.CMB.1.raw
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (328)..(328): a, c, t, g, unknown or other
  misc_feature (328)..(328): n is a, c, g, or t
  modified_base (367)..(367): a, c, t, g, unknown or other
  misc_feature (367)..(367): n is a, c, g, or t
tcagtgtgagtagtcacgaccggtgctcgatttagcactcgcacgttgggtttggggggaggtcgagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccggccagtcagagtattagagctgttggcctggtatcagcagaacgaggaaagccctaggtctgatctanaggcatntaattagaaagtcgggtacctagttaagttnagcggactagtcggtatcgtagggacaggtacgtttacncgtacacctattcagtcagtctgcagtcccgtagtacgttagttacttttacggaccttaacgttaactttaccgttagaccctaaaacttaattaacgtagttaacgtttccttggtacccggttacgggttaccgttacccgggtacggtaaaccgggtaaaccgaaccggtttaaggaacgttaaaccgtaaaacggtaaaccgttacggttaacgggtaccctaggtaacccgtaccctacgttaccgttacgttcctttacgtaaccttccccgg

SEQ ID NO: 93210 - DNA, 697 bp, Homo sapiens
  misc_feature: GYAE6OF02JPAY3.43.55.E11.1.454.CMB.1.raw
  modified_base (200)..(200): a, c, t, g, unknown or other
  misc_feature (200)..(200): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
tcagtgtgagtagtcacgaccggtgctcgatttagcactcgcacgttgggtttgggggtaggtcgagacccagtcaggacacagcatggacatgagggtccccgctcagctcctggggctcctgctgctctggctcccaggtgccaaatgtgacatccagatgacccagtctccttccaccctgtctggactctgtaggngacagagtcaccatcacttgccgggccagtcagnggtattaggntctggttggcctggtatcagcaagaaaccgagggaaacgccctaaggttcctagtactcgtaacgtacggtactactacttaaagtttaggtaaacggttcggggtaacctaaggttaacggttacgtacggcggtaacgtaggttaggtacgtaccgtagggtaaccgtaaggttaccgtttaactccgttaccaaccgtactacgtaacgctacggtacctaggtacacggtccgtaggtacgttagttacgtttacgaccttaacgtttactaacttcgacctaaactagtaacttacgttacgtttaccgttcgggtaccggttaggttacccgggttacgtaaccgggtaacggaaccgtaagttaacggaacgttaaccgaaaccgtagtaacggtggtacctgaacctaaccgtacgttacgttcgtacgttactacggttacccc

SEQ ID NO: 93211 - DNA, 619 bp, Homo sapiens
  misc_feature: GYAE6OF02I70V8.43.55.E11.1.454.CMB.1.raw
  modified_base (277)..(277): a, c, t, g, unknown or other
  misc_feature (277)..(277): n is a, c, g, or t
  modified_base (340)..(340): a, c, t, g, unknown or other
  misc_feature (340)..(340): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaagagacagagtcaccatcacttgccgggccagtcagagtattagtagctggttggcctggtatcagcagaaaccgagggaaanccccgtagttcctgatctataaggcatctaatttagaaagtggggtccataaggttcagcggnagtggatcgtgggacagtagttactctcaccatcagtcagcctgcaggcctgacttgtattttggacctaactttattactacgaccctaaactaattaacttagtaatttcgtttacgggacccgttagggtaccggtttccgggtaacccgaaacggggtaacccgtaacggttacgggaaacgttaccgaaaaaccggtaaaccgttacggtacgggtacctacggtacctaacccgtattcccgttaggttcccgtttaccgtactttacccccg

SEQ ID NO: 93212 - DNA, 526 bp, Homo sapiens
  misc_feature: GYAE6OF02FPB3P.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtacccattaaggttcagcggcagtggatcgtagggacagtagtttactctcaccatcagcagcctgcagcctgatgtattttgactaactttattactgaccaaacaatatgtattcgttggccgttggaccgttcggaccaagggaccaacgtgaactacgaaacgtaactggtacggctagcctacatctgtcttcattcccg

SEQ ID NO: 93213 - DNA, 686 bp, Homo sapiens
  misc_feature: GYAE6OF02JRDOZ.43.55.E11.1.454.CMB.1.raw
  modified_base (245)..(245): a, c, t, g, unknown or other
  misc_feature (245)..(245): n is a, c, g, or t
  modified_base (420)..(420): a, c, t, g, unknown or other
  misc_feature (420)..(420): n is a, c, g, or t
tcagtgtgagtagtcacgaccggtgctcgatttagcactcgcacgttgggtttgggggagtcagacccagtcaggacacagcatggacatgagggtcccgctcagctcctgggctcctgctgctctggctcccaggtcgccaaatgtgacatccagatcgacccagtcctccttccaccctgtctggattcctgtaggagacagacgtcaccatcacttcgccggccagtcagagttattagacncgtggttggccttggtattcgagacaagaaaccgaagggaacgtccccgtaaggttccctagactacgtaagtaacggctaactacttaaagttacgtaaaaggttcggggtacctaaacgttttaaggttaccaacggtacggaccttaaggtagggtactacgtacgggtaanaggttaacgtttacaccgttacaccgtagtacgaacgtcacgccgtaagccgacgtccctagaattacggttaatttaccggacttaaacgtttacgtttaactcgtaaaccgtaactaattagttcgtactttacgtacggtaccgtagggttacgtttccggacgtaaacgggctaaacggttaagacgttaacgaaacgtcgttacgtacggtataaccggaccaacgtaacttccgttaagttacccttcgtaaccttcccg

SEQ ID NO: 93214 - DNA, 531 bp, Homo sapiens
  misc_feature: GYAE6OF02GMVEF.43.55.E11.1.454.CMB.1.raw
  modified_base (199)..(199): a, c, t, g, unknown or other
  misc_feature (199)..(199): n is a, c, g, or t
  modified_base (277)..(277): a, c, t, g, unknown or other
  misc_feature (277)..(277): n is a, c, g, or t
  modified_base (336)..(336): a, c, t, g, unknown or other
  misc_feature (336)..(336): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggactctgtagganacagagtcaccatcacttgccgggccagtcagagtattagtagctggttgctggtatcagcaagaaaccagggaaacnccccgtaggttcctgatctataaggcatctaattagaagtgggtccagttagtcagcgnagtgatcgaggacagtacttactctacacatcagcacgcctgacagcctgatgtactttcgactaactttatacgtcgacctaaactatactcgtaacttcgttcgggaccgttgggtaaccgttccgggacgaacgggtaccacggtagaactcgaaacgctggtacgctagccactctcgtctctcactcccg

SEQ ID NO: 93215 - DNA, 718 bp, Homo sapiens
  misc_feature: GYAE6OF02JXVR2.43.55.E11.1.454.CMB.1.raw
  modified_base (196)..(196): a, c, t, g, unknown or other
  misc_feature (196)..(196): n is a, c, g, or t
tcagtgtgagtagtcacgaccggtgctcgatttagcactcgcacgttgggtttgggggagtcagacccagtcaggacacagcatggacatgagggtccccgctcagctcctgggctcctgctgctctggctcccaggtgccaaatgtgacatccagatgacccagtctccttccaccctgtctggatctgtagganacagagtcacatcacttgccgggccagtcagagtattagagtcgtgggttggaccgttgtactacgagacgaaacgaaaccggagggaacccgtcccgttaacgttccgtagtactaacgtaagtaacggactattaacgttaaagttaacggaaaggtccggggtaacccttaagtttaaggttaccacgggtacggaacgtagggtacgtaagttaccgggtagggaacgtaaggtttaacgttttacaccgttaccaaacccgttaagtaccgaacggtactacgtaccgttacgaccgaccgttaccgtgttaacgttacgtttaagtttccgtaaacttaaccgttttacttaacgttccgaaaccgtaaacgttaatagttaccgttaatttccgggttacggtacccggttagttaccggttaccgacggaaaccgtacggtaagtacgaactaagtaaccgaaggttgacgtactccgtaacacttactcgttcgtacttactccgttaacccg

SEQ ID NO: 93216 - DNA, 509 bp, Homo sapiens
  misc_feature: GYAE6OF02GNPY3.43.55.E11.1.454.CMB.1.raw
  modified_base (198)..(198): a, c, t, g, unknown or other
  misc_feature (198)..(198): n is a, c, g, or t
  modified_base (349)..(349): a, c, t, g, unknown or other
  misc_feature (349)..(349): n is a, c, g, or t
  modified_base (363)..(363): a, c, t, g, unknown or other
  misc_feature (363)..(363): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtagganacagagtcaccatcacttgccgggccagtcagagtattagtagctggttggcctggtatcagcaagaaaccagggaaacgccccgtaggttcctgatctataaggcatctaattagaaagtgggtacctattaaggtcagcgcagtgatcnggacagtagttacnctacacatcagcacgctgcagcctagatgtatttgactaattatactcgacaanatatntattcgtgcgtgtcgttcgacaggacaacgtagaactacgaaacgaactagtacggctagacactactcgtagtcttacacttcccg

SEQ ID NO: 93217 - DNA, 587 bp, Homo sapiens
  misc_feature: GYAE6OF02GAK7F.43.55.E11.1.454.CMB.1.raw
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (298)..(298): a, c, t, g, unknown or other
  misc_feature (298)..(298): n is a, c, g, or t
  modified_base (344)..(344): a, c, t, g, unknown or other
  misc_feature (344)..(344): n is a, c, g, or t
  modified_base (354)..(354): a, c, t, g, unknown or other
  misc_feature (354)..(354): n is a, c, g, or t
tcagtgtgagtagtcacgaccggtgctcgatttagcactcgcacgttggggtttgggggggagtcagacccagtcaggacacagcatggacatgagggtccccgctcagctcctggggctcctgctgctctggctcccaggtgccaaaatgtgacatccagatgacccagtctccttccaccctgtctggatctgtaggagacagagtcaccatcacttgccgggcagtcagagtattagagctggtggcctggtatcagcagaaaccagggaaacncccctaggttccngatctaanaagctatactaatttaagaaagtcgggtaccagttaagtcagcggnagtggatcgngggacagtattactctaccaaccgatccgatcgacgcctgaccacgacctagatggtaattttgacttaaatttacttaactacgtacctaaacgtaataagtagtaatttcgtagggccgttaggaccggtttacgaccgtaaaggaacctaaacggtagaaactacgaaacgtaactacggtaggactaggacctaaccgtactacttacggtaccttactactttccccg

SEQ ID NO: 93218 - DNA, 887 bp, Homo sapiens
  misc_feature: GYAE6OF02FEXJ5.43.55.E11.1.454.CMB.1.raw
tcagtgtgagtagtcacgaccggtgctcgatttagcactcgcacgttgggtttgggggagtcagacccagtcaggacacagcatggacatgagggtccccgctcagctcctgggctcctgctgctctggctcccaggtgccaaatgtgacatccagatcgacccagtcctccttccacctgtctggatctagtaggagacagacgtcacctatcacgttcggcccgggactaggtcaagtacgttaagttagtacgtcgttcgggttcggccttgggttaactcgaacgtaaccgaaacggtaaaacccggaacggggtaaaaccgtcccccgtttaagggttacccttaggtaacttaaccgttaagttaaacggtctaaacgtttaacgtttaaaagttttaacgggaaaacgggtttccgggggttaacccctaaggtttaaacggttacgacgggtaccggtacgtagggttacggtacgttaccggtaacggggaacgttaacggttacgtttaccctacgttaccaacccgtagtaccgacgtccgtaacgtccgtacggctaacggtccgttagtacgtttacgttaacgtttacgaaaccttttaaccgtttaacgttaccgtaaccgtaaacctaaacgtttaaacgttacggtttaacgttaaccggttaccgggtttaccggggtacccggtttaacgggtaacccgggtttaacccgggaacccggtaaaaccggggtaacccgtaaacggttaaacggtaaccgtaaacccggaaacgggttaaaccggtcgggtaaccggtacccgttacggtaacccgttaccgttacgttacccgttacgtttacccgttaccttacccgtttaacccccg

SEQ ID NO: 93219 - DNA, 544 bp, Homo sapiens
  misc_feature: GYAE6OF02GS6L5.43.55.E11.1.454.CMB.1.raw
  modified_base (339)..(339): a, c, t, g, unknown or other
  misc_feature (339)..(339): n is a, c, g, or t
tcagtgtgagtagtcacgaccggtgctcgatttagcactcgcacggttggggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccggccagtcagagtatagagctggtggcctggtatcagcaagaaaccagggaaagcccctaggttcctgatactataaggcatctaatttagaagtggggtccagttaaggttcagcgnagtggatcgtgggacagtagtttactcgtcacctatcagcagcctgcagcctgatgtatttcgactaatttattactcgacctaaactatatgtaattcgttggccgttggtaccgttcgaccgtaagggacctaaggtagaactacgaaacgtacgtaggtacggtactcgacctacgtattcgtacgtcttacctattccccg

SEQ ID NO: 93220 - DNA, 657 bp, Homo sapiens
  misc_feature: GYAE6OF02JKBCH.43.55.E11.1.454.CMB.1.raw
  modified_base (184)..(184): a, c, t, g, unknown or other
  misc_feature (184)..(184): n is a, c, g, or t
  modified_base (198)..(198): a, c, t, g, unknown or other
  misc_feature (198)..(198): n is a, c, g, or t
  modified_base (276)..(276): a, c, t, g, unknown or other
  misc_feature (276)..(276): n is a, c, g, or t
  modified_base (372)..(372): a, c, t, g, unknown or other
  misc_feature (372)..(372): n is a, c, g, or t
tcagtgtgagtagtcacgaccggtgctcgatttagcactcgcacgttgggtttggggggaggtcagacccagtcaggacacagcatggacatgagggtccccgctcagctcctgggctcctgctgctctggctcccaggtgccaaatggtgacatccagatgacccagtctcccttccaccctntctgatctgtaganacagagtcacatcacttgccggccagtcagagtattagtagctggttggccgtggtatcacgcagaaaccagggaacncccgttaggtcctgatctataaggcaatactaatttagaaaggtgggtacctattaaggtctagcggagagtgatcgtagggacgagtagtttacnctacaccgtactcgaacgcgtactccgtacgactacgtccgtagtagtagttacgtttacgacgttacctttaagtacgttacctaacctaaactaataagttcgtaagtttaccgttcggtaccggttacgggttaccgttacccgggttaccgtaaaacgggtaacccgttaacgggtacggttaaactaccggtaaacgtaacggttaacggttagggaccgttaacgtaccggaccttacggttaccgttccggtttacccttaccgttaacgtttccccg

SEQ ID NO: 93221 - DNA, 650 bp, Homo sapiens
  misc_feature: GYAE6OF02HKUXU.43.55.E11.1.454.CMB.1.raw
  modified_base (199)..(199): a, c, t, g, unknown or other
  misc_feature (199)..(199): n is a, c, g, or t
  modified_base (415)..(415): a, c, t, g, unknown or other
  misc_feature (415)..(415): n is a, c, g, or t
tcagtgtgagtagtcacgaccggtgctcgatttagcactcgcacgttggggtttggggggagtcagacccagtcaggacacagcatggacatgagggtccccgctcagctcctggggctcctgctgctctggctcccaggtgccaaatgtgacatccagatgacccagtctccttccaccctgtctggatctgtagganacagagtcaccatcacttgccgggcagtcagagtattagtagctggttggcctggtatcagcagaaaccgagggaaacgccccgtaggttcctgactctataaggcatacttaatttaggaaaggttcggggtaccctaagttaacgggttcaggtccggacgaggtgggtatcgtagggactaggtagtttactctaccacaactcgagcggacncctagccgagtccgtgattgttatttcgactaactttattacgtgaacccaataagtattgtaactttcgttacgggtaccggttgggtaccggtttcccggaaaccggtaacggggaaccctaacgggttaaggaaaccgttaacgaaacccggttaaacggttgggaacggttaccgttacgaacccgttacctacgttccgttacgtttacccttacgtaccgtttaccccg

SEQ ID NO: 93222 - DNA, 820 bp, Homo sapiens
  misc_feature: GYAE6OF02IVOAO.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctgggctcctgctgctctggctcccaggtgccaaatgtgacatccagatgacccagtctccttccaccctgtctggatctgtaggagacagagtcaccatcacttgccgggcagtcagagtattagagctggttagcctggtatcgagcaagaaaccgaagggaaacgtccccgtaggttcctgacttactagtaacggctatactaagttaagtaaacggttcggggtacctaagtttaacggttcgtaagcggtacaggtaggactcgtagggactaggtacgtttactacgtacacctagtacgacgacgtaacgccgttaggaccgtacggtacccgtaggttaacgttacgggttaacgtttttaccggaacgtttaaaacccgttttaacgtttaacccgttaacggtaaccccttaaaaaccgtttaaacgtaacgtttaacgggttaaaccttttcggttttaaccgggggttacccggtttaacggggttaccgggtttttaaccccggggaacccgggttaaaaccggggtaaaccccgggtttaaaaccggggttaacgggtaaaaccgttaaacccggttaaaacccgggttaaacgttacggggtttaaccggtacccgttaacggtaaccccgttaaccggtaacccggtttccgttaaaccggttttcccgttaaccgttaccgttttacccccg

SEQ ID NO: 93223 - DNA, 602 bp, Homo sapiens
  misc_feature: GYAE6OF02IZMY9.43.55.E11.1.454.CMB.1.raw
  modified_base (334)..(334): a, c, t, g, unknown or other
  misc_feature (334)..(334): n is a, c, g, or t
  modified_base (398)..(398): a, c, t, g, unknown or other
  misc_feature (398)..(398): n is a, c, g, or t
tcagtgtgagtagtcacgaccggtgctcgatttagcactcgcacgttgggtttgggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccggccagtcagagtattagtagctggttgcctggtatcagacaagaaaccgagggaaacgccctaggtcctgatctataagcatactaattagaagtgggtacctagttaaggtnaggtcgacaggtagatcgtgggaactagtagtttactctccaacctatcacgcacgtcctgacncgtcctgtattgtatttcgacttaaactttattaccgtcgacctaaactaattattagtacttacgttcggtacggttacgggtaccggttacggaccggaaacgggtaccgtaacgttacggaactacggtaaacgtacggtacggtacggtacctcgtacctaccgtacttccttacggttaccttacgtacctttaccccg

SEQ ID NO: 93224 - DNA, 583 bp, Homo sapiens
  misc_feature: GYAE6OF02JFHQI.43.55.E11.1.454.CMB.1.raw
  modified_base (198)..(198): a, c, t, g, unknown or other
  misc_feature (198)..(198): n is a, c, g, or t
  modified_base (243)..(243): a, c, t, g, unknown or other
  misc_feature (243)..(243): n is a, c, g, or t
  modified_base (421)..(421): a, c, t, g, unknown or other
  misc_feature (421)..(421): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (568)..(568): a, c, t, g, unknown or other
  misc_feature (568)..(568): n is a, c, g, or t
tcagtgtgagtagtcacgaccggtgctcgatttagcactcgcacgttgggtttggggggagtcagacccagtcaggacacagcatggacatgagggtccccgctcagcctcctggggctcctgctgctctggctcccaggtgccaaatgtgacatccagatgacccagtctccttccaccctgtctggatctgtaggngacagacgtcaccatcacgttgccgggccagtcagagtattaggngctggttgcctggtactctagcagaaaccagggaaacgcccctagtccgtgatctagtaacggcatacttaaagttagaaaggtcggggtacctagttaaggtcaaggtcgcagtgatcgtaggacagtagttactcgtacaaccgatcagctagcctcgcagctagtatgtagtttnacttagttatactgaccaaacgtanagttntactttcgtacgggtaccgttggtaccggtttaccggaacgaacggtaccgaaggttaacggactacggaaacgtaacgttagccggtacgactaccgtaccacgttactccgtttntaccctagttacccc

SEQ ID NO: 93225 - DNA, 596 bp, Homo sapiens
  misc_feature: GYAE6OF02FR1Q0.43.55.E11.1.454.CMB.1.raw
tcagtgtgagtagtcacgaccggtgctcgatttagcactcgcacgttgggtttgggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaacgcccctaggtcctgactctataaggcatactaatttagaaagtgggtaccctattaaggttcagcggcagtggatcgtgggacagtagtttactctaccacctatccagcacgccgtgccagcctagatgtattttcgacttaactttataactctaccaaactaatatacgtattacgtggtccggttcggtaccggtttcggacccgtaaacggtaaccgtaacggtaagtaaacgtaccgtaaacggtaaccgtacggtacggtccgtacggacccaaccgtacttccgttaccgtctttacctaccgttaccccg

SEQ ID NO: 93226 - DNA, 672 bp, Homo sapiens
  misc_feature: GYAE6OF02IVZLZ.43.55.E11.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (365)..(365): a, c, t, g, unknown or other
  misc_feature (365)..(365): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtcctccttccaccctgtctggatctggtagganacagngtccacatcactgccgggccagtcagatattagtagcgtggttggcctggtatcagcaagaaaccgagggaacgccccttaggttcctagacttcgtagtaacggctaatactaaagtttagaaaggttcggggtaccctaagttaaggtcaggcggtanaggtggagttcgagggactaggttacgtttactctacctaccatccgagactacgtccctggacctacgtccgtgtaattacgttaacgttttagacccttaaacttttacgttaaccgtacgtaacccaaactaattacgtgttactttcggttacggtccggttacggtaccggttaccggaccgtaaacgggaaccgtaacggtaggtaaactaaccggtaaaaccggtacggttacggtacgggtactaccggtacctaacccgttagttaccgttacgtttacctttaccactttacccccg

SEQ ID NO: 93227 - DNA, 668 bp, Homo sapiens
  misc_feature: GYAE6OF02IJNTK.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtcctccttccaccctgtctggatctgtaggagacagagtcaccatcacttggccggcagtcagtagtattagtagcgtggttcggctggtatcgagcaagaaaccgaagggaaacgtccccgtaggttcctgatctaagtaaggctatacttaagtttaaggaagtcggggtacctaagttaaggttcaggcggtacgtagtaggactacgtagggactaggttaacgtttacctacgtaccaacctacgtacacgctacgtctacgccgacggtcctaggtacttgttacttttcgacttaaactttacttaacctcgtaaacctaaactaatattacgtaacgttttcgtacgggtcccgttagggtaacccgtttacggaacccgggtaaacgggaacccgtaaaggttacgtaaacgtaaccgtaaaccggtaacgttaggtacggtactaccggacccgtaactacttcgttacgtttaccttacaccgtttcccc

SEQ ID NO: 93228 - DNA, 668 bp, Homo sapiens
  misc_feature: GYAE6OF02GC4F7.43.55.E11.1.454.CMB.1.raw
  modified_base (141)..(141): a, c, t, g, unknown or other
  misc_feature (141)..(141): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtnaccaaatgtagacatccagactgaccctagtcctccttccaccctgtctggactctgtaggagacagagtccaccatcacgttcggccgggcagtcagtagtattagtgcgtggttggcctggtactcgagcaagaaacccagggaaaccgccccttaggttcctagatactataaggctatactaagtttaagaaggttcgggtaaccctagtttaacggtcaggcggtacaggtggatcgtagggaactaggttacgttactctacacctactacacggacacgccgtcgacgtacgtccgtaggacttgttacttttacggacttaacgtttaacttaccgttccgaaccctaaataaagttacttagttaacgttggttaccggtccggttacgggtacggtttacccggacgaaacgggtaccgtaaaggtcggtaaactacgaaaacggtacgttacggtaccggtctaccggacctaccgtacgttaccgttacttacctttacgacccgtttaaccccg

SEQ ID NO: 93229 - DNA, 570 bp, Homo sapiens
  misc_feature: GYAE6OF02FORZ6.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaagtgggtcccattaagtcagcgcagtggatctgggatagtagtttactctcaccatcagcagcctgcagcctgatgtattttcgactaacttattactgaccaacatatgtattcgttggtccgtggtaccgtttccggaccgtaaacgggtacctaacggtacggtaaactaccgaaaacggtaacgtacggtacggtaccgttacgaccgaccctagttacccgttacggtttacctttacctacgtttaccccg

SEQ ID NO: 93230 - DNA, 689 bp, Homo sapiens
  misc_feature: GYAE6OF02H1Z1V.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatcgtgtaggagacgagacgtcaccatcacgttgccgggcagtcagtagtattagtagcgtggttcggctggtatcgagacgaagaaaccgaaggggaacgtccccgtaggttctcgtatctaagtaagctatactaagtttagaaacggttcggggtacctaagttaacggttcaggtacggacgagggttagagtcggtacggaacgtaagtaacgtttactcgtaccaaccgtataccgacgtactacgccgtagacctacgccgtagtatacgttacgtttactacgttaaacttactttaaccgagtaaccctaaacgttaataacgttgttaaccgtttcgttcggggtccgtttaacgggtacccgtttacgggaacccggtaaacggaacccgttaacggtaacggtaacctaacgtaaacccggtaattcggggtactaacgttaccgaccgtacgtacgttccgttactttaccgtaccgtactttcccccg

SEQ ID NO: 93231 - DNA, 586 bp, Homo sapiens
  misc_feature: GYAE6OF02IC4HU.43.55.E11.1.454.CMB.1.raw
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (289)..(289): a, c, t, g, unknown or other
  misc_feature (289)..(289): n is a, c, g, or t
  modified_base (367)..(367): a, c, t, g, unknown or other
  misc_feature (367)..(367): n is a, c, g, or t
tcagtgtgagtagtcacgaccggtgctcgatttagcactcgcacgttgggtttgggggagtcagacccagtcaggacacagcatggacatgaggtccccgctcagctcctggggctcctgctgctctggctcccaggtgccaaatgtgacagttccaagactgacccagtcctccttccacctgtactggatctgtagganacagatcaccatcacttgccggcagtcagngtattagagctggttggcctggtatcagcaagaaacgaggaaactcccctaggttccngatactataaggcatactaatttagaagtcgggacctaagttagtcaagcgcaggtgatcgtagggacagagtttacnctcaccatcagcagtccctgcctagcccttagattcgtaattttgaccttaaacgtttacgtttaacacgtacccaaagtaaactattacgtaacttcgttcggaccgttggtaccgttccggaacctaaacgggaacctaacgtacggaaataccgaaacgtaaactacggtcggactcgaaccgactaactccgtagtttacctacgtattaccccg

SEQ ID NO: 93232 - DNA, 697 bp, Homo sapiens
  misc_feature: GYAE6OF02FTIN0.43.55.E11.1.454.CMB.1.raw
tcagtgtgagtagtcacgaccggtgctcgatttagcactcgcacgttgggtttgggggggagtcagacccagtcaggacacagcatggacatgagggtccccgctcagctcctggggctcctgctgctctggctccgaggtgccaaatgtgacatccagatagacccagtcctccttccaccctgtcctggactctggtaaggagacgagagtcaccatccacttcgccggacagtcagagttatagtagcgttaggttcggccgtggttatcgacgtacaacggaaaacgagggaaacgtcccccttaagggttccctggtactacgtaagtaacggctacgtacttaaagtttaggaaaggttcgggtaccctagttaaggttcaggtcggataggtggtactgtacgggactagtagttactctaccactatcgacgtcacgtcctgaccgtacgtccgtagtattacggttaacgtttcggtaaccttaaacctttacgttaccgtataaccccgtaaaagtacttaagttacgtacttttacggtcgggtaccggttacgggtaccggttttaccgggacccgggtaaacgggaacccgtaacggtaacggaacttaccggaaaacggtaccgtaggtaccggctacgtaccaccgttcgttaccgtcgttaccttaccgtacctttacccg

SEQ ID NO: 93233 - DNA, 576 bp, Homo sapiens
  misc_feature: GYAE6OF02FYNE0.43.55.E11.1.454.CMB.1.raw
  modified_base (103)..(103): a, c, t, g, unknown or other
  misc_feature (103)..(103): n is a, c, g, or t
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (407)..(407): a, c, t, g, unknown or other
  misc_feature (407)..(407): n is a, c, g, or t
  modified_base (414)..(414): a, c, t, g, unknown or other
  misc_feature (414)..(414): n is a, c, g, or t
  modified_base (457)..(457): a, c, t, g, unknown or other
  misc_feature (457)..(457): n is a, c, g, or t
  modified_base (567)..(567): a, c, t, g, unknown or other
  misc_feature (567)..(567): n is a, c, g, or t
tcagtgtgagtagtcacgaccggtgctcgatttagcactcgcacgttgggtttggggggagtcagacccagtcaggacacagcatggacatgagggtccccgntcagctcctggggctcctgctgctctggctcccaggtgccaaatgtgacatccagatgacccagtctccttccaccctgtctggatctgtagagacagntcaccntcacttgccggcagtcagagtattagagctggtgcctggtatcgagcaacgaaaccaggggaaacctccccgtaggttcctaggactacgtagtaaggctaatacttaaagtttacggaaacggttcggggttaaccctaagttttaaacggtcgaaggcggtacgtagtggaacttcgtagggactagtacgtttacnctacacntcgagcacgctgacacgctgatgtatttcgacttaattactanacactaactaatcgtattacgttgtcggtcgtacggtcgttacgacaaacggtacgaagtacggaactacgtaaacgacgtgtacgctcgacactatccgtatccttacncgttacccg

SEQ ID NO: 93234 - DNA, 753 bp, Homo sapiens
  misc_feature: GYAE6OF02HAP13.43.55.E11.1.454.CMB.1.raw
  modified_base (140)..(140): a, c, t, g, unknown or other
  misc_feature (140)..(140): n is a, c, g, or t
  modified_base (468)..(468): a, c, t, g, unknown or other
  misc_feature (468)..(468): n is a, c, g, or t
tcagtgtgagtagtcacgaccggtgctcgatttagcactcgcacgttgggtttgggggagtcagacccagtcaggacacagcatggacatgagggtccccgctcagctcctggggctcctgctgctctggctcccaggtnccaaatgtgacatccagatcgacccagtcctccttccaccctgtctggtactcgtggtaggagacagagtccaaccatacctacgttcggcccggcagtcgagtacgttagttagaggtcgtagggtttcggccgtaggtactcgagtacgaaacgaaacccgagggaaaccgtccccgttaggttcctaggacttaacgtagtaacgggtacacgttaactttaaagttaagggtaaacgggttccgggtaacccttaagtttaaacgggttcgaacgggtcggacgaggttgtaacgtcggtaggaacgtacggttaagtttaccnccgtaactactacgtacgacacgacgtccctagtaccgtacgtcgtagtagttacgttagtttaacaaccgtttaacgttacttacgtaaccgtaacctaaacgtactacgttagttaccgtttacgggttccggtacggttaccgggtaccggttacgggtacccgggaaacggtaaacccgtacgggttaaacgaaccgttaaccggaacgtaacggtcgtacggtaccggttacaccgtaccttacggttccttaccggtttctaccttacgttacccccgg

SEQ ID NO: 93235 - DNA, 641 bp, Homo sapiens
  misc_feature: GYAE6OF02FZQI9.43.55.E11.1.454.CMB.1.raw
  modified_base (282)..(282): a, c, t, g, unknown or other
  misc_feature (282)..(282): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgcccgggccagtcagagttattagtagctggttcggcctggtatcgagcaagaaaccagggaaacncccctaggtcctgatctagtaggcatactaattagaaggttcgggtacctagttaacggtcaagtcggactaggtggactcgtagggactagtacgttacctcgtaccaaccatacgagcacgtcctgcagtcctagtatacgttatttcgacttaaacgtttacttacgtacgtaaccaaacgtattaacgtgtaactttcgtacgggtcccgttagggtccgttaccgggaaccgtaaacgggtaccctaacgggttacgtaaactaccggtaaaaccggtattacggggtacgaacccttagacccttaaccggtatttcccggttacgtttaccttacctaccgtttacccccgg

SEQ ID NO: 93236 - DNA, 769 bp, Homo sapiens
  misc_feature: GYAE6OF02IM1SB.43.55.E11.1.454.CMB.1.raw
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatcgacccagtcctccttccaccctgtctggactctgtaggagacagagtcaccatcactcgccggccagtcagagtatagagctggttgcctaggtactcagacaacgaaaccagggaaaacgtccccgtaaggtttcccaggtaacttacgttaagtaagggtactaattacctttaaacggttttaagaaaaggggttccgggggttacccctaaggtttaacggttaccaaggtccgggtactagggttacggaattccgtaggggaactaacggttaacggttttaacctacgtacctaaacccgtaattaccgaaagtacctaacggcccgttagacgacggtacccttaggtaattagtaacgtttttacggaacctttaaaacgtttactttaaccgacgtaaacccaaattaacgtaacgttgttaaccgttttaccggttacgggtaccccgttaacggggtaccggtttacccggggaaaccgaaacggggttaaccaaacgggttaggaaaacttaccggaaaaccggtaacgttaggtaccggtaacttacggaaccctacgtactttaccgttggtaccttttacacgttttccccg

SEQ ID NO: 93237 - DNA, 607 bp, Homo sapiens
  misc_feature: GYAE6OF02HCTD0.43.55.E11.1.454.CMB.1.raw
  modified_base (103)..(103): a, c, t, g, unknown or other
  misc_feature (103)..(103): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
  modified_base (547)..(547): a, c, t, g, unknown or other
  misc_feature (547)..(547): n is a, c, g, or t
  modified_base (571)..(571): a, c, t, g, unknown or other
  misc_feature (571)..(571): n is a, c, g, or t
  modified_base (598)..(598): a, c, t, g, unknown or other
  misc_feature (598)..(598): n is a, c, g, or t
tcagtgtgagtagtcacgaccggtgctcgatttagcactcgcacgttggggtttggggggagtcagacccagtcaggacacagcatggacatgagggtccccntcagctcctggggctcctgctgctcgtggctcccaggtcgaccaaatgtgacatccgagatcgacccagtcctcccttccaccctgtctggactcgtagtaggagacatacgtcaaccatctacgttcggcccgggcctagtcagagttagttagtagcgtgggttcggccgtggtatcgagcaagaaaccgagggaaactccccgtaggttcagactctaagtaggctattactaagttagaacggtcggtacctagttaggtcagcggacnggngtatcgtaggacaggttacgttacnctaccgaacngtacgagcacgtcctggacacggtctagtattgttattacgtacttaacgttatacctacgaaccaaatagttagtcgttacttcggtaccggtcggtacgaccgttcggaaccggaacgtaacgaacggtanaccgtaataccggtaatggtacgntaccgactactcgttactcgtacttcnccttacccg

SEQ ID NO: 93238 - DNA, 816 bp, Homo sapiens
  misc_feature: GYAE6OF02GB4AM.43.55.E11.1.454.CMB.1.raw
  modified_base (106)..(106): a, c, t, g, unknown or other
  misc_feature (106)..(106): n is a, c, g, or t
  modified_base (133)..(133): a, c, t, g, unknown or other
  misc_feature (133)..(133): n is a, c, g, or t
  modified_base (430)..(430): a, c, t, g, unknown or other
  misc_feature (430)..(430): n is a, c, g, or t
  modified_base (592)..(592): a, c, t, g, unknown or other
  misc_feature (592)..(592): n is a, c, g, or t
tcagtgtgagtagtcacgaccggtgctcgatttagcactcgcacgttggggtttggggggagtcagacccagtcaggacacagcagtggacatgacgggtccccgntcagctccgtgggctcctgcctgcctntcggcctcccgaggtcgaccaaatgtacgacacttccgaagactaccgaacccgtagttccttccctttacccacccgttgtcctaggtcttcgtagggtaaggacgtaaccgaggtactccaacctacttccgtacgttccgggcccggtacccgtaagtcgaaggttacgttaagtttacgtacggttccgttcgggttacggccgttgggtaactacgtacggtaacccgtaaacggaaacccggaagggtaacccgtcccggttaagtccgaggtactacgtaagtaacggtnttacgttagttaaagttaaggaacggttcggtacctaaagtttacggagccggtacgtaggtagttacggtgtcggttaacggacgtaagtttacgttacctaccgtacgaaccctagtaccgtacggacgtcgtcgtacgcgtaaccggtcttaacgggtnttacggttaacttacgtaccgttaacgttacgtactacctaacgtaaacttagttatacgtttacgtaggttccggtaccggtaggtacccgttaccgggaaaccgttaaaccggaccgttaaacggtacggtaaccgtaaactaccgggtaacttacgggtccgtaagtaccggaacctacgttaaccttgggttaccttccgttaccgttaccccgttccgg

SEQ ID NO: 93239 - DNA, 551 bp, Homo sapiens
  misc_feature: GYAE6OF02GLNUO.43.55.E11.1.454.CMB.1.raw
  modified_base (103)..(103): a, c, t, g, unknown or other
  misc_feature (103)..(103): n is a, c, g, or t
  modified_base (197)..(197): a, c, t, g, unknown or other
  misc_feature (197)..(197): n is a, c, g, or t
  modified_base (356)..(356): a, c, t, g, unknown or other
  misc_feature (356)..(356): n is a, c, g, or t
  modified_base (377)..(377): a, c, t, g, unknown or other
  misc_feature (377)..(377): n is a, c, g, or t
  modified_base (415)..(415): a, c, t, g, unknown or other
  misc_feature (415)..(415): n is a, c, g, or t
  modified_base (534)..(534): a, c, t, g, unknown or other
  misc_feature (534)..(534): n is a, c, g, or t
tcagtgtgagtagtcacgaccggtgctcgatttagcactcgcacgttgggtttggggggagtcagacccagtcaggacacagcatggacatgagggtccccgntcagctcctggggctcctgctgctctggctcccaggtgccaaatgtgacatccagatgacccagtctccttccaccctgtctggatctgagganacagagtcaccatcacttgccgggcagtcagagtattagtagctggtggcctggtatcagcagaaaccaggaacgcccctaggtcctgatctataaggcatactaattagaaagtgggtacctattagtcagcgcagtggatcgtaggacagtattacnctacacatcagcagcctgacngcctgactgtatttgactaattatactgaccaataatntagtacttcgttacggcggttaggtaccgtttacgggaccgtaaacggggtaacctaacgtacggaaactaccgaaacggtaacgttagtacgggtactcggacacccgtattaccgtntaccttactcttacccg

SEQ ID NO: 93240 - DNA, 877 bp, Homo sapiens
  misc_feature: GYAE6OF02H6RVX.43.55.E11.1.454.CMB.1.raw
tcagtgtgagtagtcacgaccggtgctcgatttagcactcgcacgttgggtttgggggagtcagacccagtcaggacacagcatggacatgagggtccccgctcagctcctggggctcctgctgctctcggacctcccagggtcgacccaaaagttcgtacgaaccatacccaggaatcggaccccagttccctcccttcccgtaaccccttgtccttagggacttcctaggtaacgggagaaccgaggacgtccacctaacttccgtacgtcggacccgggacctaaggtcaagtagttattaggtacgtcgttggttcggcgttaggtatcgacgacgtaacgaaaccggtaacggggaaccgtaccccgttaacggttcctacggtaacttacggttaaacgaacgggtccttaaacgtttacgttaaaggttttaaacggggtaaaaccgggttcccgggggtaaaccctttaacgggtttaaacggggttacccggaagggtacccgggtacggtaacggggtttagggacgtttacccggggtaaggggtaacccgttaggttaaaccggttttaccctacgttaaccgaaccctacgtaccgtacggtacccgtaacggtcccgttcgggtaaccgtacggtcgttaactggtttacgtttattttaccggtaacttaacgtttacgttaacgtcgaaattaacctaagttacgttcgttaagttttcccggcggggttacccgttacggtaacggggttccgaacccggtaaaggtaacccgtacgggtaaacgaacgtaccgaacgtacgttcgggtacggtacctcggaaccgtcttacggactttcgtacctttcgacccgttccc

SEQ ID NO: 93241 - DNA, 781 bp, Homo sapiens
  misc_feature: GYAE6OF02GF7SS.43.55.E11.1.454.CMB.1.raw
tcagtgtgagtagtcacgaccggtgctcgatttagcactcgcacgttgggtttgggggagtcagacccagtcaggacacagcatggacatgagggtccccgctcagctcctgggctcctgctgctctggctcccaggtcgacaaatgtgacatccagactcgacccagtccttcccttccacccgtgtctaggactcgtaggtaggagaacaggacgtaccaacctatcctacgttcgggcccgggacctacggtcaggagtttaacttaggtaacggtcgttgggttcggaccgtggtacgcgaacgtacgaaacgaaaaccggaacgggaaaccgtaccccccgttaggttccgtataacgtaccgttaaagtaaccggactaacgtttaaccgtttaaaaggttttaaccgggaaaagggtttcccggggtaacccgtttaaacgtttaacggttacgacgggtaccggaaccgtaagggttaggtaacgtacgggtaacgggaacgtaacggtaacgtttacctactacccaacgttacgtaccgagtccgtaccgtcgtcgaccgacgtccgaaggtcgttacggtttaattacgttactaacgtttactacgtaccgaactaactacttagtacgttgttcggttacggtacggttaccgggaccggttttaacgaccggtaaacggtaacgtaacgtaacgaacgtaaccgtaacggaccgttgtaacgtccgagtaccgtactgttacgtcccttacgttcctaccttccccg

SEQ ID NO: 93242 - DNA, 724 bp, Homo sapiens
  misc_feature: GYAE6OF02I46NG.43.55.E11.1.454.CMB.1.raw
  modified_base (691)..(691): a, c, t, g, unknown or other
  misc_feature (691)..(691): n is a, c, g, or t
tcagtgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacactaccagatcgaccctagtctccttccaccctgtctggatctggtaggagacgagacgtcacactacacgttcggccgggacctagtaccgaagtacggtaattacggtagtccgttggtttcgccgttaggtactcgagacaacgaaaccgtagggaaaccgtccccgttacggttcctacgacttacgtaagtaacggctaacttacgttaaagtttaaggtaaaacgggttcgggttaacccgttaagtttaaacggggttacgacgggtaccgtacgtaggggttacggtaacgttccggtaacgggtacgtaaggttaacgtttacgtaccgtacctactacgtactacgacgtaccgacccgtacggtactaccggacgttcgtaggtttacgttaacgtttacggtaacctttaagtttaactagtaccaaccgtattaagtatagtatttccgtacggtccgtacggtacgtaccgggtaaccgacggtaacgtaacgtacggactacgaaacgtcgtaggtaccgtacncgtacctcgattaccgtgtccttactcgtaccc

SEQ ID NO: 93243 - DNA, 565 bp, Homo sapiens
  misc_feature: GYAE6OF02FO2B8.43.55.E11.1.454.CMB.1.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
  modified_base (328)..(328): a, c, t, g, unknown or other
  misc_feature (328)..(328): n is a, c, g, or t
  modified_base (351)..(351): a, c, t, g, unknown or other
  misc_feature (351)..(351): n is a, c, g, or t
tcagtgtgagtagtcacgaccggtgctcgatttagcactcgcacgttgggtttgggggggagtcagacccagtcaggacacagcatggacatgagggtccccgctcagctcctggggctcctgctgctctggctcccaggtgccaaatgtgacatccagatgacccagtctcctccaccctgtctggatctgtagganacagagtcaccatcacttgccggccagtcagtagtatagtagctggtgcctggtatcagcagaacaggaacgcccgtagtctgatntataggcatctaattagaagtgggtaccagttaaggtcagcggnagtgatcgaggacagtacttacnctcactatacgagcacgcgtcgcacgcgtagtacgtagttatttcgacttaactttacttacctacgtaaccctaataactaagttcgtaacttcggtacgggtccgtacgggtcgttccggaaccgtacggaaccgtaggtacgtacgactaacggtacgtaggttcggcttacgacctaactgttacccgttggttacctctcgttaccccg

SEQ ID NO: 93244 - DNA, 722 bp, Homo sapiens
  misc_feature: GYAE6OF02G2IYQ.43.55.E11.1.454.CMB.1.raw
  modified_base (209)..(209): a, c, t, g, unknown or other
  misc_feature (209)..(209): n is a, c, g, or t
tcagtgtgagtagtcacgaccggtgctcgatttagcactcgcacggttgggtttgggggggagtcagacccagtcaggacacagcatggacatgagggtccccgctcagctcctggggctcctgctgctctggcctcccgaggtcgaccaaatgtagacatccagatgacccagtcctcccttccaccctgtctggactcttggagganacagagtcactatcaccgtcggcccgggactacgtacaaggtagttaagttacggtagtcggttggttcggtccgttaggtactacgacgacgaacggaaaaccggacgggaaaccgtccccgttaggttccgtagacttaccgtaagtacggactacgttattaaacgttaagtaaagggttccgggtaccttaagttacggtacgacgggaccggtagtacgggtaggaacttcggtagggtaactagttaacggtttacctcgttaccaacgttcgtacgacgtacgaccgtacgttcggaacgtccgtaccgtaggtaacttgttacgttaccgtaactttaaacttacgttaccgtaacgaacctaataagttagtattacgttacggttcggaccggttaggtccgttacggaccgtaacggaacgaaccggtaacgtaacgaacgtaaggtaaccgtgtaccgtacgtcgaccgtactacgttcgattccgtacgtaccctttccg

SEQ ID NO: 93245 - DNA, 696 bp, Homo sapiens
  misc_feature: GYAE6OF02J0JD3.43.55.E11.1.454.CMB.1.raw
  modified_base (646)..(646): a, c, t, g, unknown or other
  misc_feature (646)..(646): n is a, c, g, or t
tcagtgtgagtagtcacgaccggtgctcgatttagcactcgcacgttgggtttgggggagtcagacccagtcaggacacagcatggacatgagggtccccgctcagctcctgggctcctgctgctctggctcccaggtcgccaaatgtgacatccagatgaccctagtctccttccaccctgtctcggatccgtgtacggagacagacgtcacctatctacgttcgccggggtaccacgtcaggtagttattagtaacgtctcggttggtccgttggtaactctagacgtaacggaaaccgtaagggaaccgtccccgttaaggttcccgtagacttacgtaataacggtacctaagttaaccttaaaggttaaggtaaacgggttcgggtaacccttagttaaacggttacgtaggaccggactacggttggtatcggtaggtacgtaacgttacttacgtacgtacctacgtactacgttacgacgtacgacccgttacgacgtcgtaccgtgtaacctagttaacgttcgtaaccttaaacgtttactactacgaccgtaaagttactagtcttaagtcgtacgtcgtacgtcgttacgaccgtagaaccgttaatagtacgacgaacgtaagcggtaccggngtacccgtaccgacgttcgttacccgtatttccgttactaccttaccccg

SEQ ID NO: 93246 - DNA, 236 bp, Homo sapiens
  misc_feature: GYAE6OF01EQN0N.34.71.G05.1.454.CMB.1.raw
  modified_base (234)..(236): a, c, t, g, unknown or other
  misc_feature (234)..(236): n is a, c, g, or t
tcagtacacgtgatcacgaccggtgctcgatttagtgtcgtcgcaagagagagggggtgccaggggaagaccgatgggccctggtcaccgtctcctcagcctccaccaagggcccatcggtcttccccctggcaccctcctccaagagcacctctgggggcacagcggccctgggctgcctggtcaaggactacttccatcacgtgtactgagcgggctggcaaggcgcatagnnn

SEQ ID NO: 93247 - DNA, 483 bp, Homo sapiens
  misc_feature: GYAE6OF01D1DXR.34.71.G05.1.454.CMB.1.raw
  modified_base (441)..(441): a, c, t, g, unknown or other
  misc_feature (441)..(441): n is a, c, g, or t
  modified_base (477)..(477): a, c, t, g, unknown or other
  misc_feature (477)..(477): n is a, c, g, or t
tcagtacacgtgatcacgaccggtgctcgatttagtgtcgtcgcaagagagagggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggggataaatatgcttgctggtatcagcagaagccaggccagtcccctgtgctggtcatctatcaagatagcaagcggccctcagggactccctgagcgattctctggctccaactcgtgggaaacacagccactctgaccatcagccgggacccaggctatggatgagctagacttaattactgtcaggcgtgggacaggacaaccggngtgtagtgggcggaggacagctgacgtccgaggtcngacccg

SEQ ID NO: 93248 - DNA, 719 bp, Homo sapiens
  misc_feature: GYAE6OF01CVCNY.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgctattgggtgcgacaggcccctggacaagggcttgagtggatgggatggatcaacacaacacgtcgggaaacccaacgtatcgacccgaggggtccttacgacgtaaggggtaacggttttgttaccgtttccttcccgtttagggaaccctaccccgttcgttaggttccaacggtccaacgggtacctaatttaacttcgtacggtaccgaacggtaacttccgaaggaccgtaacggtaccccttaaaaggttccggggtaaccgttacgggtaaacgggaaccctaaaccggttcgggtaccccggtttaggttaacgtttaacgttcgggttacggaccgggtaaaggtaacggggttaccctttaaagtttaacccgttaaagtacggttaaagttaagggtaaaaggtttgggttttaaatttaagttcgggtttaaaccgg

SEQ ID NO: 93249 - DNA, 557 bp, Homo sapiens
  misc_feature: GYAE6OF01CPTS3.34.71.G05.1.454.CMB.1.raw
  modified_base (346)..(346): a, c, t, g, unknown or other
  misc_feature (346)..(346): n is a, c, g, or t
  modified_base (443)..(443): a, c, t, g, unknown or other
  misc_feature (443)..(443): n is a, c, g, or t
tcagtacacgtgatcacgaccggtgctcgatttagtgtcgtcgcaagagagagggggcgtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaagttgggggataaatatagcttgctggtatcagcagagccagccagtcccctgtgctggtcatctatcaagatagacaagccggccctcgacgggactcccgtagacgcatttcctntcggacctcaactcgtacgggaaccacagccactctacgaccatcgagccgggaccaggcctagcggatggacgcgtagtacctagttactgtacgnggcggtgggacaggacaaccggtaggtacggttacggttacgggaccgggtaacggggacccgaaacggtccgtaccgggaacccggttccgtaacgggtcgaccggaccccgg

SEQ ID NO: 93250 - DNA, 551 bp, Homo sapiens
  misc_feature: GYAE6OF01DRNVR.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacaggcccctggacaagggcttgagtggatgggatggatcaacacaacacgtaggaacccaagtatcgcccagggtcttcacgaggtacgtttgtcttctccgttggacctacctctgtcagcgacggcatactcgtgcagtatcacgcagacctaagtggactgacggtacacgtgcgttagtacgttacgtggtgcgaggtacggtattaactttacgtaagttggaacgtttaaggtaagggttaggttttaaattgtagttaacgg

SEQ ID NO: 93251 - DNA, 239 bp, Homo sapiens
  misc_feature: GYAE6OF01BDW5V.34.71.G05.1.454.CMB.1.raw
  modified_base (235)..(239): a, c, t, g, unknown or other
  misc_feature (235)..(239): n is a, c, g, or t
tcagtacacgtgatcacgaccggtgctcgatttagtgtcgtcgcaagagagagggggtgccagggggaagaccgatgggccctggtcaccgtctcctcagcctccaccaagggcccatcggtcttccccctggcaccctcctccaagagcacctctgggggcacagcggccctgggctgcctggtcaaggactacttccatcacgtgtactgagcgggctggcaaggcgcatagnnnnn

SEQ ID NO: 93252 - DNA, 503 bp, Homo sapiens
  misc_feature: GYAE6OF01A16WZ.34.71.G05.1.454.CMB.1.raw
  modified_base (470)..(470): a, c, t, g, unknown or other
  misc_feature (470)..(470): n is a, c, g, or t
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacaggcccctggacaagggcttgagtggatgggatggatcaacaccaacactgggaacccaacgtatgcccagggcttcacaggacgtttgtcttctccttggacacctctgtcagcacggcatactctgcagactcagcagcctaatcggctgacggacactgaccgtgtacttactgtgcgagaggtntagttctatgatagagttagttattagtgtacg

SEQ ID NO: 93253 - DNA, 495 bp, Homo sapiens
  misc_feature: GYAE6OF01EZFN5.34.71.G05.1.454.CMB.1.raw
  modified_base (456)..(456): a, c, t, g, unknown or other
  misc_feature (456)..(456): n is a, c, g, or t
tcagtacacgtgatcacgaccggtgctcgatttagtgtcgtcgcaagagagagggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggggataaatatgcttgctggtatcagcagaagccaggccagtcccctgtgctggtcatctatcaagattaataacgcggccctcgtgggactcccgtgagcggtattcgactggctccatcgtctcgggaacacacgccactctgaccatcacgccgggacccaggtcctagtacgagtgaggctgactattactgtcagacgtgggacagccaccgatgtcgntcgtcggcggacggacagctaggaccgtcgtggtacccg

SEQ ID NO: 93254 - DNA, 546 bp, Homo sapiens
  misc_feature: GYAE6OF01C0MUM.34.71.G05.1.454.CMB.1.raw
  modified_base (279)..(279): a, c, t, g, unknown or other
  misc_feature (279)..(279): n is a, c, g, or t
  modified_base (438)..(438): a, c, t, g, unknown or other
  misc_feature (438)..(438): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtncgacaggcccctggacaagggcttgagtggatgggatggatcgaaacaccaacactacggggaaccctaaacgtatcgcccgaggggcttcgaacgtaggtacggtttcgtctttcttccgttggactacctctgttcagccacggctatatctgcagntcagcagtcctaatcggactggagacacgtcgccgttattattactggtcgtacgagacggtattagttactagtagtattaggaagttgtttaattagtggttaacg

SEQ ID NO: 93255 - DNA, 236 bp, Homo sapiens; identical to SEQ ID NO: 93246
  misc_feature: GYAE6OF01DZCBL.34.71.G05.1.454.CMB.1.raw
  modified_base (234)..(236): a, c, t, g, unknown or other
  misc_feature (234)..(236): n is a, c, g, or t

SEQ ID NO: 93256 - DNA, 505 bp, Homo sapiens
  misc_feature: GYAE6OF01CL4MH.34.71.G05.1.454.CMB.1.raw
  modified_base (253)..(253): a, c, t, g, unknown or other
  misc_feature (253)..(253): n is a, c, g, or t
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
tcagtacacgtgatcacgaccggtgctcgatttagtgtcgtcgcaagagagaggggacccaacaaccacaccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttnactagctatgctatgcattgggtncganaggcccctggacaagggcttgagtggatgggatggatcaacaccaaacactcggggaaacccaagtaatcgacccagggcttcgacagggacgtttgtactttctcttggacaccgtctgtcagcaggcatatctgcagatcagcagcctaatggctggacgacacgtgaccgtgttatactgtgacgagaggctattcatgatagagttagttatgtgtaacg

SEQ ID NO: 93257 - DNA, 567 bp, Homo sapiens
  misc_feature: GYAE6OF01BAZLH.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgtgtgcgacacggcccctggacaagggcttgaggtggatgggatggatcaacacccaacacgtacgggaaacccaacgtatcgacccgagggtaccttccgaacgacgggtacggttttgtctttaccttccgttaggactaccttctcgtctagctacggctatactctgcagactcagcacgccgtaagtcggtctaggacgacacgtcgacgtgtattaccgtggtacgtcggagtacgggtacttattacgtagtacgtaattaggtaaggtttggtttaattgttacg

SEQ ID NO: 93258 - DNA, 500 bp, Homo sapiens
  misc_feature: GYAE6OF01AZ6JD.34.71.G05.1.454.CMB.1.raw
tcagtacacgtgatcacgaccggtgctcgatttagtgtcgtcgcaagagagagggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcgagggactcccgtgagcgattctctggctccaactcgtagggaacacagccactctgaccatcaggccgggacccaggcctagtcggatgaggctgactattactgtcaggcgtggacagcaaccgagtggtagttcgggcggacgggaccaagcgtacggacccgtacgacggtcacggacccg

SEQ ID NO: 93259 - DNA, 653 bp, Homo sapiens
  misc_feature: GYAE6OF01A3P95.34.71.G05.1.454.CMB.1.raw
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacacggcccctggacaagggcttgagtggatgggatggatcaacaccaacgacgtacggggaaacccaacggtactcggaccccgaggggtcctttacgaacgtaggggtaccgggttttgtcctttcgttcccgtttagggacctacccgttcttacggttaccgacggcctaacgggtcctaagttaacttccgttagaccgtaaggtacttcgaacggtacctaacggtacccttaaagtcgggtaccttaggaacggtacctacgttcggaccggttagttaacttacgtactaggaccggtaaggtacggtacttaattaacgttagtagtaagttaaggtaaggtttaggtttaattagtgttaacg

SEQ ID NO: 93260 - DNA, 499 bp, Homo sapiens
  misc_feature: GYAE6OF01ALR4U.34.71.G05.1.454.CMB.1.raw
  modified_base (410)..(410): a, c, t, g, unknown or other
  misc_feature (410)..(410): n is a, c, g, or t
  modified_base (467)..(467): a, c, t, g, unknown or other
  misc_feature (467)..(467): n is a, c, g, or t
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacaggcccctggacaagggcttgagtggatgggatggatcaacaccaacactgggaacccaacgtatgcccagggcttcgacaggacggtttgtcttctccttggacacctctgtcagcacggcatatcngcagatcagcagcctaatggctgaggacactgccgtgtattactgtcgcgagacggnttatctatgatagaagtggttaattgtgtacg

SEQ ID NO: 93261 - DNA, 541 bp, Homo sapiens
  misc_feature: GYAE6OF01EA1KX.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacacggcccctggacgaagggcttgaggtggatgggatggatacaacaccaacactacggggaacccaacgtatcggcccagggcttcacgacgggtacggtttgtcttcgtccttggacctacctctgtcagcacggcatatctgcagatcagcacgtcctaagtggactggacggactacgtgcgttagtattactgtcgacgaggtacggtacttattactatgagttaaggtaaggttagtttaattgtggtaacg

SEQ ID NO: 93262 - DNA, 546 bp, Homo sapiens
  misc_feature: GYAE6OF01DZXOF.34.71.G05.1.454.CMB.1.raw
  modified_base (360)..(360): a, c, t, g, unknown or other
  misc_feature (360)..(360): n is a, c, g, or t
  modified_base (392)..(392): a, c, t, g, unknown or other
  misc_feature (392)..(392): n is a, c, g, or t
  modified_base (414)..(414): a, c, t, g, unknown or other
  misc_feature (414)..(414): n is a, c, g, or t
  modified_base (435)..(435): a, c, t, g, unknown or other
  misc_feature (435)..(435): n is a, c, g, or t
  modified_base (454)..(454): a, c, t, g, unknown or other
  misc_feature (454)..(454): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagccgtggggcctcagtgaaggtttcctgcaagtccttctggatacaccttcactagctatgctatgctagttgggtgcgacgacggcccctggacgaaggggtcttggagtggatgggatggatacaacaccaacacgtacggaacccaagtancgacccgagggcttacgacgaggtacggtttntcttctccgttgacctaccgtntcgtcagcacggctatactcngcagatcagcagcctaagngactgagacacgtgaccgtgtacttcgtggtgcgaggtgtacttaagttactagtgaagttaggtaaggtttagtttaattagtggtaacgg

SEQ ID NO: 93263 - DNA, 666 bp, Homo sapiens
  misc_feature: GYAE6OF01B2N2L.34.71.G05.1.454.CMB.1.raw
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagagccgtgggcctgagtgaaggtttcctgcaagtccttctggatacaccttcactagctatgctatgctagttgggtgcgacgacggccccgtggacgaagggtctggagtggagtgggatggatacaacaccaacgacgtacgggaacccaacgtacgcgacccgagggtccttacgacggtaggtacggttttcgttcttccgttcccgttaggtaccctacccgttcgttcgtacacgtaccgaccggctatactcgtcgacgacgtactcgagaccgacgtaccgtaaaggtcgggacgtacgggaacggtaaccgtacgttccggtaccgttagttaactttccggtaggttcggaccggtaagggtaccggttactttaagtttaccgttaaggttaggttaacgttaaagggttaacggtttaaggtttttaacgtttaaggttacggttaaacggg

SEQ ID NO: 93264 - DNA, 544 bp, Homo sapiens
  misc_feature: GYAE6OF01BNR5O.34.71.G05.1.454.CMB.1.raw
tcagtacacgtgatcacgaccggtgctcgatttagtgtcgtcgcaagagagagggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaagttgggggataaatatgtttgctggtatcagcagaagccaggccagtcccctgtgatggtcatctatcaagtattataacgccggtaccctcgtgggactcccgtgacgcgtattcactcggcctcctatctacgtacgggaacctacgacgaccctactctacgaccctagtccgacggaccgggacccagggtacctaagtacgagtggacggtctagtacttaagttacgtgtacaggacgtaggacacgacacgtacgtgtcgcttcgtcgggcggacggaccagtcctacgacccgtcgtggtcgaccgg

SEQ ID NO: 93265 - DNA, 661 bp, Homo sapiens
  misc_feature: GYAE6OF01DT6PA.34.71.G05.1.454.CMB.1.raw
tcagtacacgtgatcacgaccggtgctcgatttagtgtcgtcgcaagagagagggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaagtggggaataaatatgcttgctggtatcagacagaagccaggccacgtccctgtcgcgtggtcatctatacaagatagacaacgccggccctacgacgggtactcccgtgacgacgtactttcctcgtcgggtcctaccctaactcggtacgggaaaccaccgacgacccacttaccgtacgaaccaagtccgaacgggcccggggtaacccgacggtacgtagtgggtaacgtgggacgggtctaggtaaccttaagtttacgtcgggtaccgagggtcgggtacgggaacgacggaccgaaacccgggttaggttacggggttaacggtttccgggggaccgggaaacggggaaccccgtaaagggtccccgttaccgggtaaccccgggttacccgttaacggggtcccgaaccgggtaaacccccggg

SEQ ID NO: 93266 - DNA, 622 bp, Homo sapiens
  misc_feature: GYAE6OF01B3U3U.34.71.G05.1.454.CMB.1.raw
  modified_base (215)..(215): a, c, t, g, unknown or other
  misc_feature (215)..(215): n is a, c, g, or t
  modified_base (229)..(229): a, c, t, g, unknown or other
  misc_feature (229)..(229): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccatcccaggtgcagctggtgcaatctgggtctgagttgaagagcctgggcctnagtgaaggtttccngcaagccttctggatacaccttcactagctatgctatgcagttggtgcgacacggccccgtggacaaggcttaggagtggatgggactggactacaacaccaacgacgtggaaaccctagtactcgacccgagggtccttacgacgtacggtacgtttcgtcctttcgtaccgttagacctaccgttcgtcgtacgtacgtcctacggctaagttactcgtacgctacggtactacgacgtcgaacgtccttaagtcggtactacggacgtactacgttcgtaccggttagttaacgttcgaggttacgacggtaacggtacggttacttaacgttaccgtagttacgtaacgttacggtaagttaggtttaacttaacggtggttaacccgg

SEQ ID NO: 93267 - DNA, 671 bp, Homo sapiens
  misc_feature: GYAE6OF01DFHZI.34.71.G05.1.454.CMB.1.raw
  modified_base (231)..(231): a, c, t, g, unknown or other
  misc_feature (231)..(231): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaggtttccngcagccttctggatacaccttcactagctatgctatgctattggtgcgacacggccccgtggacgaagggtcttaggagtggagtgggatggatacgaacaaccaacgacgtacgggaacccaaacggtactacggcccgtaagggtccttaccgaacgtaacgggtaccgggtttttagtccgtttaccttccgtttacgggacctacccgttcgtcggtaccaggacccaacggtcaagttactcgtacgcaacggtactcaacgggcctaacggtacccgttaaagtccgggtacttaacgggacggtaacctacggtcggtacccgttaggttaacttaccgttggtacggcggtaacggtacggtactttaacgtttaccgtaagttataaaggttagtaaaggtttgggttttaaattggttacgttaaacggg

SEQ ID NO: 93268 - DNA, 566 bp, Homo sapiens
  misc_feature: GYAE6OF01C1242.34.71.G05.1.454.CMB.1.raw
  modified_base (498)..(498): a, c, t, g, unknown or other
  misc_feature (498)..(498): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactccccaggtgcagctggtgcaatctgggtctgagttgaagaagcctggggcctcagtgaaggtttcctgcaagccttctggatacaccttcactagctatgctatgcagttgggtgcgacacggcccctggacaagggcttggagtggagtgggatggactacaacaccaacacgtacggaacccaacgtatcgacccgagggcttacgacgtacgggtacggttttgtctttcttccgttggactacctctgtcagcacggctatactctgcagactcagcacgtacctaagtggactggacggacacgtcgtaccgttagtacttacgtgnggagaggtcggtacttaattacgtaagtgtaagttaaggtaaggtttaggtttaattgttggtaacgg

SEQ ID NO: 93269 - DNA, 670 bp, Homo sapiens
  misc_feature: GYAE6OF01ALTYY.34.71.G05.1.454.CMB.1.raw
  modified_base (280)..(280): a, c, t, g, unknown or other
  misc_feature (280)..(280): n is a, c, g, or t
  modified_base (554)..(554): a, c, t, g, unknown or other
  misc_feature (554)..(554): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgccactcccaggtgcagctggtgcaatctgggtctgagttgaagaagcctggggcctcagtgaaggtttcctgcaagccttcgtggatacaccttcactagctatgctatgctattgggtncgacacggcccctggacaagggcttggagtggagtgggatggatcaaacgaccaacgaccgtaggaaacccagtacgtcgacccgtagggtccttacgaacgtacgggtaccggttttgtaccgtttccttaccggtttacgggaccttacccgttcgttcgtaccgacggtacctaaccgggactaacttactccgtagccaagtactacgacgcacgtacctaagtggactagggacgtacctacgtcggtaccgttagttaacgtttacgnggtttacggacggtaacgggtacggttacgtttaactttaacggtaagttacgggtaaagtttaaacgggttaaagggtttaggttttaaacgttaaggttagggtttaaaccggg

SEQ ID NO: 93270 - DNA, 599 bp, Homo sapiens
  misc_feature: GYAE6OF01BE9FO.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagccgtggggcctcagtgaaggtttcctgcaagccttctggatacaccttcactagctatgctatgcagttgggtgcgacacggcccctggacaagggtcttgagtggagtgggatggatcaacaccaacaccgtagggaacccaagtatcgcccgaggctcacgaggtacggtttcgtcttcgtccgttggacctaccgtctcgtcacggcacggctacgtatcgtgcaagtactcgacgcacgtaccttaagtcggacgtggacggtacctacgtcggtcccgttagttcttacggttgtacgcggaggtacgggttacttaacgttacgttagtaggtaagttaacgggtaaaggttttaggtttaaacgttttaggttagttaaaccggg

SEQ ID NO: 93271 - DNA, 763 bp, Homo sapiens
  misc_feature: GYAE6OF01CI1AL.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctgggcctcagtgaaggtttcctgcaagccttctggataccaccttcactagctatgctatgctagttgggtgcgacacggcccctggacaagggctttaggagtggatgggatgggatacaaacaccaaacacgtacggggaaaccccaacggtatcggacccaaggggtcctttacgaacgtagggtaccggttttcgttacgtttcccgttccgtttacgggaaccctacccgtttccttacggttccgtaacggtcccgtaaccgggtacctaagttaaacttcccgtacggtaccgtaacggaactccgtaacggcccgtaacggttaacccgttaaagttcggggaccttaaggggaaccgggtaaccgtaacccggtttcggtaccccggtttagtttaacgtttaaccggttcgggttacgggacccgggtaaagggtaaccgggttaccctttaaagttttaaacccggttaagttaaccgggtaaagttaagggttaaaccgggtttaagggtttttaaagtttaacggttaggttaaacccggg

SEQ ID NO: 93272 - DNA, 653 bp, Homo sapiens
  misc_feature: GYAE6OF01C2B59.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgctagttgggtgcgacacggccctggacaagggcttggagtggagtgggataggatacaacaccaacacgtacgggaacccaagtatcggacccgagggtcttacgaacgtacgggtacggttttgtcctttcttaccgttggacctacccttcgtcgttacacggccgtacggtacctaattactccgtcgtacaacggtactaccgacggtaccaacggtacccgttaaacgttcgggaccttaagggaaccgggtaccaccggttacggtacccggttagtttacttaaccgtggtacggacgaagggtacggtattaacgtttaacgtagttaggtaagttaggtaaacggttttggtttaaattagttaggttaaacgg

SEQ ID NO: 93273 - DNA, 617 bp, Homo sapiens
  misc_feature: GYAE6OF01CBAQ3.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgctattgggtgcgacacggcccctggacgaagggcttggaggtggagtgggatggatcgaaacaccaacacgtacggggaaccccaacggtacgtacgcccgaggggtccttacgaacgagggtaccggtttgttcctttccgtccgtttacggacctaccgttcttcggtaccacggtaccgtacgggtcagttacgtctcgacagactcacgccagtaccctaagtcggacttggaacggactaccgtcggtccgttagtacttacgtggttcgacgtaaggtcggtacttaagttacgtaagtagtaagttacggtaggtttaggtttaattaggtcgttaacgg

SEQ ID NO: 93274 - DNA, 505 bp, Homo sapiens
  misc_feature: GYAE6OF01A25JU.34.71.G05.1.454.CMB.1.raw
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (461)..(461): a, c, t, g, unknown or other
  misc_feature (461)..(461): n is a, c, g, or t
  modified_base (465)..(465): a, c, t, g, unknown or other
  misc_feature (465)..(465): n is a, c, g, or t
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacaggcccctggacaagggcttgagtggatgggatggatcaacaccaacactggaacccaacgtatgcccagggcttcacaggacgtttgtcttctcttggacncctntgtcagcacggcatatctncagntcagcagcctaatggctaggacgacgctgccgtgtacttactgtgcgagnggtnttagttctatgtagtaggagttaggtttattagtgtaacg

SEQ ID NO: 93275 - DNA, 237 bp, Homo sapiens
  misc_feature: GYAE6OF01CYGN8.34.71.G05.1.454.CMB.1.raw
  modified_base (234)..(237): a, c, t, g, unknown or other
  misc_feature (234)..(237): n is a, c, g, or t
tcagtacacgtgatcacgaccggtgctcgatttagtgtcgtcgcaagagagagggggtgccagggggaagaccgatgggccctggtcaccgtctcctcagcctccaccaagggcccatcggtcttcccctggcaccctcctccaagagcacctctgggggcacagcggccctgggctgcctggtcaaggactacttccatcacgtgtactgagcgggctggcaaggcgcatagnnnn

SEQ ID NO: 93276 - DNA, 545 bp, Homo sapiens
  misc_feature: GYAE6OF01BDHTN.34.71.G05.1.454.CMB.1.raw
  modified_base (493)..(493): a, c, t, g, unknown or other
  misc_feature (493)..(493): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacacggcccctggacgaagggcttggagtggatgggatggatcaacaccaacacgtcggaaccaacgtatcgcccagggccttacgacgagggtacggtttgtcttcgtccgttaggacctaccttctcgtcacgcacggctatactctagcagactcagcagacctatggctggacgaccacgtgccgttgtattacgtgttgacggtagnggtacttaagttactactgtaattaggtaaggttgtttaattagtggtaacg

SEQ ID NO: 93277 - DNA, 637 bp, Homo sapiens
  misc_feature: GYAE6OF01DH560.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatcgtgggtctgagttgaagaagccgtggggcctcgagtggtaaggtttcctgacaagccttctggatacctaccttcactagctatgactatgctagttgggtgcgacgacggccccgtggacgaagggtcttgagtggagtgggagtggactacaaacaccaaacgacgtagggaaacccaagtagtcgacccgagggtcttaccgaacgtagggtacggttttcgtactttccgttccgttacgggacctaccgttcgtcgtcgaacggtccgaacggtcctaattactcgtacgactaagtactcgagtccgaagtaccgtaagtcgggactaggaacgtctaacgttcggtaccgttagtaacgtttagcgtaggacgtaggtacggtattaacgttaactagtagtaagttaaggtaagtttaggtttacttaggtgttaaccggg

SEQ ID NO: 93278 - DNA, 731 bp, Homo sapiens
  misc_feature: GYAE6OF01C1YE9.34.71.G05.1.454.CMB.1.raw
  modified_base (292)..(292): a, c, t, g, unknown or other
  misc_feature (292)..(292): n is a, c, g, or t
  modified_base (412)..(412): a, c, t, g, unknown or other
  misc_feature (412)..(412): n is a, c, g, or t
tcagtacacgtgatcacgaccggtgctcgatttagtgtcgtcgcaagagagaggggacccaacaaccacacccctcctaagaagaagcccctagaccacagcctccacaccatggactggacctggaggatcctcttcttggtggcagcagcaacaggtgcccactcccaggtgcagctggtgcaatcgtgggtctgagttgaagaagccgtggggcctcaggtgtaaggtttccctggcaagtccttcgtggactaccacctttcactagctatgctatgtctagttgggngcggacacgggtccccgtaggaccgaagggtcgtttaggagggttaggaggttgggactagggtaactaccgaaaccaacccgaaacgtacggtaaccggggaaacccctaacggttacncggaccccgtagggtacccttacgaccggtacggttaccggttttcgttccgtttaccgttacccgttcggtaacccgttaccgttccgttacggtaaccgacggtacccggtaaccggtataaccttattacccggtacgtacgacgtacgtccagtaccgaacgtaccgttaaggtcggtacgtacggaacgtaccgtaccgttacggtaccgttagttaccgtagtttggaggtcggtaaaggaccgttacttaaagtttacgtaggtaagtaagtttaaggttaaggttaggttttaattacgtaggttaaacgg

SEQ ID NO: 93279 - DNA, 626 bp, Homo sapiens
  misc_feature: GYAE6OF01CIJ6P.34.71.G05.1.454.CMB.1.raw
  modified_base (457)..(457): a, c, t, g, unknown or other
  misc_feature (457)..(457): n is a, c, g, or t
  modified_base (546)..(546): a, c, t, g, unknown or other
  misc_feature (546)..(546): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttgggtggcagcagcaacaggtgcccacctcccaggtgcagctggtgcaatcgtgggtctggagttgaagaacgccgtggggcctcaggtagtaacggtttcctgacaagtccttcgtggatacctaccttcactagctatgctatgctagttgggtgacgacgacggcccctaggacgaagggtcttggaggtggagtgggatggataccgaacaaccaacgacgtaaccggaaacccgtaacgtacgtcggacccgaggtccttacggacgtacgggtcgttttgtccgtttcgttccgttacggacctacccgttntcgaccaggccaacgcgtaattactccgtagactaagtctaccagaccacgtacgtaacgtgacgtcggaacgtactcgtcggacgttnttaacgttcgtggtagacgtaggtacgtacttaagttacagttagagtaggttaagttgtttaattgttaacgtaacggg

SEQ ID NO: 93280 - DNA, 727 bp, Homo sapiens
  misc_feature: GYAE6OF01BX881.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatcgtgggtctgagttgaagaagccgtggggcctcgagtgtaaggtttcctgcaagtccttcgtggactacgtaccttcactagctatgctatgctagttgggtgcgacgacggtccccgtaggacgaagggtcgttaggaggtggtagtgggatggactacgaaccaaccaacgtacgtacggaaaccctaagtacgtcgacccgtagggtcctacgacgtacgggttacgtttacggttcctttccgtccgttaccggaccttacccgttcgttacggtaccgtaacggccgtaacccgggtacttaaccgttaacgtttccgaacggtaccgtaaacggtaacgtaccgaacgtcccgtaaacggttacccttaagggtcgtacggttacggacggttaacctacggttcggtacccggtttagtaaccgtttaggtaccggttacgggaccggtaaggtacggttactttaagtttacgtaagttagtaaaggttaacggtaagtttacggtttaatttacgggttcgttaaacgggg

SEQ ID NO: 93281 - DNA, 698 bp, Homo sapiens
  misc_feature: GYAE6OF01B94IT.34.71.G05.1.454.CMB.1.raw
  modified_base (350)..(350): a, c, t, g, unknown or other
  misc_feature (350)..(350): n is a, c, g, or t
tcagtacacgtgatcacgaccggtgctcgatttagtgtcgtcgcaagagagagggggctgggcctcaggaagcagcatcggaggtgcctcagccatggcatggatccctctcttcctcggcgtccttgcttactgcacaggatccgtggcctcctatgagctgactcacgcccaccctcagtcggtcccgtcgtcccccgaggaccagacacgccacgcactccacctgctcgtaggagtaagtaaaggttagggggaattaaaagtagtgtcttagcgttaggtatacagacaggaacgccgacggccgtaccgtcccgtgtcgtcgtacgtctactctatacaagtanagacgacggccgacctagacggactccgtacgacgtcgtacttctcgtacgtcctaccgtaacgtcggtacggtaaccacgcgccctacgtccacgaccacgtccgacggtacccggacccaggtacctaggaccggtagtacggagtaccttaggtaaccgttacgttccggtagtccgggagggttcccggtaggggaaacccgtagggtaaccggaaccggttagggttacgggtttaccgggaccggggggtaaccgggaaacccggggacccttaacggggtccgtaacccgggttaaccccgggttaccggtaaccgggtaacggacccgggtaaccccggg

SEQ ID NO: 93282 - DNA, 700 bp, Homo sapiens
  misc_feature: GYAE6OF01BSDFB.34.71.G05.1.454.CMB.1.raw
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttgggtggcagcagcaacaggtgcccactcccaggtgcagctggtgcaatctgggtctgagttgaagagccgtggggcctcgagtgtaacggttcctgcaagtccttcgtggataccacttcactagctangctatgctagttgggncgactacggccctggacaggtcttggagtggagtggatggatacgaacgaacctaacgacggtaccggggaaaccctaacggtactacggacccggaggggtacccttacgaacggtaacgggggtttaccggttttcggtttaccttttcccgtcccggttttacgggaacccttacccgttcgttacgttccgaacggtacccgaacgggtactaacgttactacgttacgacgtaacgtacctacgaacgtaccggaacgtacccgttaagcggtaacgttggaaaccggtactaccgttcgtaccgttagttacttaggtggtcgtacggacggtacggtattaaagttacgtagttacggttaacgttagggttaaagtttagggtttaactttaagtagggttaaccgg

SEQ ID NO: 93283 - DNA, 642 bp, Homo sapiens
  misc_feature: GYAE6OF01BXRN5.34.71.G05.1.454.CMB.1.raw
  modified_base (370)..(370): a, c, t, g, unknown or other
  misc_feature (370)..(370): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagccgtggggcctcgagtgaaggtttcctgcaagccttctggatacaccttcactagctatgctatgctagttggtgcgacacggcccctaggacgaagggtcttaggaggtggagttgggatggactacaacaaccaacgtaccgtacggaacccaacgttacncggacccgtagggtcttaccgaacgtagggtacggtttcgtacctttcgttacccgttggaacccttacccgtacgttacggtcgtacgaccggtaaccggctaacgtacgtcctacggtacacgtactacgagctaacggaccttaagtccgggtacgttacggaacggtaccgtaaccgttcggtaccggttagttaacgttacgttggtcgacggacgtaggtacttagttactagtagtaagtagtaagttagttattagtagtacgg

SEQ ID NO: 93284 - DNA, 764 bp, Homo sapiens
  misc_feature: GYAE6OF01ATD7K.34.71.G05.1.454.CMB.1.raw
tcagtacacgtgatcacgaccggtgctcgatttagtgtcgtcgcaagagagagggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccagcatccacctgcctcgtaggacgtaagttaaaggttagggggtaacttaaaagtagtcgtacgtttggcgttaggtactacgagacgaaggaacgaccgaacgggcccgtacggtcccccgttggtcgtcggttcggtactacttaccgttaactacgaaagtaactaacggaccgtaaaccggtccggtacccgtacggaacggggtacctacccggtagacggccgttaattccgtacgtcggtacctacccgacgtaccggtacggaacctacgaccggacctacgtacgtacgaaccacgtaccggaccggaccccggggaacccgtacgggtacgttaacgggtagggtaacgtacgggtaacgggtcgttaacggttaacctttaggtttaaccggttacggtacggtacgggtaccgggtacgggtaacgaccggtacgtaaaccgggtacgggttacgggtacgggttaccggggacggggaaccgggtaaccgacggtaccggtaccggtacccgtacgggtacggtcccggaacggtaccccggg

SEQ ID NO: 93285 - DNA, 839 bp, Homo sapiens
  misc_feature: GYAE6OF01BOO8K.34.71.G05.1.454.CMB.1.raw
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtcgcccactcccgaggtgcagcgtggtgcaatcgtggtctgtagtagaagacgccgtcgggcctacgagttaggtaacggtttcctcgaccgtaacgtcccgttcgtaggtaacctacctacccgttacactacggtcttaagtcgtaccttagtcgtacgttaggttggggtaccgaacgtaccggacccggtaccccgtaaggaaccggtaagggtcgttaggaggtaggtacggttagggaatcgggtaaactaaccaaacccgaaacctaaccggtaaccggtaaccggaaaccccgtaaggtaccgtaccccggtacccggtaacggtacccgtaaccgaacggttaccgggtttaacggtttccgttcccgtttacccgtacccgttacgggtaccctaaccgttcgtaccgtaccgaccgtaccggtacccgtactaacgttaacgttccgtacgtacggtaaacttaccgtacgtaaccgtaccgtaaccgttaaccgttaacgggtccggaacgtaacggtaacccggtaccgtacgttccggtaaccggttgttaactacgggtggtaccggtaaacggtcggttaaacgtacctttaaggttaacgtacggttaagttaacggtaaaggtttacggtttaagtttaggttaaccggtgttaaaaccggggg

SEQ ID NO: 93286 - DNA, 524 bp, Homo sapiens
  misc_feature: GYAE6OF01DWCDU.34.71.G05.1.454.CMB.1.raw
  modified_base (279)..(279): a, c, t, g, unknown or other
  misc_feature (279)..(279): n is a, c, g, or t
  modified_base (346)..(346): a, c, t, g, unknown or other
  misc_feature (346)..(346): n is a, c, g, or t
  modified_base (362)..(362): a, c, t, g, unknown or other
  misc_feature (362)..(362): n is a, c, g, or t
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgctattgggtncgacaggccctggacaaggcttgagtggatgggatggatcgaacaccaacacgtggaaacccagtangcccagggcttcacgnggacgtttgtcttcgtccttggacctactctcgtcagcacggtcagtatctgcagatctagcagtcctaagtggctaggaggacacgtgccgtgtaattacgtgtgacgaggtagtactatttacagtgtaagtagtaacgtggtttaactagtgtaaccgg

SEQ ID NO: 93287 - DNA, 599 bp, Homo sapiens
  misc_feature: GYAE6OF01D9V1Q.34.71.G05.1.454.CMB.1.raw
  modified_base (281)..(281): a, c, t, g, unknown or other
  misc_feature (281)..(281): n is a, c, g, or t
  modified_base (529)..(529): a, c, t, g, unknown or other
  misc_feature (529)..(529): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgctagttgggtncgacacggtccccgtggaacgaagggtcttggaggtggagtgggatggatacaacaccaacacgtacgggaacccaagtatcgacccgtagggcttacgacgtaagggtacggtttgttccttcgttccgttacggacctaccgttcttcgtaccacgccgaacggtctaagttactcgtagactagactcgagctacgtacctaagtcggataggacgtactacgtcggtccgttagtacgttacgnggtggacggaggtacggtattagttactagttagaaagttaggtaagttaggtttaattgtggttaacgg

SEQ ID NO: 93288 - DNA, 658 bp, Homo sapiens
  misc_feature: GYAE6OF01B7RW1.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgctagttgggtgcgacacggcccctggacaagggcttgagtggagtgggatggatacgaaacaccgaacacgtacgggaacccaacgtactcgcccgagggtccttacgacgtaggtacggttttacgtcctttcctccgtttacggacctaccgttccttcggtccgacgccgtacggtactagttaactcctagaccgtaagtactacgacgaccgaacgtaccttaaggtcgggtactagggaacgtaccgtaaccgttcggtacccggttagttaactttaccggtaggtcggtaccggtaaggtacggtaccgtttaatttaccgttaagttacggtaagttaaggtaacggtttaggtttaatttacggtaggtttaaacggg

SEQ ID NO: 93289 - DNA, 645 bp, Homo sapiens
  misc_feature: GYAE6OF01CDRSG.34.71.G05.1.454.CMB.1.raw
  modified_base (297)..(297): a, c, t, g, unknown or other
  misc_feature (297)..(297): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatcgtgggtctgagttgaagaagccgtggggcctcgaggtggtaaggtttccctagacaagctattcgtggatccaccttcactagctatgctatgctagttgggtgcgacncgggcccctggacgaagggtctaggaggtggagtgggatggatacaacaccaacgtacgacggaaccctaagtataccggccgtaggccttacgacgtaggttacggtttcgtcttctaccgttcgacctaccgttgtcgcgacgaccgacggtctaattacgtccgtaggacctaggtacctacgacgtacaaccgttacgttaaggtcgggtacgtacgggtacgaccttaccggtccggttacggttagtttacgttacgcgggtacgaggtacggtaggttaacctttagttaaccgtagtagttaaagttagggttaacggttaggttttaactggttaacgg

SEQ ID NO: 93290 - DNA, 619 bp, Homo sapiens
  misc_feature: GYAE6OF01CD57H.34.71.G05.1.454.CMB.1.raw
  modified_base (293)..(293): a, c, t, g, unknown or other
  misc_feature (293)..(293): n is a, c, g, or t
  modified_base (501)..(501): a, c, t, g, unknown or other
  misc_feature (501)..(501): n is a, c, g, or t
tcagtacacgtgatcacgaccggtgctcgatttagtgtcgtcgcaagagagagggggctgggcctcaggaagcagcatcggaggtgcctcagccatggcatggatcctctctcctcggcgtccttgcttactgcacaggatccgtggcctcctatgagctgactcagcccaccctcagtgtccgtcgtccccaggacagacagccagcatcacctgctcgtggagaataaagttgggggaataaatatgtcttgcgtggtatcagacagaagccgagccacgtccccgtgtcncgtggtctatctatacaagatacgacaacggccggccctacgacgggtacctcccgtaggacgtcgtacttcgtcgtcggtcctacccgtaacgtcggtacgggaactacgacgcctactctaccgacactacgaccggaccgggaccgagctagtggtagtggacgctagtacttattaccgtgtacgacgggtcgtcgggtaaacncggtacccgtaaacggtaggttacggggtacggttacggggacggggtaaaccggaccggtaacgtccgggttaccggtaacccggtaccgttaacgggccgtcccggtaaacccggg

SEQ ID NO: 93291 - DNA, 586 bp, Homo sapiens
  misc_feature: GYAE6OF01CE7AR.34.71.G05.1.454.CMB.1.raw
  modified_base (182)..(182): a, c, t, g, unknown or other
  misc_feature (182)..(182): n is a, c, g, or t
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (279)..(279): a, c, t, g, unknown or other
  misc_feature (279)..(279): n is a, c, g, or t
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
  modified_base (357)..(357): a, c, t, g, unknown or other
  misc_feature (357)..(357): n is a, c, g, or t
  modified_base (410)..(410): a, c, t, g, unknown or other
  misc_feature (410)..(410): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
  modified_base (511)..(511): a, c, t, g, unknown or other
  misc_feature (511)..(511): n is a, c, g, or t
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccaggtgcagctggtncaatcgtgggtctgagttgaagacgccgtgggcctgagtgtagttccngcacgtcttcgngactacacttcactgctatgtactatgcgtagttggngcgacgacgcccgtagaccgaggtctggagtggagttggatggacaccgaanaccgaacncgtaccggaaccagtacncggccgaggtactacgaacgtggttaccgtgttcctcgtctacgacctacgtntacgtacgcgacgtacgccttaagtcgtctacggactacggtaacncgganccgtagtacgtagtcggatacgacggactcgagtcccgtagtaccgttgnggtccgagtaggtacgtcttacgttaagtcgtaagtagttaaacggtagtttagtacgttagtccggttaacggg

SEQ ID NO: 93292 - DNA, 742 bp, Homo sapiens
  misc_feature: GYAE6OF01EZKGC.34.71.G05.1.454.CMB.1.raw
  modified_base (237)..(237): a, c, t, g, unknown or other
  misc_feature (237)..(237): n is a, c, g, or t
  modified_base (278)..(278): a, c, t, g, unknown or other
  misc_feature (278)..(278): n is a, c, g, or t
tcagtacacgtgatcacgaccggtgctcgatttagtgtcgtcgcaagagagagggggacccaacaaccacaccccctcctaagaagaagcccctagaccacagctccacaccatggactggacctggaggatcctcttcttggtggcagcagcaacaggtgcccactcccaggtgcagctggtgcaatctgggtctgagttgaagaagccgtggggcctcgagtgtaacggtttccngcaagtccttctaggactactaccttcactagctatgctangtactagttcggtgcgacgacggtcccctggtaccgaagggtcgtaggacggttggaggtgggtatggtaactaccgaaaccaccgaaacgtaccgtaccgggaaaccctaacggttaacgccggaccgtacgggtaccttaccgaacggtacggggtttaccggttttcgttaccgtttcccgtttacgttaccgggaacccttaccgttccgtttacgtaccgtacggtccggtaaccggtactaacttacgttacgtaccggacgtaggttaactaccggtaagaccgtaaccgtaccgttaaacggtcggtacgtacgggtaacgtaccgtacgttccgtaccggttaagttaacgttcgggtagtaccggtacggtaacggtacggttacgttaacttacgttagtaacgtaggttaaacggttaggtttaggtttaagtttaggtaggttaaaccggg

SEQ ID NO: 93293 - DNA, 598 bp, Homo sapiens
  misc_feature: GYAE6OF01ARMPX.34.71.G05.1.454.CMB.1.raw
  modified_base (238)..(238): a, c, t, g, unknown or other
  misc_feature (238)..(238): n is a, c, g, or t
  modified_base (512)..(512): a, c, t, g, unknown or other
  misc_feature (512)..(512): n is a, c, g, or t
  modified_base (522)..(522): a, c, t, g, unknown or other
  misc_feature (522)..(522): n is a, c, g, or t
tcagtacacgtgatcacgaccggtgctcgatttagtgtcgtcgcaagagagagggggacccaacaaccacacccctctaagaagaagcccctagaccacagctccacaccatggactggacctggaggatcctcttcttggtggcagcagcaaacaggtgcccactcccaggtgcagctggtgcaatctgggtctggagttagaagaagccgtcggggcctcagtgtaacggtttccngacaagtcccttgtggtactacctaccttcacttagctatgctatgctagttggtgcgacgacggtcccgtaggacgaggtctgaggtgaggtggatgatacaacgaaccaacgaccgtacggaaaccctaacgtagtccgacccgtaggtcctacgaacgtcggttacgtttgttccgttccttcgttacggacctctcgttcgtacgacgtccgacggtactattacgcgtagctaagtactcagccacgtacctagtcgacgtagacgtancgttgacgtnttacgtacgtgtgaggtagtcgtaattacgtagtagttctaagtaacggttgttaagtttattagtaggttaacgg

SEQ ID NO: 93294 - DNA, 742 bp, Homo sapiens
  misc_feature: GYAE6OF01DQKRH.34.71.G05.1.454.CMB.1.raw
  modified_base (483)..(483): a, c, t, g, unknown or other
  misc_feature (483)..(483): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagccgtggggcctcaggtgtaaggtttcctgacaacgtccttcgtaggactacctaccttacaactagtcctaatcgacttagtgacgtagttcgggtcgacgaccgacggtccccgtaggacgaagggtcgttaggaggtggagtgggagtaggtacgtacgaaaccaaccgaacgtaccgtaacgggaaaccctaacggtaacgtaccggacccgtaagggtcttaccgacgtacgggtaccggtttcgtacctttccgttaccgttacggtaccnccgtttactcgtaacgcgccgaacgtctacttaactcgtacgaactagactcgtaacgacgtaccgtacgttaaggcggtacgtacggtaacgggacccttaggtccgttaccgttaagttttaccgttacccggtaggtacccggttaacggacgggttaaccggtacgttttaaacgttaaccggtaagtttaacggtaaacgttaaagggttaacggtttcgttttaaatttaaccgggttagtttaaacccgggg

SEQ ID NO: 93295 - DNA, 570 bp, Homo sapiens
  misc_feature: GYAE6OF01EITXG.34.71.G05.1.454.CMB.1.raw
  modified_base (219)..(219): a, c, t, g, unknown or other
  misc_feature (219)..(219): n is a, c, g, or t
  modified_base (360)..(360): a, c, t, g, unknown or other
  misc_feature (360)..(360): n is a, c, g, or t
  modified_base (382)..(382): a, c, t, g, unknown or other
  misc_feature (382)..(382): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
  modified_base (441)..(441): a, c, t, g, unknown or other
  misc_feature (441)..(441): n is a, c, g, or t
  modified_base (485)..(485): a, c, t, g, unknown or other
  misc_feature (485)..(485): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagccgtggggcctnagtgaaggtttcctgcaagtccttcgtggactacaccttcactagctatgctatgctagttgggtgcgacacggcccctggacgagggtcttggagtggagtgggatggatcaacaccaacgacgtacggaaccaacgtancgccaggctacacgagtcgttntctctctgactctntctnacgcacgcatntcgngcagactcgacgtcacgtacgttaancggtacgtgaacggactacgtacgtccgttaggtacgtttacgnggttcgacgtaaggtcgttacttagtttactaggttacgtaaaggttaacgggttaagtttaggtttaattaggttggtaaacgg

SEQ ID NO: 93296 - DNA, 780 bp, Homo sapiens
  misc_feature: GYAE6OF01B5NW8.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacgaggtcgcccactcccaggtgcagctggtgcaatcgtgggtctgagttgaagaacgccgtggggcctcgaaggttaggtaacggttttccctgaccgtaacggtccctttaccgtagggaacttaaccctaccccttttacgaaccgttagtaccttaagttcggtaccttaagttcgtaccgttagtttcgggggtacgaccggtaaccggaccgggtcccccgtagggaaccggtaaaggggtccttgggaggttagggaggtagggagtggaactacgaaacctaaccgaacgtaacgaaccgggaaacctaacgtacgtacggacccgacgggtcctacgacggtaacgggttaccgttttcgttccgttaccgttacgttccggtactcccgtgttaccgtacgacgtaccgaccggtatacgtaacgttcccgaggaccagtacctcgaagtacctaacggtaacctaggtccgtacgtggaaccgtaccgtacgtcggtaccgtacgtacctaacgtttgtcgggtaacgtcggtaaaggcgttaacgttaacgttagtaaacgttaggttaacgtaaaggtttaacggttttaaggttaaagtttaggttaaccggg

SEQ ID NO: 93297 - DNA, 753 bp, Homo sapiens
  misc_feature: GYAE6OF01CUH48.34.71.G05.1.454.CMB.1.raw
  modified_base (254)..(254): a, c, t, g, unknown or other
  misc_feature (254)..(254): n is a, c, g, or t
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagagccgtgggcctcgagtgtaaggtttcctgacaagtccttcgtggactacnccttacactagctaatgcttaatcgctagtttgggtcgcgaaccgacggcccccgtagggaaccgaaggggtctttaggaggtagggtaagtgggagttacgggaacttaacgaaaccgaaccctaaaaccgacggttaaccggggaaaccctaaaacggttacgttccggacccgtaggggtacccttaccgaacggtacgggttacggttttcgttacccgttttccgtcccgttagggaaccctacccgtttcgtcgttaccgacgtccgaaccggtactaacgttaacttcgtacgacgtacggtactacgacgtacgtacgaacccgtttaaggccgaccgttagggaaccgtacctaccggttcgtaccggttagttaacgtttacgacggttaggtaccggtaaggttacggtaactttaacggtttaacgtacggttaagtaagttaaacggttaaaggtttggtttaaacttagttacggttaaaccggg

SEQ ID NO: 93298 - DNA, 690 bp, Homo sapiens
  misc_feature: GYAE6OF01CAWQA.34.71.G05.1.454.CMB.1.raw
  modified_base (155)..(155): a, c, t, g, unknown or other
  misc_feature (155)..(155): n is a, c, g, or t
  modified_base (174)..(174): a, c, t, g, unknown or other
  misc_feature (174)..(174): n is a, c, g, or t
  modified_base (185)..(185): a, c, t, g, unknown or other
  misc_feature (185)..(185): n is a, c, g, or t
  modified_base (250)..(250): a, c, t, g, unknown or other
  misc_feature (250)..(250): n is a, c, g, or t
  modified_base (268)..(268): a, c, t, g, unknown or other
  misc_feature (268)..(268): n is a, c, g, or t
  modified_base (522)..(522): a, c, t, g, unknown or other
  misc_feature (522)..(522): n is a, c, g, or t
  modified_base (547)..(547): a, c, t, g, unknown or other
  misc_feature (547)..(547): n is a, c, g, or t
tcagtacacgtgatcacgaccggtgctcgatttagtgtcgtcgcaagagagaggggacccaacaaccacacccctctaagaagaagcccctagaccacagctccacaccatggactggacctggagatcctcttcttggtggcagcagcaaacgnggtcgcccactcccaggtncagcgtggtcncaatcgtgggtctaggtgttagaaagacgtccggtggggcctcgtaggtacgtaaacggtttccnggactaacgtccttaagnggtactacctaccttcgataacgctagtcgtattatcgtccttagtttgggaacgtcccacgtaccggtccccgtaggaccgtaagggtcctaggtaaggtggagtggaagtcggttaacaaccgaaacctaaccggaccgtacggtaacccggaaaccgtacgtacttccccgggaacgttcggtacttaccggacgttaacggggtcgttttctccttacgtccgttacgcctcgtcgtgtacgtcgaccgngtaactacttcgctaggactacgtncgacgtcaacgtcccgtagtcgacgtacgacggtaacttcgtacgtaccgtagttaacttgttaccggagaccggaaggtacgttacctagtttacgagtaaggtacgttaagtaggtttaattcccgtaagtgttaaccggg

SEQ ID NO: 93299 - DNA, 734 bp, Homo sapiens
  misc_feature: GYAE6OF01BD1WE.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaacggtttcctgcaagccttcgtggactaccaccttcactagctatgctatgtctagttgggtgcgacgacggccccctagggaccgaagggtcttaggaggtggaggtgggtagtcggactacgaaaccaccgtaaacgacgtacgggaaaccctaacgtacgtacggacccgtagggccttacgaacgtacgggtacggttttcgttcctttaccgttcccgttacggaacccttacccgttcgttacggtcctacggccgacggtactaacgttacctccgtacggacctaacgtacttaccggaacaccgtaacgtaccgtttaaacgtcgggtaccgtacgggtaaccggaaccgtaccggtttacgggtaccgtttacgtttaaccgtttcggtacggtaccggtacggaacggttaaccgggttaactttaacggtttacgtaaagttacggttaaggttaacggttaagggtttaggtttatttaaccggttaggttaaccggg

SEQ ID NO: 93300 - DNA, 717 bp, Homo sapiens
  misc_feature: GYAE6OF01AGWRR.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtcgcccacctcccaggtcgcagctggtgcaatcgtgggtctgagttagaagaagccgtgggcctgagtgtaacggtttctgcgtaacgtccttcgtggactaccgtaccttacactagtcctagtcgtactagtcgtcgtagttcgggtacgacgaccgacggtcccccgtaggtacgaaggtcgtgacggtggaggtggatggacacgaacacaagacgtacggaaccgagtacgtcgaccgacggtctacacgtacgggtacgttcgtcttcgtccgtaggtaccctacctcgtacgtaccgacgtccgtacggtactacgtacgttaccgtcgtacctaacggtactacggtaccgtacggaacgttaaccgttaacggtcggtacgtaggtaacccggtagtaccggtcgtttacccggtagttaaacgtttccggtaggtaccgggtaggtaaccgggttccgtaagtttaccgttaagttaaggttaaggtaaaacgtttaaggggtttaacggtttaaggtttaaacgtttggtttaaacggttaaccgggg

SEQ ID NO: 93301 - DNA, 855 bp, Homo sapiens
  misc_feature: GYAE6OF01DEJR0.34.71.G05.1.454.CMB.1.raw
  modified_base (242)..(242): a, c, t, g, unknown or other
  misc_feature (242)..(242): n is a, c, g, or t
  modified_base (408)..(408): a, c, t, g, unknown or other
  misc_feature (408)..(408): n is a, c, g, or t
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacgaggtcgcccactccccaggtgcagctggtgcaatctgggtctgagttagaagaagtccgtggggcctcgagtaggtaaggtttcccngcaacgtcttcgtggactactaccttcactagtactatcgacttagtgtctagtttggacgccgacgtaccggcccgtaggtaaccgagggtctttagaggtcgaggttcggagtaggtactacgaaaccaaccgaacgtaccgtaacgggaaacccctagttacnccggacccgtagggtaccgttacgacggtaacgggtacgttttcgtccgtttaccgttcgttacgtaccttaaccgttccgtagtccaaggtaccgtacggtaccaacgttcgtttccaaggtacgtaaaccgtacgtccggaaactccccgttaacgggtaaccccgttttaagggtccgggtaaacctttaacgggggaaaccccgttaaaccgtttccgggttaaccccggggtttacccgggtttaaacgttttaaccggttttaccgttcgggggtaaaaccccggggtggttaaaaacccggggaaccgttttaaaccgtttaaaccggtttttaaccgaaaaggtttttaaccggggaaaagttttaaaccggggtttaaaggggtttttaaggttttttaaccccgtaaaagggggtttttcccgggtaaaacccgggg

SEQ ID NO: 93302 - DNA, 647 bp, Homo sapiens
  misc_feature: GYAE6OF01EY6B1.34.71.G05.1.454.CMB.1.raw
tcagtacacgtgatcacgaccggtgctcgatttagtgtcgtcgcaagagagagggggctggggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccagcatcacctgctctggagagttaaagttggggaataaatatgtcttgcgttggtatcagacagaacgccgaggccacgtcccctgtcgcgtggtcattctatacaagagtacgacgaacggccggaccctacggacgggtactcccgtagacgtcgtacttcctcgtcggtcctaccaaccgtcgtaacggaaccacgaccgccctaactccgtacgaacctacgaccgaacgggacccgggacccaggtaccgtagtgggagtcgggaacgtcgtaacgtaacttacgttaccggtcggtcggtacgggtcgggtacggaacgacgggaaccgtaacggtacgggttacgggttacggtacggggacgggaacggggacctaacggcccgttaaccgggtacccgtaccggttaacggtccgaaccggtaacccgg

SEQ ID NO: 93303 - DNA, 843 bp, Homo sapiens
  misc_feature: GYAE6OF01BP5I8.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctgtgcaatctggtctgagttgaagaagccgtggggcctcgagtgtaaggtttcctgacaagtcccttctggatacctaccttcactagctatgctatgactagttgggtcgcgtacgacggtccccgtggacgtaacgggtcgttcggaggttgggacgttggggtaagttgggtaacttaccgaaaccgacccaaacgtacccgtacggggaaaccccaaacggttacgtaccgaccccgtaaggggtcccttaaccgaacggtacgggttacggttttaccggttcctttacccgtttaccggtttacggtaacccgttaccccgtttacccgttcggttaacccgtacggtacccggtaaccgggtacgtaacgtttaacgttacccgttacggtacccttaaaggtaaccttaccggaacgacccgttaacggtacccccgttaaaggttccgggtaaccggttacgggaaaccggggtaccccgttaacggtttaccgggtacccggttaagttttaaccggttttacggttaccggttagggtaacccggtaagggtacgggtttacccttaaacggtttaccgttaaggtacggttaaaaccggtttaaggttaaaccggtttagggtttaatttaccggttaggtttaaacccgggg

SEQ ID NO: 93304 - DNA, 851 bp, Homo sapiens
  misc_feature: GYAE6OF01CRX4J.34.71.G05.1.454.CMB.1.raw
  modified_base (153)..(153): a, c, t, g, unknown or other
  misc_feature (153)..(153): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttgggtgcgggggancagcaacgaggtcgccctacctcccgaggtcgcagcgtggtcgactaacgtcgtgggtctagtagttaggaagacggccgtcgggcctagaggtacgtaacggtttcctagactaacggtccttcgtagtacctaacctacctttacgaactacgtccttagtccgtattagtcgtacgtaggtttcgggacgaccgtaccggaccggtacccccgtaagggaaccgtaacggggtcgttaggaggtagggtagggtagggtacgtaacggtaacaacccgaaaccgaaccgtaaaaccggtacggtaaaaccccggggtaaaacccgttaacggtaccgtaccccgggaacccggttaacggttaccccgtttaaaccggaaggtttaaccgggggttttccgttttccggtttaacccgttccccggtttaaccggtacggtaaccctaccggtttccgtggtaaccgacggacccgtaacggtactagttacccttgacgaactacgtacgtacggaacctaaccggtacgtaaccgttaaggtccggtaccggtaggaaccgtcgttacggtcgttacgttagtacgttcgggacgttccggagttaaccggtcgtttaactttaacgtcggttaaagtaggttaacgttaagggtttaacgtttagtttaaatcgggttaacggttaacgggg

SEQ ID NO: 93305 - DNA, 712 bp, Homo sapiens
  misc_feature: GYAE6OF01BJ1F3.34.71.G05.1.454.CMB.1.raw
  modified_base (548)..(548): a, c, t, g, unknown or other
  misc_feature (548)..(548): n is a, c, g, or t
  modified_base (626)..(626): a, c, t, g, unknown or other
  misc_feature (626)..(626): n is a, c, g, or t
tcagtacacgtgatcacgaccggtgctcgatttagtgtcgtcgcaagagagaggggacccaacaaccacacccctcctaagaagaacgcccctagaccacagcctccacaccatggactggacctggaggatcctcttcttggtggcagcagcaacgaggtcgccccacctcccgaggtgcgagcgtggtgacctaattcgtggtctggtagttaggaaagtacgccggtcggggcctacgaggtacggttaacggttttccagaccgtaacgtcccgttcgtacggtaactaccctaccccttacaccgttacgtaccttagttcgtacctagtcgtacgtaggtttcgggcgaccgaccgtaccggcccgtaggaaccgtagggtctaggagtggacgtggagtacggactaccaaccgaaccacgtaccggtaaccgaccgaacgtacgtaccggaccgtacgtctaacgacggttacggttacggtttccttccgttcccgttacgtacgacctaccgttctacgtacgcgtaacgtcgaactntacgtcgacgtcactacgcgactcgtaactacgttagccgtacgtaggaccgtaccgtacggtcgttacgtaacgttntaggggtccacggtagtacgtaactagttatacgtaaggtacgtaaaggttacggttagtttaacctttgtaacggtgttaacggg

SEQ ID NO: 93306 - DNA, 755 bp, Homo sapiens
  misc_feature: GYAE6OF01EVOP9.34.71.G05.1.454.CMB.1.raw
tcagtacacgtgatcacgaccggtgctcgatttagtgtcgtcgcaagagagaggggacccaacaaccacacccctcctaagaagaagcccctagaccacagctcccacaccatggactggacctggaggatcctcttcttggtggcagcagacaacaggtcgcccacctcccaggtgcagcgtggtgacaatcgtggtcgtgtagttagaagaagccgtcgggccgtctagtaggtaacggtttccgtcgacgacgtccttcgttaggtactacctaccttacctactagtctacgtacgtctactcgtacgtacggttagggtacggtaccggaccgcggaccccgaacggggaaccgtaacggggacgtttcggtaggtgggtaaggtagggtaaggtacggtaacgtaacctaaaccgtaaacccgaaaccgtgaaacccctaacgggtaaacccgtaaccggtaaccgtaacggtaccctaccgggaccgttaaccggtaaccggttacggtaaccggtttcgttccttcggttaccttaccggtaccttaccgttccgtacggtacctaacggacctacgtactactacgtaccgtacgactacgaacgtcgacggtacctaacgtacggtaacgttacggacgtaacggtacggtacgtaccgtacgtaccgttacgttacgttacgtaggtacggtacggtacgtacggtacgttaacgttacgtaagttacgtaagttaaggtaagg

SEQ ID NO: 93307 - DNA, 711 bp, Homo sapiens
  misc_feature: GYAE6OF01ERSO6.34.71.G05.1.454.CMB.1.raw
tcagtacacgtgatcacgaccggtgctcgatttagtgtcgtcgcaagagagagggggctgggcctcaggaagcagcatcggaggtgcctcagccatggcatggatccctctcttcctcggcgtcttgcttactgcacaggatccgtggcctcctatgagctgactcacgcccaccctcacgtcgtccgtcgtccccgaggacagacgagccagcataccacctgcctcgtaggagtaagttaaaggttgggggaataaacgttagtacgtcgtttgacgttaggttacgtacgacgtacaaggacgaccgtaacggacctaccggtcccgttggtcgtcgttcggtactactactatacgaagtatacgacgtaacgccggacccgtacggtacggtactaccgtaggacgtccgtagttctacgtccggtacctaccctaacgttccggtaacggtaaccaccgtccgaccttaacgccgtacccaacgacgtacggaccggtacccgggacgtagtaactagggacgggtactagggacgttaccgtaagtttaacttaaccggttgttaccgggtacggcgggttaaccgggtaacggtcgaaccggtaccgtaccgggttagggtaccgggttacggcggggaaccggtacgacccggtacgccggtaccggtacccgtagggtaccgtcccgaaccgggtacccgg

SEQ ID NO: 93308 - DNA, 674 bp, Homo sapiens
  misc_feature: GYAE6OF01BCYMF.34.71.G05.1.454.CMB.1.raw
  modified_base (389)..(389): a, c, t, g, unknown or other
  misc_feature (389)..(389): n is a, c, g, or t
  modified_base (610)..(610): a, c, t, g, unknown or other
  misc_feature (610)..(610): n is a, c, g, or t
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtcgcccacctcccaggtgcagctggtgcaatcgtgggtctgagttgaagaagccgtgggcctcgagtgtaacggtttcctgacaacgtcccttcgtaggactaccaccttcactagctatgtctatgactagttgggtgacgacgaccggccctgggacagggtcttggaggtggagtgggtagtaggactacgaaccaccgaaccgtacggtaccggaaaccctaggtacncggacccggtaagggtcccttacggaacgtacgggtttaccgttttcgttacccgttccgttcggttacccggaccttcccttacgtcggttccgagccgtacccggctagtactcgtacgactacgtaccgacacgtaccgaccgtaccgtaggtccgggtacttacgggaacgtaccgtaccgttcggtacgttacgtttacgttacggtggttaacgngggtaagtcggttaccttaagttcgttagtagtacgttaggtagttatttagtgtaggtaacgg

SEQ ID NO: 93309 - DNA, 709 bp, Homo sapiens
  misc_feature: GYAE6OF01AYVQJ.34.71.G05.1.454.CMB.1.raw
  modified_base (176)..(176): a, c, t, g, unknown or other
  misc_feature (176)..(176): n is a, c, g, or t
  modified_base (541)..(541): a, c, t, g, unknown or other
  misc_feature (541)..(541): n is a, c, g, or t
  modified_base (683)..(683): a, c, t, g, unknown or other
  misc_feature (683)..(683): n is a, c, g, or t
tcagtacacgtgatcacgaccggtgctcgatttagtgtcgtcgcaagagagagggggacccgaacaaccacacccctcctaagaagaagccctagaccacagctccacaccatggactggacctggaggatcctcttcttggtggcagcagcaacaggtgcccactcccaggtgcngctggtgcaatcgtgggtctgtagttcgaaaggaagccgtggggcctcgagtggtaaggtttcctgcgtaacgtccttcgtggattaaccgtccttcgtaactagcctatgtcctagtgcgttacgttggggtcgccggaacgccgggccccgtagggaacgtaacgggtcgttacggagggtggtagggttagggtattagggacttaacaacccactaaaccgacggtaccggaaaccgacgttacgacgacccgagggtcttaccaggtacggttacgttttcgtaccgttccttcggtacgtaccctccgttgtcgttaccgacgtacgtaaccgcgtaacgtactacgtcgactagtacncgtacgcgtactaccgttaagccggtgttacggacgtaacctgtaaccggtcgttacgttaacgttcgttaacgggccggtaacgtacggtaacggttatttaaagttaccgtatacgggtaaagttacggttaagggtttntttaaagggttaccgtggtaacccgg

SEQ ID NO: 93310 - DNA, 870 bp, Homo sapiens
  misc_feature: GYAE6OF01D9021.34.71.G05.1.454.CMB.1.raw
  modified_base (258)..(258): a, c, t, g, unknown or other
  misc_feature (258)..(258): n is a, c, g, or t
tcagtacacgtgatcacgaccggtgctcgatttagtgtcgtcgcaagagagaggggacccaacaaccacacccctcctaagaagaacgcccctagaccacagcctccacaccatggactggacctggaggatccttcttcgttgggtggcagcagacaacgaggtcgcccacctcccgaggtgacagtcgtggtcgactaatcggtgggtctggtagttaggaagacgccggtgggcctgaggtagtaacggtttccngactacgtccgttcgtaggactacctaccttacacctagtactagtcgactagtcggcgttaggttcggggtacgccggtacgaccgggtccccgtaagggtaccggagggtccgtttgggacggtaggtaggtagggtagttaggaacctaccaaacccgaccaacggtacccggtaaccggtaaacccgtaacgtacggacccggtcccggacggttacctacggtaccggtaacgggtttacggttttacgttccgtttcccgttccggttacccggaccgttaacccttccgtaccgtacggtaccgtaccgtaccgtataaccgttactccgtaacgacgtaaccgtacgtaccgaacgtaccgtaaccgtaacgttaaccgggcggtacgtaacgggtacccgtaaccgttcccggttacggttacccgtttaggttaaaccgtttacgggtccgggtaacggttaaacgggtaaccgggtttaacggttaacccgttttaaacgtttaacggtaacggtttaacgggttaaaggggttttaaaccgggtttaaaggggggtttaaatttttaaacgggttacggtttaaccgggtttaaccgggg

SEQ ID NO: 93311 - DNA, 639 bp, Homo sapiens
  misc_feature: GYAE6OF01CT9VP.34.71.G05.1.454.CMB.1.raw
  modified_base (490)..(490): a, c, t, g, unknown or other
  misc_feature (490)..(490): n is a, c, g, or t
  modified_base (580)..(580): a, c, t, g, unknown or other
  misc_feature (580)..(580): n is a, c, g, or t
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccaggtgcagctggtgcaatcgtgggtctgagttgaaagagccgtcgggctcagtagtaacggtttcctgactaacgccttacgtaggtactaacctaccttcaactagactaacgtgacttagtgtactagtttgggacgaccgacgaccggcccgtaggacgaaggtctaggaggtaggagtgggatagactacgaaaccaccgaacgacgtacggaaacccaagtactcgccgtaggtctacgacgtaggtacgtttctcttcgtcgtacggactcctcgtgtacacgtcgaacgtctaattcacgtcgacgtagtacganacggacaccgttacgtaagttcggacgttaggaaccgtcgtaccggttcgaccgttatagttaacgcggtacggacggtaggttaacgtntttaacgtagtagtaggtaagtaacggttaagtttacgtttattaacgtggttaaacgg

SEQ ID NO: 93312 - DNA, 656 bp, Homo sapiens
  misc_feature: GYAE6OF01ELZLL.34.71.G05.1.454.CMB.1.raw
  modified_base (290)..(290): a, c, t, g, unknown or other
  misc_feature (290)..(290): n is a, c, g, or t
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccgaggtgcagcgtggtgcaatcgtgggtctgagttgaagaagccgtggggcctgagtgtaacggtttcctgacaacgtccttcgtggactaccaccttcactagctatgctatgctagttggngccgacgaccggcccgtggacgaagggtcttaggaggtggagtgggatggactaccgaaacaaccgaacgacggtaaccggaaaccctaagtacgtcggaacccgtagggtccttacgacgtacgggttacgtttcgttccttccgttacgttcgacctctcgtcgtcgacgcgacgtctattactctgacagtactacgacgacgtacgacctaaggtcggaccgtagaccggtacctacggttcgtaccgttagtttaacgttcgtacggtacggtcggtaagggtaccgttacgtttaagttacgttaagtagtaaaggtttaggttaaacggttaggttttaacttaggtggtttaaacggg

SEQ ID NO: 93313 - DNA, 856 bp, Homo sapiens
  misc_feature: GYAE6OF01CYQRL.34.71.G05.1.454.CMB.1.raw
  modified_base (221)..(221): a, c, t, g, unknown or other
  misc_feature (221)..(221): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtcgcccactccccgaggtgcagctggtgacatctgggtctggagttgaagagcctggggcctnagtgtacggtttcctagctaacgcctttcgtcggtataaccacctttccgactagccttagtgtaccttagtcgtaccttaggttcggggtacgtaccggaccgtaccggtccccggtacggggaacgaacggggttcgttacgggtaaggtggggtaaggttggggaattacggggtaacctaaccgaaaccgaaccccgtaaaccggtaccggtaaccgggttaaaccccggtaacgtaacgttcggacccgtacggggtactaccgtaaccggtacgggttaccgggttttcgtaccgtttacccggttaccgtttacggacccgttaacccgttccgttaccggtaccgacggtaccccggtacgggtccttaacgttaactcccggttacgcgtaacggttacgaccgaacggtacccggaacggttaaccgttaacgtcgggtaaccggtaacggtaccgggaccgttaccgttaccggtaacccgttacggttaaaccgtacccgttgggtaaccgggttccgggaaacgtacggttaacccgttttaacgttaaccgttagggtttaaaccgtaaggtttaaagggtagttttaacggttaaatttcgggttaaggtttaaaccggg

SEQ ID NO: 93314 - DNA, 865 bp, Homo sapiens
  misc_feature: GYAE6OF01AFROA.34.71.G05.1.454.CMB.1.raw
  modified_base (652)..(652): a, c, t, g, unknown or other
  misc_feature (652)..(652): n is a, c, g, or t
  modified_base (780)..(780): a, c, t, g, unknown or other
  misc_feature (780)..(780): n is a, c, g, or t
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagacaaacgaggtcgccccactcccgaggtagccagcgtggtgcaagtcgtgggtctgtagttagaagacgcggtcgggcctcgtaggtaggtaacggtttcctggacctaagtccttcgtaggaactacctaccttacaccgtacgtctagtgtctatcgtacgttaggttcgggtcgaccgtaccgaccggtaccccggtaggggaacggtaacgggtcggttacggtaggggtagggtacggtaggggtaacgtagggtaacgtaacccgaaacccaaaccggtaaacccgtaaccgggtaaacccggggtaaaaccccgtaaaccgggttacggtacccggtaaccccgggtaacggttaccccggttaacggtaaaccgggttaacccggggtttaacgggttttcggtttacccccgttttaccgttccccgggttaccggtacccgtttaccccgtcggttaaccccggttcgaaccccgggacgtaaacccgggtnttaaccgttacgttaccggtacgtacccgtaaaggtaccttaccgtaccgaacccgtaacgttaacccgttaagggtcgtaccgtaaggcccgtaaggtccgtacgggtcgtttaactaggttccggntaccgggacgtaacgttacggttacttaaggttacgttacgagttacggttaggttagttagtttacgcggttaggttaaccggg

SEQ ID NO: 93315 - DNA, 752 bp, Homo sapiens
  misc_feature: GYAE6OF01CLLXR.34.71.G05.1.454.CMB.1.raw
  modified_base (161)..(161): a, c, t, g, unknown or other
  misc_feature (161)..(161): n is a, c, g, or t
  modified_base (177)..(177): a, c, t, g, unknown or other
  misc_feature (177)..(177): n is a, c, g, or t
  modified_base (621)..(621): a, c, t, g, unknown or other
  misc_feature (621)..(621): n is a, c, g, or t
tcagtacacgtgatcacgaccggtgctcgatttagtgtcgtcgcaagagagagggggacccaacaaccacacccctcctaagaagaacgcccctagaccacagcctccacaccatggactggacctggagatcctcttctggtgcagcagcaacgaggtcncccactcccgaggtcnctagcgtggcgactagtcggtggtctaggtagttagaaagacgccggtcgggcctcgagttacggtacgtttccgagactacgtccgttagtacggactacctaccttacgtacgtagtactagtcgtactagtacgcgttacgggttcgggaccgccggaaccggtccggtaccccggtaggggtaaaccggtaggttcgtaagggtagggtacggtaagggttaggacgtaacggtaacctaaccccgaaaacgttaccggaaacccgttaacgggaaccccggtaaaacacggtactacccgggaccgtacggtaccctaccggaggttacggtttccgttacgttcccttaggtcctacgggtacctccgtgtaccgcgacctacgagtactagtactggtacgaacgtgaccgcgtacggaccttaagtcggttacggngtacggaccgttaacgccgttacggtacgttatacgtaagtcggtcgtaagtcgtaagttccttaagacgtttagaaccggttaattaggtaacgggttttataacgtagggttgtaacccggtttagggg

SEQ ID NO: 93316 - DNA, 999 bp, Homo sapiens
  misc_feature: GYAE6OF01B8DPK.34.71.G05.1.454.CMB.1.raw
  modified_base (755)..(755): a, c, t, g, unknown or other
  misc_feature (755)..(755): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttgggtggcagcagcaacgaggtcgcccactcccgaggtcgcgagtctggtgactaagtcgtgggtcgtggtagttaggaacggtaacgccggtcggggtcctaccgtagggttaggttaaacggtttccgtagacgtaaaccgtccgttacgtaggtactacctaccgttactaactacgtacttacgtacgtacgttaacgtcgtaccgttaaggtttcggggaccggtaccggaaccggtaccccggggtcccggtaacggggtaacggaacgggttccgtttagggacggttagggtacgggttagggtacgttacgggaacctaaccgaaaaccgtaaccgaaaccggaacggtttaaacccgggggaaaccctaacggttaaccgacccgggtaccggtaacggggttacccttaacggaaccggtttaacggggtttaccggtttttacggtttaccccgtttaccgtttacccggttaccgggtaacccctttaacccggttacgtacccggtttaacgaaccgggtacccggttaaaccggtactttaaaccggttacgtttacccggacgtaaaccggttaccgtaaacgttacccgggttaaaacncccggttaaaccgttaccgggtttaaggtacccggtaccggtaacgggaaaccggttccttaccggggttaaccggttttaaccggtacgttttaaccgggttttaacggaacgggttacggtaaaccggtaccgggtttaaacgtttaacgttaaccggtttaaaggttaacgtaacggtttaaaggttaaaccgggtttaagtttaacgggtttaacgttaggttaaccgggttaaacgggg

SEQ ID NO: 93317 - DNA, 799 bp, Homo sapiens
  misc_feature: GYAE6OF01AWFU6.34.71.G05.1.454.CMB.1.raw
  modified_base (669)..(669): a, c, t, g, unknown or other
  misc_feature (669)..(669): n is a, c, g, or t
  modified_base (678)..(678): a, c, t, g, unknown or other
  misc_feature (678)..(678): n is a, c, g, or t
  modified_base (722)..(722): a, c, t, g, unknown or other
  misc_feature (722)..(722): n is a, c, g, or t
  modified_base (731)..(731): a, c, t, g, unknown or other
  misc_feature (731)..(731): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttgggtggcagcagcaacgaggtcgccctacctacccgaggtgacgagtccgtggtcgactagttccgtggtctagtagttaggaaagacgtccggtcgggtcctagtacggtaggttaacggtttccgtagtaccgtaacgtcccgtttcgtacggtaacctacccttaccgttactaacgtacgtacgttagtacggtacttacgtcggtagttacggtttgggaccgtacccggaaccggtaccccgggtacccggtacgggtaacggtagggttcggttacggtaagggtacgggtaacgggtagggtacgtaacgggtaacctaaccgtaacccgaaaccgtaaaccggtaaccggtaaaccgggaaaccctaagttaccggaccggtacccggaaggtttacccaacggtaacgggttacggttaacggttttcccgttaccgtaccgttccgtaccgtaacccgttcgtacggtctacccggtagtaccgtaagtacgttacttacgcgttaacgcgttaaacncgttaaccncgtaactcgtagtacgtcgagacgtcgtactcgtacgtacgttncggttacgnacggttaggcgtacttagaacttgtagaacgttagtacggttaagtcggtttaagtgtcggttaacgg

SEQ ID NO: 93318 - DNA, 830 bp, Homo sapiens
  misc_feature: GYAE6OF01B0U8G.34.71.G05.1.454.CMB.1.raw
  modified_base (177)..(177): a, c, t, g, unknown or other
  misc_feature (177)..(177): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggactcctcttcttggtggcagcagcaacaggtgcccactcccgaggtancagctggtgcaatctgggtctgtagttgaagaagcccgtggggtcctacgaggttggtaacggtttccgtgaccgtaacgtcccgtttacgtagggtacttaaccctaccgtttacgaccgttacgtaccttataggtccttaagtcgacctaaggtttcggggtcgaccggaaccgaccggtaccccccgttagggaaccggtaaacggggtcctttaggggaggttacggggtaggtagggggttaccgtacgggtaatacccgtaaaaccgtaaaccctaaaccgtaaccgggtaaccggggaaaccccgaaaccggtttaacgtaccggacccgtacgggtaccttaccgaacggtacggggtttaacgggttttcgttaactttcccgtaccggttcggacccttaccgttccgttacgaccacggtacccgtaacggacttaacgttacttacgtcgaccgatacgtaccgaacgacgtacgtaccgtaagtacggtacgtaggaccgtacgtaccgtacggcgtttagttactacccggttagtaccggtacggtaaccgtggtttaccgttaacgttcgtaaccgttaggtaaacgttaacggttacggtttaaggtttaccttaaaggttccggtttaaaccgg

SEQ ID NO: 93319 - DNA, 782 bp, Homo sapiens
  misc_feature: GYAE6OF01DFZOP.34.71.G05.1.454.CMB.1.raw
tcagtacacgtgatcacgaccggtgctcgatttagtgtcgtcgcaagagagagggggacccaacaaccacacccctctaagaagaagcccctagaccacagctccacaccatggactggacctggaggatcctctttcttgggtggcagcagcaacgaggtcgaccccacctcccgaggtcgacagcgtggtgctagtcgtgggtctggtagttagaacgaacggtccggtcggggccctagacggttaggtaacggttttccgacgaccgtaacgtccgttacgtaggtaactacccttacctttacgaacttacgtactatcgtaccttaagtgtacgttaggtttcgggaccgaccggaaccgaccggtacccgtacgggaacggtacgggttcgtaggagggttaggtagtagggtatacggaaccgtaccaaccgaaccggtaacacggtaaccgggaaacctaacgtacgtccggaccgtacggtacctacggaacggttacggttctttacggttcccgttactccgtaacgcctacgtcgtacgccgacgtcgaagtcctagtactcgtacgacgtaactacgtcacggtaccacgttaaccgagtccgggtaacctacgggactaccggtacgtaccggttacggttactttaaccgtggttaccggcgggtaacggaacggtttacgtaacgtttaacgttacgtaaggttaaaggttacggttaaagtttacgggttagttttacccggttaagacccggttttaacgggg

SEQ ID NO: 93320 - DNA, 505 bp, Homo sapiens
  misc_feature: GYAE6OF02I89XT.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacaggcccctggacaagggcttgagtggatgggatggatcgaacaccaacactgggaacccaagtatgccagggcttcacaggacgtttgtcttctccttggacacctctgtcagcacggcatatctgcagatcagcagcctaatggctgaggacacgtgccgtgtattactgtcgacgagaggtcttagtactagtgaataggagttaggtattagtgtaacg

SEQ ID NO: 93321 - DNA, 497 bp, Homo sapiens
  misc_feature: GYAE6OF02HZLM2.34.71.G05.1.454.CMB.1.raw
  modified_base (443)..(443): a, c, t, g, unknown or other
  misc_feature (443)..(443): n is a, c, g, or t
  modified_base (450)..(450): a, c, t, g, unknown or other
  misc_feature (450)..(450): n is a, c, g, or t
  modified_base (458)..(458): a, c, t, g, unknown or other
  misc_feature (458)..(458): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacaggcccctggacaagggcttgagtggatgggatggatcaacaccaacactgggaacccaacgtatgcccagggcttcacaggacgtttgctttctcttggacacctctgtcagcacggcatatctgcagatcagcagcctaatgctgagacactgccgtntattacngtgcgagnggtctagtactatgatagaagttggttaattatgtaacg

SEQ ID NO: 93322 - DNA, 537 bp, Homo sapiens
  misc_feature: GYAE6OF02JPCFQ.34.71.G05.1.454.CMB.1.raw
  modified_base (296)..(296): a, c, t, g, unknown or other
  misc_feature (296)..(296): n is a, c, g, or t
  modified_base (409)..(409): a, c, t, g, unknown or other
  misc_feature (409)..(409): n is a, c, g, or t
tcagtacacgtgatcacgaccggtgctcgatttagtgtcgtcgcaagagagagggggctgggcctcaggaagcagcatcgggggtgcctcagccatggcatggatccctcctcttcctcggcgtccttgcttactgcacaggatccgtggcctcctatgagctgactcagccaccctcagtgtccgtcgtccccaggacagacagccagcatcacctgctctggagataaagttggggataaatatgcttgctggtatcagcagaagccaggccagtccctgtgctggtcatctanacagatagacaagccgcctcgagggactcctgagcgtattctcgtcggcctaccaacgtcgtagggaaccacacgccactctacgaccatcgacggaccggacccaggctagnggagtggacggctagtactacttacgtgtcgaagggcgtacgggacagaccgaacggtagtggtacggtcgggacggaacgggaccgaagtcgtacggaccgtaccgtacggacgacgcccgtaacgg

SEQ ID NO: 93323 - DNA, 504 bp, Homo sapiens
  misc_feature: GYAE6OF02IT8TP.34.71.G05.1.454.CMB.1.raw
  modified_base (469)..(469): a, c, t, g, unknown or other
  misc_feature (469)..(469): n is a, c, g, or t
tcagtacacgtgatcacgaccggtgctcgatttagtgtcgtcgcaagagagaggggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacaggcccctggacaagggcttgagtggatgggatggatcaacaccaacactcgggaacccaacgtatcgcccagggcttcacaggacggtttgtcttctccttggactacctctgtcagcacggcatatctgcagatcagcagcctaagtggctgagacactgccgtgtacttacgtgtgcggagnggtctattactatgatagagttgttattatgtacg

SEQ ID NO: 93324 - DNA, 531 bp, Homo sapiens
  misc_feature: GYAE6OF02HZ1GZ.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacaggcccctggacaaggggcttgagtggatggggatgggatcaacaccaacactgggaaacccaacgtatcgcccagggcttcacaggacgtttgtcctttctcctttgggactacctctgtcagcacggcatatctgcagattcagcagcctaatgggctgaggacacgtgccgttagtacttactgtgcgtaggaggtcttaattactagttgagtaaggtaagttaggtttaatttagtgttaacg

SEQ ID NO: 93325 - DNA, 498 bp, Homo sapiens
  misc_feature: GYAE6OF02G1YFM.34.71.G05.1.454.CMB.1.raw
  modified_base (444)..(444): a, c, t, g, unknown or other
  misc_feature (444)..(444): n is a, c, g, or t
  modified_base (451)..(451): a, c, t, g, unknown or other
  misc_feature (451)..(451): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacaggcccctggacaagggcttgagtggatgggatggatcaacaccaacactgggaacccaagtatgccagggcttcacaggacgtttgtcttctccttggacacctctgtcagcacggcatatctgcagatcagcagcctaatgctgaggacacgtgccgtntattacngtgcgagaggcttattactatgattagaagttggttattatgtaacg

SEQ ID NO: 93326 - DNA, 693 bp, Homo sapiens
  misc_feature: GYAE6OF02IF04Q.34.71.G05.1.454.CMB.1.raw
  modified_base (311)..(311): a, c, t, g, unknown or other
  misc_feature (311)..(311): n is a, c, g, or t
tcagtacacgtgatcacgaccggtgctcgatttagtgtcgtcgcaagagagagggggctgggcctcaggaagcagcatcggaggtgcctcagccatggcatggatccctctcttcctcggcgtccttgcttactgcacaggatccgtggcctcctatgagctgactcagccaccctcagtgtccgtgtccccgagggaccagacaggccagcatcacctgctctggagataaacgtgggggataaatatgcttgctggtatcagcagaagccaggcccacgtcccctgtcgcgtggtcaagtctatcaagntacgacaagccggacctcgaacgggacttccccgtaggacgtacgagttctccgtacgggtccttacccgaaaccgttccgtaacggggaacctaccgaacggtacccaaccgttcgttaccggtaacccacgttaccgaaccggcccggggaacccgtaaggtacccgttaaggttacgggaacgttacggacgggtaccgttacgtaaccggttaatttaccggttacggttacccgtaagggtccggggttaagggaaccgacgggtaccggaaccggttaggttacggggttaacgtttcggggaccgggtaagggacccgtaaacgggcgttacgggaacccgttcccggtaacgggttaccgacggtaaccccggg

SEQ ID NO: 93327 - DNA, 531 bp, Homo sapiens
  misc_feature: GYAE6OF02IXRI0.34.71.G05.1.454.CMB.1.raw
  modified_base (245)..(245): a, c, t, g, unknown or other
  misc_feature (245)..(245): n is a, c, g, or t
  modified_base (424)..(424): a, c, t, g, unknown or other
  misc_feature (424)..(424): n is a, c, g, or t
  modified_base (477)..(477): a, c, t, g, unknown or other
  misc_feature (477)..(477): n is a, c, g, or t
  modified_base (525)..(525): a, c, t, g, unknown or other
  misc_feature (525)..(525): n is a, c, g, or t
tcagtacacgtgatcacgaccggtgctcgatttagtgtcgtcgcaagagagagggggacccgaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctgggggcctcagtgaaggtttcctgcaagccttcnggatacaccttcactagctatgctatgcattggggtgcgacaggccccctggacaagggcttggagtggatgggatgggatcaacaccaaccacgtgggaacccaacgtactgccccaggggcttcgaacaggtacggtttgtcttctccttggacacctctgtcagcacggcatatcngcagatcagcagcctaatggctgagacgactcgccgtgtacttacgtgtcggngaggtaggtcttattactaacgtgtaataggtagttggtttaagttanggtacg

SEQ ID NO: 93328 - DNA, 574 bp, Homo sapiens
  misc_feature: GYAE6OF02J2DMY.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacacggcccctggacaagggtcttgagtggatgggatggatcaacaccaacacgtcgggaacccaaggtatcgcccagggcttcgaacgagggtacgtttgtctttcgtccgtttaggacctaccttctcgtcacgcacggcatatctgcagactcgacgcacgccttaagtcggactagacgaccacgttcggccgttagtagtttacgtggttgaccggtaggcgggttacttagttactagtacgtaagttaacgggtaagtttacggtttaatttagtacggttaacgg

SEQ ID NO: 93329 - DNA, 519 bp, Homo sapiens
  misc_feature: GYAE6OF02IKHWI.34.71.G05.1.454.CMB.1.raw
  modified_base (431)..(431): a, c, t, g, unknown or other
  misc_feature (431)..(431): n is a, c, g, or t
tcagtacacgtgatcacgaccggtgctcgatttagtgtcgtcgcaagagagagggggacccaacaaccacacccctcctaagaagaagccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacaggcccctggacaagggcttgagtggatgggatggatcaacacaacacgtcggaacccaacgtatcgacccagggcttcacgaggtacgtttgtcttctccttggactcctctgtcagcacggcatatctgcagatcagcagcctaagnggactgacgactacgtcgtccgtagttacttacgtgtgacgagaggtctaagttacagtagataggaagttggttaattagtgtaacg

SEQ ID NO: 93330 - DNA, 238 bp, Homo sapiens
  misc_feature: GYAE6OF02IK03O.34.71.G05.1.454.CMB.1.raw
  modified_base (234)..(238): a, c, t, g, unknown or other
  misc_feature (234)..(238): n is a, c, g, or t
tcagtacacgtgatcacgaccggtgctcgatttagtgtcgtcgcaagagagaggggggtgccaggggaagaccgatgggccctggtcaccgtctcctcagcctccaccaaggcccatcggtcttccccctggcaccctcctccaagagcacctctgggggcacagcggccctgggctgcctggtcaaggactacttccatcacgtgtactgagcgggctggcaaggcgcatagnnnnn

SEQ ID NO: 93331 - DNA, 558 bp, Homo sapiens
  misc_feature: GYAE6OF02HWSO3.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagccgtggggcctcagtgaaggtttcctgcaagccttctggatacaccttcactagctatgctatgcagttgggtgcgacgacggccccgtggacaaggggcttggagtggatgggatggatcaacaccaacacgtacgggaaacccaagtactcgccagggcttacgacgacggtacggttttgtcttcgttccgttggacctaccgtctgtccagcacggctatctcgtgcaagatcgacgcacgcctaagtggctaggacgactacgtgccgtagtattacgtgtacgcggaggtggtacttaagttactaagtgagttaggaaggtttaggtttaattagttagtaacg

SEQ ID NO: 93332 - DNA, 560 bp, Homo sapiens
  misc_feature: GYAE6OF02GXWGD.34.71.G05.1.454.CMB.1.raw
  modified_base (279)..(279): a, c, t, g, unknown or other
  misc_feature (279)..(279): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtncgacaggccctggacaaggcttgagtggatgggatggatcaacaccaacactgggaaacccaagtatcgacccgagggcttcgacgaggtacgtttgtcctttcgtcccgtttggacctaccttcgtcgtcagtccgacggctatactctgctagatcgagcagtcctaagtcggctaggacgactacgtcgcccgttgtaattacgtgtacgtcggtaggacggtcttattaactagttagtaagttaggtaagttagggtttaactttagtagttaacg

SEQ ID NO: 93333 - DNA, 546 bp, Homo sapiens
  misc_feature: GYAE6OF02GYYCU.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacacggcccctggacaagggcttggagtggatgggatggatcaacaccaacacgtagggaacccaagtactcgacccgagggccttacgacgtaggtacgtttgtccttctccgttggactaccgttctgtcagccgacggcatactctgcagatcagcagcctaagtggctagacgacacgtcgtccgtatattacgtgtcgcggagtacggtcttaagttactagtgtaagtaggtaagttaggtttaattagtagttaacgg

SEQ ID NO: 93334 - DNA, 663 bp, Homo sapiens
  misc_feature: GYAE6OF02HS8BF.34.71.G05.1.454.CMB.1.raw
  modified_base (223)..(223): a, c, t, g, unknown or other
  misc_feature (223)..(223): n is a, c, g, or t
tcagtacacgtgatcacgaccggtgctcgatttagtgtcgtcgcaagagagaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctgganataagttggggataatatgcttgctggtatcagacagaagccaggccacgtcccctggtgctggtcatctatcaagatagacaacgccggaccctcgacgggactaccccgtgagcgtattcgtcgtcggcctaccctaactccggtacggaaccaccacggaccctactcctacgaaccacttaccgaacggacccgggaacccgacgggtacctacggtacgggtaagtacggtacgggtactacggtaaccgttacgttaaccgttggttaccgacggggttccgggtaacgggaaccgtaacgggtaacccggtaaacccgggtaggttacgggttaacgggttaccggggtaacggggaaccggggtaaccgaacgggtaccgtaccgggtacccggttaacccggttacggtacccggtaaccggaaccccggg

SEQ ID NO: 93335 - DNA, 566 bp, Homo sapiens
  misc_feature: GYAE6OF02IB1OI.34.71.G05.1.454.CMB.1.raw
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcagttgggtgcgacgacggccctggacaagggcgttgagtggatgggatggatacaaccaccaacacgtagggaaacccaaggtactcgaccgagggcttcaacgtaggtacgtttgtcttcgtcctttggacctacctctgtcagcgacggcatatctgcagactcagcacgacctaagtcggactgacgtacacgttgaccgttgtaacttacgtgtacggacgtacggaggtacttaagttaacttagtagtacgttaaggtaacggtttaggtttaactttagtagttaacgg

SEQ ID NO: 93336 - DNA, 917 bp, Homo sapiens
  misc_feature: GYAE6OF02FTWAG.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggacgtcggaccgtggaggactccttctttcgttgggtggcagcagacaacgtaggtcgccccacctcccgagggtcgacgagtcgtggtgactaactcggttcgggttctaggtaggttaggaaaggaacggtccgggtcggggtccctacgtaggttaggttaacggtttcctgacgaacgtccttcgtaggtactaacctaccttacacgtacgtcttatcgtacttagtcgacttaggtttcgggggtcgaccggtaacggaccccgggtacccccgttaggggaaaccggtaaacggggttccgtttagggtaacgggttaggggaaggttacgggggaaggttaggggtaacctaaccgtaaaacccgaaaccccgtaaaaccgtaaccgggttaaacccggggaaaacccccgtaaacgggttaacgtacccgggaccccgggtaacggggttacccttaccggaaccgggtaacgggggttttaaccgggtttttcgtttacccgttttcccgttttacccgggtttacggggtaaccccttacccgtttccgtttacggtacccgaacggttcccgggaaccgggtacttaacgttaaccttccgtacggtaacctaggtaacgttccgaacggtacgtaccgtaaccgttaaaggtcgggtacgtacgggaacggtacctaccggttacggtacccggtttagtttacgttacgtgtacgggacgtagggtacgtactttaacgttacgtagttagtaagttaggtaaggttttagttaattagtagttaacgg

SEQ ID NO: 93337 - DNA, 532 bp, Homo sapiens
  misc_feature: GYAE6OF02JCA23.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacaggcccctggacagggcttgagtggatgggatggatcaacaccaacactggaacccaacgtatgcccagggctcacaggtacggtttgtcttctccttgactacctctgtcagcacggcatactctgcagatcagcagcctaagtggctgagacacgtcgccgtagttacttacgtggtgcggaggtacggtacttaacgttaacttagtagtagtacggtagttacggtttaatttagtagttaacgg

SEQ ID NO: 93338 - DNA, 597 bp, Homo sapiens
  misc_feature: GYAE6OF02JZMMF.34.71.G05.1.454.CMB.1.raw
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (434)..(434): a, c, t, g, unknown or other
  misc_feature (434)..(434): n is a, c, g, or t
  modified_base (466)..(466): a, c, t, g, unknown or other
  misc_feature (466)..(466): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagtccttcgtaggatacaccttcactagctangctatgcagttggtnacgacacggccctggacaagggcttgagtggatgggatggatcgaacaccaacacgtcgggaaccctaagtactcgcccgtagggtccttacgacgtaggtacgtttcgtctttcgtccgtttggacctacctcgtacgtcaacggcacggntactatctagctagctcacgcgagtcttaagnggacgtagacgacgtacgtcgtaccgttgttaacgttccgtaggtacgtcggtaacggtcggttacttacgttaacgtacgttaggtaacgtttaggtaaacgtttcgggtttaacttacgtgttaaccgg

SEQ ID NO: 93339 - DNA, 569 bp, Homo sapiens
  misc_feature: GYAE6OF02G0644.34.71.G05.1.454.CMB.1.raw
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacaggcccctggacaagggcttggagtggatgggatggatcaacaccaacactacgggaaacccaacgtatcggcccaaggggtccttcgaacgtacgggtacggttttgtcctttccgtccgtttggacctaccctctcgtcaggcacggcatactctgcagatcagcagcctaagtcggctaggacgactacgtcgccgttgtaactttcgtggtgccggtaggtacggtcctttaagttacttagttagacgttaaggtaaggttaggtttaatttagtgtaacgg

SEQ ID NO: 93340 - DNA, 638 bp, Homo sapiens
  misc_feature: GYAE6OF02HE3OP.34.71.G05.1.454.CMB.1.raw
  modified_base (283)..(283): a, c, t, g, unknown or other
  misc_feature (283)..(283): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagccgtggggcctcagtgaaggtttcctgcaagccttcgtggatacaccttcactagctatgctatgctagttgggtncgacacggcccctggacagggtcttgaggtggagtgggatggactacaaacaccaacacgtacggaaaccctaacggtactcggcccgtaagggtccttacgaacgtacggtacgtttcgtctttccgtccgtttacggacctaccgtcgtgtcgacgcctacggctattacgtcgtcgacgtacgtaacgtccgaacgaccgtacgtacccttaagtcggtaccgttaggaaccggtaacctcgttacggtccggttacgttaacgttaccgttagtcggtacggtacggtaacggttacttaacgttaactagtagtaagtaggtaagttaggtttaacttaggtagtaacgg

SEQ ID NO: 93341 - DNA, 609 bp, Homo sapiens
  misc_feature: GYAE6OF02IUVGH.34.71.G05.1.454.CMB.1.raw
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagctggggcctcagtgaaggtttcctgcaagccttctggatacaccttcactagctatgctatgcattgggtgcgacaggcccctggacaagggcttgagtggatgggatggatcgaacaccaacacgtggaaacccagtatgacccagggcttcacgaggacgtttgtccttcgtccttggacctacctctcgtacagccacggctagtatcgtgcgaagtactacacgcgacgtacctaaagtcgggtactaggaacggtaaccgtacgtacggtacccggttagttaacgtttaacgtggttacggacggtacgggtaacgggttacctttaagtttaaccttaagttacgtaaggttaacgggtaagtttagggttttaatttaggttacggttaaacggg

SEQ ID NO: 93342 - DNA, 634 bp, Homo sapiens
  misc_feature: GYAE6OF02HBTIK.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacaggcccctggacaagggcttggagtggatgggatgggatacaacaccaacacgtacggaacccaacgtatcgccgaggtctacacgaggtacggtttcgtcttcctccgttacggacctaccgttcgtcgtcgacgccgtacggactactacttccgtcgacgacgtactacgacgacgtacgtacccttaagcgggtacgttagggacggtaactaccgttcggtccggttagttaacgtttacgttaggtcggtacggaagggtccggttactttaacgtttaacgttacgttaggtaacgtttaacgggttaaggtttagggttttaacgtttaggttagttaaccgg

SEQ ID NO: 93343 - DNA, 590 bp, Homo sapiens
  misc_feature: GYAE6OF02IFQ1U.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacacggccctggacaagggcttggagtggatgggatggatcaacaccaacacgtagggaacccaacgtatcgcccgaggtcttacacgtacggtacgtttgtcttctccgtttcggacctcctcgtcgtcgagccgacggcatactcgtgcagtactcagcgacgtacctaagtcggtacgtaggacggtactacgtcgtccgttagttaactttacgtgtcggacggtacggtaggtacctttaagttaacgttagttaggtaacgttaaggttaaggtttaggtttaagtttacgtaggtttaacgg

SEQ ID NO: 93344 - DNA, 564 bp, Homo sapiens
  misc_feature: GYAE6OF02GE1UK.34.71.G05.1.454.CMB.1.raw
  modified_base (431)..(431): a, c, t, g, unknown or other
  misc_feature (431)..(431): n is a, c, g, or t
  modified_base (471)..(471): a, c, t, g, unknown or other
  misc_feature (471)..(471): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcagttgggtgcgacacggcccctggacgaagggcttgagtggatgggatggatcgaacaccaacacgtacggggaaacccaacgtatcgcccgagggtcttacgaacgagggtacggtttgtcctttcgtccgttggacctacctctgtcacgcacgcatntctgcagctcgagcacgtcctaagtcggacgtgacggacncgtcgccgttgttaattcgtgtcgacggaggtaggtacttaacgttacgtaataggtagtaggttaaggttaggtttatttacgtgttaacgg

SEQ ID NO: 93345 - DNA, 584 bp, Homo sapiens
  misc_feature: GYAE6OF02HH1A3.34.71.G05.1.454.CMB.1.raw
tcagtacacgtgatcacgaccggtgctcgatttagtgtcgtcgcaagagagagggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataattgggggataaatatgcttgctggtatcagcagaagccaggccagtcccctgtgctggtcatctatcaagatagcaagcggccctcgacgggactccccgtgacgcgaacttcctactcgggtcctaccaacttcgtacggggaaaccacgacggccctaactccgtacgaaccctactccgacggccgggaacccgagggccttaagcgggatcggacggtctagaacgttacttaacgttgtaccgagggtcgtagggacacggaccaaccggaggttcggtacggttaccggggacggaacgggaccgaaggtcgtacggacccggttaccgtaacgggtcacggtaccccgg

SEQ ID NO: 93346 - DNA, 560 bp, Homo sapiens
  misc_feature: GYAE6OF02HDVNM.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacaggcccctggacaagggcttgagtggatgggatggatcaacaccaacactgggaacccaagtaactgcccagggcttcacgaggtacgtttgtcttcgtccttggactacctctcgtcagcacgggcattatctgcagatcagcacgtcctaatggactagaggaccacgtgtacccggttgttaacttacgtcggtagacggaggtacggtaccttaagtttactaagttaggtacgttaaggtaaggttaggttttaagtttagtaggttaacgg

SEQ ID NO: 93347 - DNA, 594 bp, Homo sapiens
  misc_feature: GYAE6OF02F5D6G.34.71.G05.1.454.CMB.1.raw
  modified_base (433)..(433): a, c, t, g, unknown or other
  misc_feature (433)..(433): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacacggccctggacaagggcttgagtggatgggatggatcaacaccaacacgtacgggaacccaagtatcgacccgagggtcttacgacgagggtacggtttgtctttctccgtttaggacctacctctgtcagcacggctatatctgacanatcacgcacgacctaagtcggacttaggaacggacctacgtcgtaccgttagttaacttaccgtggttacggaccggtaagggtacggttaccttaaagtttaccgtaagttaggtaacgttaacgggtaaggtttaggtttaatttacgaggttaaccgg

SEQ ID NO: 93348 - DNA, 576 bp, Homo sapiens
  misc_feature: GYAE6OF02FWLUY.34.71.G05.1.454.CMB.1.raw
  modified_base (279)..(279): a, c, t, g, unknown or other
  misc_feature (279)..(279): n is a, c, g, or t
  modified_base (466)..(466): a, c, t, g, unknown or other
  misc_feature (466)..(466): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctgggggcctcagtgaaggtttcctgcaagccttctggatacaccttcactagctatgctatgcattgggngcgacaggcccctggacaagggcttgagtggatgggatggatcgaacaccaaacacgtacgggaaacccaacgtatcggacccgaaggggctttacgacgagggtaaccggttttgtccgttcctccgttggacctaccgttctcgtcacgcgacggctatactctgcagactcgagcacgcctaancggacttgacgactacgttgaccgttgttagttctggtagaccggtaggtacgtcttaagttaacttagtagtattaacggtaaggttagtttaattacgtagttaacgg

SEQ ID NO: 93349 - DNA, 641 bp, Homo sapiens
  misc_feature: GYAE6OF02ITLA0.34.71.G05.1.454.CMB.1.raw
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacacttcactagctatgctatgcattgggtgcgacgacggcccctgggacaaggggtcttggaggtggagtgggatggatcaacaccaaacgactacggggaaaccctaacgtagtcgacccgaagggtccttacgacgagggtaacggtttcgtccgttccgttccgtttcggacctaccctcgttcgtctaacggccgacggtcgaacttacgtcgtacggctaaggtactcaacgcacgacccttaaagtcggcttaggacgaattaccgtcgtaccgttgttaaccgttagtcggtacgtacgggaacggtggtacctttaaagtttaccgtaagttcggttaagttaacggttaaggtttaacgggtttattttacggtagttaaccggg

SEQ ID NO: 93350 - DNA, 620 bp, Homo sapiens
  misc_feature: GYAE6OF02HZ8WU.34.71.G05.1.454.CMB.1.raw
  modified_base (256)..(256): a, c, t, g, unknown or other
  misc_feature (256)..(256): n is a, c, g, or t
  modified_base (547)..(547): a, c, t, g, unknown or other
  misc_feature (547)..(547): n is a, c, g, or t
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagccgtggggcctcagtgaaggtttcctgcaagtccttgtggatacaccttnactagctatcgctatgcagttgggtgcgacacggccccgtggacgaagggtcttaggaggtggagtgggatggaactacgaacaaccaacgacgtacggggaaacccaagtatccggaccgtagggtccttacgaacgtacgggtaacggttttgtcctttccgttccgttacggacctacgttcgtggtaccagtccgacggctactactcgtgacgtagtactcgacgacacgtacttaagtcggtactaggtaacgacctaacgtcgtaccgttagttaacgttacgnggtcgtacggaggtaacgttcttacgttaacgtagtgtaacgtaggtaagtttagtttattagtagttaacgg

SEQ ID NO: 93351 - DNA, 560 bp, Homo sapiens
  misc_feature: GYAE6OF02IN14R.34.71.G05.1.454.CMB.1.raw
  modified_base (250)..(250): a, c, t, g, unknown or other
  misc_feature (250)..(250): n is a, c, g, or t
  modified_base (333)..(333): a, c, t, g, unknown or other
  misc_feature (333)..(333): n is a, c, g, or t
  modified_base (376)..(376): a, c, t, g, unknown or other
  misc_feature (376)..(376): n is a, c, g, or t
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagccgtggggcctcagtgaaggtttcctgcaagccttctggatacnccttcactagctatgctatgcagttgggtgcgacaggcccctggacaagggtcttggagtggatgggatggatcaacaccaanacgtaggaacccaagtactcgccgaggctcgacaggacgtttntcttctcgttcggactcctctgtcagcgacggctactactctgacagtactcagcagacctaagtcggctagacgacacgtcgcgttagttaacttacgtggtgacggtaggtacggtacttaagttaacgtaagttaggtaattaaggttaagggtttagttttaagtttagtacgttaacgg

SEQ ID NO: 93352 - DNA, 609 bp, Homo sapiens
  misc_feature: GYAE6OF02JJTMM.34.71.G05.1.454.CMB.1.raw
tcagtacacgtgatcacgaccggtgctcgatttagtgtcgtcgcaagagagagggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaagtgggggataaatatgcttgctggtatcagcagaagccaggccacgtccctgtgctggtcatctatcaagatagacacgccggccctgacggactcccgtagacgcgtacttctacgtcggtcctacccgtaacgttcgtacggggaaccaccgtacgaccctacctacgtaccgtaaccacgttaccgacggacccgggtaacccgagggtacctaacggtcggagtcgggacggtcgtacggtaacttagttccgtaggtaccgagggtccggtaggaaccgaggtaccgaccggtaggtacggttacggttacggggacggtacggaccgtaaggaccgtcggtacccgttaccggtacggtccgaccggtacccgg

SEQ ID NO: 93353 - DNA, 572 bp, Homo sapiens
  misc_feature: GYAE6OF02J0H01.34.71.G05.1.454.CMB.1.raw
  modified_base (269)..(269): a, c, t, g, unknown or other
  misc_feature (269)..(269): n is a, c, g, or t
  modified_base (454)..(454): a, c, t, g, unknown or other
  misc_feature (454)..(454): n is a, c, g, or t
  modified_base (473)..(473): a, c, t, g, unknown or other
  misc_feature (473)..(473): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctangcattgggtgcgacaggcccctggacaaggcttgagtggatgggatgggatacaacgaaccaacgacgtagggaaaccccaacggtatcgacccaaggggtcttacgaacgacggtacggtttcgtacctttcgtaccgtttgggacctaccctctagtccaggccacggcctatactctgcagntcgagcagcctaatcggcngacgacactcgccgttagtattactgtacgacgaggtacgtacttattaactacgttagaagttaacggaggtttaggtttaactttagtagttaacgg

SEQ ID NO: 93354 - DNA, 643 bp, Homo sapiens
  misc_feature: GYAE6OF02J1YLX.34.71.G05.1.454.CMB.1.raw
  modified_base (468)..(468): a, c, t, g, unknown or other
  misc_feature (468)..(468): n is a, c, g, or t
  modified_base (474)..(474): a, c, t, g, unknown or other
  misc_feature (474)..(474): n is a, c, g, or t
  modified_base (485)..(485): a, c, t, g, unknown or other
  misc_feature (485)..(485): n is a, c, g, or t
  modified_base (505)..(505): a, c, t, g, unknown or other
  misc_feature (505)..(505): n is a, c, g, or t
  modified_base (560)..(560): a, c, t, g, unknown or other
  misc_feature (560)..(560): n is a, c, g, or t
tcagtacacgtgatcacgaccggtgctcgatttagtgtcgtcgcaagagagagggggaccgaacaaccacacccctcctaacgaagaagcccacgaccacagctccacaccactggactggacctggaggatcctcttcttggtggcagcagcaacaggtgcccactcccaggtgccagctggtgcaatctgggtctgagttgaagacgcctggggcctgagtgtaggtttcctgcaacgccttctggatactaccttcactagctagtgtctattgctaggttggggtgaccgacgcggtccccgtagggacgaaggcgtttgaaggttggacgtggggtaacttgggaactcgaaacctacaaccgacggtacggggaaaccccaagttaaccgtcgcccgagggtcttaccacgtacgggtacggttttcgacctttcaccgtttggaacctcctcgtcgtaccnggaccnggactatcgtntcggcaaggtcacaggcacnccgttaagcggcttggaacgccgtactccggtcgttactaagttaccttagggcncggtacgtacggttacctaatttaacgggtctaagtaccggtttaagtaaggttttaccggtttattacggtagtttaacggg

SEQ ID NO: 93355 - DNA, 702 bp, Homo sapiens
  misc_feature: GYAE6OF02HLJFQ.34.71.G05.1.454.CMB.1.raw
  modified_base (277)..(277): a, c, t, g, unknown or other
  misc_feature (277)..(277): n is a, c, g, or t
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaggtttcctgcaagccttctggatacaccttcactagctatgctatgcattgggtncgacacggccctaggacgaacgggtctggaggtggagtgggatggactacaacaccaacgacgtacggggaaaccctaacggtactcgacccgtagggtccttcaacggtacgggtaccggttttcgtcctttccgtccgtttcggacctaccgtcgttacgtacacggtaccgaccggtctattacgttcgtcgacgtacgtactacgacgacaacgtacccgttaaggtcgggtaccgttagggaaccgtaccgtaccggttacggtcccggttacggtttaaactttaccgggtgttaccgggtaccggtaacgggtacggggttacctttaacgttttaacggtaaccgttaagggtaacggtttaacgggtaaagggttttacggggttttaaacgttttacggtaacggtttaaccggg

SEQ ID NO: 93356 - DNA, 653 bp, Homo sapiens
  misc_feature: GYAE6OF02F0DEK.34.71.G05.1.454.CMB.1.raw
tcagtacacgtgatcacgaccggtgctcgatttagtgtcgtcgcaagagagaggggctgggcctcaggaagcagcatcggaggtgcctcagccatggcatggatccctctcttcctcggcgtccttgcttactgcacaggatccgtggcctcctatgagctgactcagccaccctcagtgtccgtgtcccaggacagacagccagcatcacctagctctggagataaagttgggggataaatatgtcttgctaggttatcgagcaagacgccaggccacgtccccgtgtcgacgtggtcagtctatactaagatagacgaagccggtcccgtacgacgggtactccccgtaggacgtacgtacttctacgtcgggtccctacccgtaaaccgtccgttacggggaaaccaccgtaacggccctaaccgttcgtacgaaccctaagttcccgaacggtacccggggaacccacgggacttaacggtgggaacgttggaacgggtctaggttacttaacgtttacgtacggtacgtacgggcgtagggtaaccagggtaacccgtaacggtaggtaggttacggttacccgggacggggtaccggaaccgtaacggcgtacggtacccgtacgtacggtaccacccgtaacccgg

SEQ ID NO: 93357 - DNA, 651 bp, Homo sapiens
  misc_feature: GYAE6OF02HOIRU.34.71.G05.1.454.CMB.1.raw
  modified_base (452)..(452): a, c, t, g, unknown or other
  misc_feature (452)..(452): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacaggcccctggaccaagggcttggagtggatgggatggatcgaacaaccaacacgtacgggaaacccaacgtatgacccagggccttcacgtacgggtaccggtttgttccgtttcctccgttttagggaacctacccgttcgttcggttccaacggccgtaaccgggtnaacgttacttccgtcggactaaggacttaccgagacccaagtacccttaaagttcgggacgttacggaacggaacctaccgtacggtcccgttaagttaacgttttacgtacggtacgtacggaacggtacggtacctttaagttacttaacgtagtaacttaagggtaaggtttaggtttaattaggtacgttaacgg

SEQ ID NO: 93358 - DNA, 775 bp, Homo sapiens
  misc_feature: GYAE6OF02HUW8A.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagagcctggggcctcagtgaaggtttcctgcaagccttctggatacaccttcactagctatgctatgctagttggggtgccgacgacgggcccccgttagggaaccgaaggggtcctttagggacggttagggaagtggggaattgggaacttaccgaaacctaacccaaactaccgtacggggaaacccctaacggtacgtccgacccggtagggtcctttacgaacgtacgggttacggttttcgtaccgtttccttacccgtttacggtaaccctacccgttccttacggtaccgtaacggtacccgtaccgggtactaagttacgtttaccgtcgaccgtaaggtaccttaccgaacgtaccgtaacgtacccgttaaaggtcgggtaccgtacgggaacggtaaccgtaccgttaccggttacccgggttacgtttaacgtttaccgttcggtacggtaccggtaagggtaacgggttacctttaaacgtttaaccgttaaggttacggtaacgttaacgggtaaagggttttacggtttaaacgttttaggtacggtttaaaccggg

SEQ ID NO: 93359 - DNA, 623 bp, Homo sapiens
  misc_feature: GYAE6OF02HOXNK.34.71.G05.1.454.CMB.1.raw
  modified_base (359)..(359): a, c, t, g, unknown or other
  misc_feature (359)..(359): n is a, c, g, or t
tcagtacacgtgatcacgaccggtgctcgatttagtgtcgtcgcaagagagagggggacccaacaaccacaccctcctaagaagaagcccctagaccacagctccacaccatggactggacctggaggatcctcttcttggtggcagcagcaacaggtagcccactcccaggtgcagctggtgcaatctgggtctgagttgaagaagcctggggcctcagtgaagtttcctgcaagtccttctggatacgaccttcactagctatgctatgctagttgggtgcgacacggccctaggaacgagggtcttggagtggagtgggatgatacaaacaccaacacgtacggaaccaacgtacngacccgaggtcttacacgtacgtacggtttcgtctttccgtcgttacggacctacgtctacgtcaacgcgacggactaactactctgacgagtatacgtagactacgtacctaagtggtacgtacggtaacgacctagtcgtaccgtagttaaccgtttacgtcggtacggtaacggtacgggtaaacggttctttaacgttaaccgttagttaacggtaggttaaggtaacgggttttagtttaactttagtcggttaaacgg

SEQ ID NO: 93360 - DNA, 698 bp, Homo sapiens
  misc_feature: GYAE6OF02G6PD4.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagccgtggggcctcgagtgaaggtttcctgcaagccttctggataccaccttcactagctatgctatgactagttgggtgcgacacgggtcccccgtagggaaccgaaggggtcttaggacggttggagttggggagtgggaactaccgaaaccaccgaaacgacgtacggggaaacccctaaaggtactcggacccgtagggtacccttacgacgtacgggtaccggttttcgtacctttccgttcccgttacggtaccctacccgttccgttcggtacgtaacggccgtaaccgggtcctaacgttaacgtccgtacggacgtaacgtacttacgaccggacctaacgtacccgttaaggtcggacgttacggaacggtacctaccgttcggtaccggtttagtaactttacgtggtcgacggtaaggtacggtacttaacgttactagtacgtaagttaaggtaagttaggtttattacgtagttaacgg

SEQ ID NO: 93361 - DNA, 795 bp, Homo sapiens
  misc_feature: GYAE6OF02G5VVL.34.71.G05.1.454.CMB.1.raw
  modified_base (246)..(246): a, c, t, g, unknown or other
  misc_feature (246)..(246): n is a, c, g, or t
  modified_base (285)..(285): a, c, t, g, unknown or other
  misc_feature (285)..(285): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagccgtggggcctcgagtgaacggtttcctgcaagtccttntggataccaccttcactagctatgctatgctagttgggnccgacacggccctggacgaagggtcttggaggtggagtgggatggactacgaaccaaccaacgtacgtacgggaaaccctaagtactacgacccgagggtaccttacgaacgtagggtaccgtttacgtctttaccgtccgttacggacctaccttcgtcgtaccgacggtacgaccggtctaagttactacgtcgactaacgtctacgacgaccgtaacgtacccgttaaagtccgggtacgtaacgggtaaccgtaaccgttaccggtcccgggttaccggttacggtttaacgtttaccggttacgggttaccgggtaaaccggggtaaccgggtttaacggggttaaccccgtttttttaaagggtttaaaccccgtttaaagggttttaacccgggggttaaaaacgttttttaaacgggggtttaaaaccggggtttttttaacgggggtttttaaaaacggtttttaacgggtttaaccccgggggtttttaaaaaccggggg

SEQ ID NO: 93362 - DNA, 580 bp, Homo sapiens
  misc_feature: GYAE6OF02GIHPT.34.71.G05.1.454.CMB.1.raw
  modified_base (445)..(445): a, c, t, g, unknown or other
  misc_feature (445)..(445): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacgacggcccctagggacaagggtcttggaggtggagtgggatggatcaacaccaacacgtacggggaaacccaacgtatcgacccgagggtcttcgacgagggtacggtttgtcctttctccgttggacctaccgttctgtcacgcacggcactatctgcagntcagcacgacctaagtcggcgtagacggactacgtcgtccgttagtaacttacgtgtacgacgtaggtacgtacgttaacttaactagttagtaagttaacggtaaggtttaggtttaagtttagttgttaacgg

SEQ ID NO: 93363 - DNA, 601 bp, Homo sapiens
  misc_feature: GYAE6OF02IIXQD.34.71.G05.1.454.CMB.1.raw
  modified_base (233)..(233): a, c, t, g, unknown or other
  misc_feature (233)..(233): n is a, c, g, or t
  modified_base (287)..(287): a, c, t, g, unknown or other
  misc_feature (287)..(287): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (416)..(416): a, c, t, g, unknown or other
  misc_feature (416)..(416): n is a, c, g, or t
tcagtacacgtgatcacgaccggtgctcgatttagtgtcgtcgcaagagagagggggacccaacaaccacacccctcctaagaagaagccctagaccacagctccacaccatggactggacctggaggatcctcttcttgggtggcagcagcaacaggtgcccactcccaggtgcagctggtgcaatctgggtctgagttgaagaagccgtggggcctcagtgaaggtttccngcaagccttcgtaggattacaacctttcactagctatgctaatgcagtttgggnacgacaggcccctggaacaagggcttgagtgatgggactggancaacaccaanactagggaaacccctaagtacacgcccaagggtcttacaggacggaacgttttgtcttctccttggacacccgttncgtacagacacgatacgtactctagactagactacgacgacaacgtacgtaaaggttcgacgtacgaaggaaccgttacgttcggtaccgttagttaacgttacgtggtacggtacggaaggtcggtacttaattaactacgtagtaagttaaggtaaggtttaggtttaattaccgtagtaacg

SEQ ID NO: 93364 - DNA, 642 bp, Homo sapiens
  misc_feature: GYAE6OF02H0LW1.34.71.G05.1.454.CMB.1.raw
  modified_base (370)..(370): a, c, t, g, unknown or other
  misc_feature (370)..(370): n is a, c, g, or t
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatactaccttcactagcctatgctatgctattgggtgccgtacacggcccctggacgaagggtccttggaagtgggatggggatgggacttacaacgaccaacaccgtagggaaacccctaagtanacggacccgaggggtcccttacgaacgtaacgggtaccggttttagtcctttcgtccgtttcggacctacctctgtcagcacgctatactctgacagtatcagcacgtaccttaagtcggacgtaggtacgaaccgtacgttccggccggttagtacgtttacgtggtacggtaccggtagggtacggtacctttaatttaaccgttagttaaccgttaagttaacggggttaaggtttaacgggttttaatttacggttacgttaaacggg

SEQ ID NO: 93365 - DNA, 243 bp, Homo sapiens
  misc_feature: GYAE6OF02GFZB1.34.71.G05.1.454.CMB.1.raw
  modified_base (233)..(243): a, c, t, g, unknown or other
  misc_feature (233)..(243): n is a, c, g, or t
tcagtacacgtgatcacgaccggtgctcgatttagtgtcgtcgcaagagagaggggggtgccagggggaagaccgatgggccctggtcacctctcctcagcctccaccaagggcccatcggtcttcccctggcaccctcctccaagagcacctctgggggcacagcggccctgggctgcctggtcaaggctacttccatcacgtgtactgagcgggctggcaaggcgcatagnnnnnnnnnnn

SEQ ID NO: 93366 - DNA, 681 bp, Homo sapiens
  misc_feature: GYAE6OF02HMQTK.34.71.G05.1.454.CMB.1.raw
  modified_base (358)..(358): a, c, t, g, unknown or other
  misc_feature (358)..(358): n is a, c, g, or t
  modified_base (381)..(381): a, c, t, g, unknown or other
  misc_feature (381)..(381): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagccgtggggcctcagtgtaacggtttcctgcaagtccttctggatactaccttcactagctatgcttatgctagttggggtcgacgtacgacgggtcccctagggaacgtaaggggtcttggaggtggagtggggatggatcaaacaccaanacgtacgggaaaccctaagtacncggacccgagggtccttacgaacgtacgggtacggttttcgttactttccgttccgttacggacctacccgttccgtcggtaccgtaacggcccgtaaccgggtactaagttacgttacgtacgactaacgtactacgacgccgtaaccgtaccgttaagtcgggtaccttacgggaacggacctacgttaggtccggttaagtacgttacgtggtcggtaccggtaaggtacggtaccttaagttaacgtacgtaggtaacgttaaggtaggtttaggtttaattagttaggtaaccgg

SEQ ID NO: 93367 - DNA, 578 bp, Homo sapiens
  misc_feature: GYAE6OF02FTEKI.34.71.G05.1.454.CMB.1.raw
  modified_base (392)..(392): a, c, t, g, unknown or other
  misc_feature (392)..(392): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcgagtgaaggtttcctgcaagccttctggatacctaccttcactagctatgctatgcagttgggtgcgacacggccctggacgaagggcttaggagtggagtgggagtggatcaacaccaacacgtacgggaacccaacgtactcgcccgagggcttacgacgaggtacggtttntccttactccgttaggacctccgtctgtcacgcgacggtctatgtcctgctagatcgagcgatccgtaagtcggacgtcgagactacgtcgtccgtagttacttacgtgtagcgtaacggtcggtacttaagttacgtagttagaagttacggttaaggttaggtttacgttagtagttaaccggg

SEQ ID NO: 93368 - DNA, 643 bp, Homo sapiens
  misc_feature: GYAE6OF02JD10X.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagccgtggggcctcgagtgtaaggtttcctgcaagccttctggatacacctttcactagctaatgctatgctagttgggtcgcgacacggccccgtggaaccgaagggtcttggagtggagtgggatggataccaacaaccgaacgacggtaccgggaaaccctaacggtacgtccggaccgtacgggtccttacgaacgtacgggttacgttttgttaccgtttccttccgtttcggacctacccgtccgttacgtcacgtccgaccgtactagttactcgtacgcaacgtataccgacgtaccgacgtaaccgttaagtcggcgtaacgacgggtactacgtcgtacgtttagttacttacgtgttagcgtaggtcggtacttaacgttacgtagtagtacgttaaggtaggttggttaacttagttacgttacgg

SEQ ID NO: 93369 - DNA, 621 bp, Homo sapiens
  misc_feature: GYAE6OF02IATL5.34.71.G05.1.454.CMB.1.raw
  modified_base (460)..(460): a, c, t, g, unknown or other
  misc_feature (460)..(460): n is a, c, g, or t
tcagtacacgtgatcacgaccggtgctcgatttagtgtcgtcgcaagagagagggggacccaacaaccacacccctcctaagaagaagccctagaccacagctccacaccatggactggacctggaggatcctcttcttggtggcagcagcaacaggtgcccactcccaggtgcagctggtgcaatctgggtctgagttgaagaagcctggggcctcagtgaacggtttcctgcaagccttctggataccacctttcacttagccttatgcttatgctagttgggtgcgacacggccctggacaagggtcttggaggtggatggggatggactcaaacaccaacgacgtacggaaaccccaacgttagtccgaccgtagggtccttacgacgtacgggtacgtttgtacctttccgttccgtttcggacctaccgttctacggtcacggtaccaccgganacggttaactcgttagcctaaggtactaccagtaccagtcctaaggtcgcgtaggacggtactacgtcgtacggtagttacttacgtgcgacggtagtggttaccttagttacgtaagtaggttataagggtacgttaggttttacttacgtaggttacgg

SEQ ID NO: 93370 - DNA, 648 bp, Homo sapiens
  misc_feature: GYAE6OF02IB3MV.34.71.G05.1.454.CMB.1.raw
  modified_base (289)..(289): a, c, t, g, unknown or other
  misc_feature (289)..(289): n is a, c, g, or t
  modified_base (539)..(539): a, c, t, g, unknown or other
  misc_feature (539)..(539): n is a, c, g, or t
tcagtacacgtgatcacgaccggtgctcgatttagtgtcgtcgcaagagagaggggacccaacaaccacaccctcctaagaagaagccctagaccacagctccacaccatggactggacctggaggatcctcttcttggtggcagcagcaacaggtgcccactcccaggtgcagctggtgcaatctgggtctggagttgaagaagccgtggggcctcgagtgaacgggttttcctggcaaaggccttctgggatactacctttcacttagctatgctatgcattgggtncgtacacggccctggaccgaagggtctttagacgtggaatgggtactggatcaacgaccacacgtggaacccagtactgcccgtgggtcttcgacgacggtacgttttcgtacttcgtcctttagggacctaaccgttcctgtcctaacggccgtaacggcctaaggttctacgtttagaccctaagggtaacttccgaagtccaacggtacccctaggttaaccggcttacgggaacgtaccttacggntccgggttatacgttaccgtggttacggactagggtaacggtctttaaactttcgaacgttagtacgttaaggtaacggtttaggttttaactttcggtagttaaccgg

SEQ ID NO: 93371 - DNA, 627 bp, Homo sapiens
  misc_feature: GYAE6OF02I15DN.34.71.G05.1.454.CMB.1.raw
tcagtacacgtgatcacgaccggtgctcgatttagtgtcgtcgcaagagagagggggacccaacaaccacacccctcctaagaagaagcccctagaccacacgctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacacggcccctgggacaagggtcttgagtggagtgggatggatcgaacaccaacacgtacggggaaaccccaacggtacgtcgcccctaggggtccttacgaacgtacgggtaacggttttcgttaccgtttccttcccgtttagggaccctaccttcgtcgtcgacgtccaccggctatacgtctgactagactcagctagaccttaagcggtactaggacggtactacgtcgtaccgtgttaacttacgttggtcgtacggtaggtacggttacctttaagttaacgttacgttagtaacgttaaggttaaggtttaggtttaacgtttagtacgttaaccgg

SEQ ID NO: 93372 - DNA, 592 bp, Homo sapiens
  misc_feature: GYAE6OF02IB770.34.71.G05.1.454.CMB.1.raw
  modified_base (232)..(232): a, c, t, g, unknown or other
  misc_feature (232)..(232): n is a, c, g, or t
  modified_base (560)..(560): a, c, t, g, unknown or other
  misc_feature (560)..(560): n is a, c, g, or t
  modified_base (585)..(585): a, c, t, g, unknown or other
  misc_feature (585)..(585): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagccgtgggctcagtgaaggttttccngacaagccttcgtggactacaccttcactagctatgctatgctagttgggtgcgacacggccctgggaacaagggtcttggagtggagtgggatggatacaacaccaacacgtacgggaaacccaacgtactacgcccgtaaggggtcttacgaacgtagggtacgttttgttccttacgtcctttcgggacctaccgttcgtagtccaggtccacggtcaattactcgtgactagatcaacgacacgtacctaagttcggacctaggagtaaccacgtacgtccgtagttaacttcgtagtcgacgtacggagtctaattaactagngtataagtaagttaggttatttagngtaacgg

SEQ ID NO: 93373 - DNA, 686 bp, Homo sapiens
  misc_feature: GYAE6OF02GLO4E.34.71.G05.1.454.CMB.1.raw
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctgggcctcagtgaaggtttcctgacaagccttcgtggatacaccttacactagctatgactatgctagttgggtgcgactacggcccctaggacgaaggcttgagtggagtggatggatcaacacaacacgtacggaaaccaagtactcggcccgagggtccttacgaacgacgggttacgtttcgttaccttcgttaccgtttacgggtacctaccgttccgttacggtaccgacggtaccgaaccgggtacttaacggtacttaccgtacggacgtaacggtaacttaccgaacggaccgtaacgttacccgtaaacgttgggtacccgttaggaaacggacctacgttacgggtaaccgttacgtttaacgttacgttcggtacggtacgaagggtaacgtaactttacgttaagtaacgtaggtaaacgttagggtaaacggtttaggttttaactttaaggtacgttaaacgg

SEQ ID NO: 93374 - DNA, 645 bp, Homo sapiens
  misc_feature: GYAE6OF02GRMYC.34.71.G05.1.454.CMB.1.raw
  modified_base (272)..(272): a, c, t, g, unknown or other
  misc_feature (272)..(272): n is a, c, g, or t
  modified_base (291)..(291): a, c, t, g, unknown or other
  misc_feature (291)..(291): n is a, c, g, or t
  modified_base (508)..(508): a, c, t, g, unknown or other
  misc_feature (508)..(508): n is a, c, g, or t
tcagtacacgtgatcacgaccggtgctcgatttagtgtcgtcgcaagagagagggggcgtgggcctcaggaagcagcatcggaggtgcctcagccatggcatggatccctctcttcctcggcgtccttgcttactgcacaggatccgtcggcctcctatgagctgactcacgcccaccctcagtcgtccgtcgtccccaggaccagacagccgagctatccactcgtctcgtaggagtaataaaggttcggggaattaaagatgtacgttgntaggttactcgagcagganaccgtagccctacgtccctaggtcgtcgcggttacatacctagttaccgaaagattacggacgtaagccgtcccgagtaacggggtccaacccttggaccgtacggtattcctggtccggtaccttacccgaaccttcgacggggtaaacaccacggcctaccgtctcggaccacgtcacggacgaccgtagacgtactggagttacgacggttacngtacgttactaccgttagaccgtacgggcgtaacggtaccacggacgtaccgtaggcggttaacggtacgggcgggtaaacgggtccgaacgtccgttacggaccccggtacggttaccggtaccgagtaaccccgg

SEQ ID NO: 93375 - DNA, 637 bp, Homo sapiens
  misc_feature: GYAE6OF02IXBB4.34.71.G05.1.454.CMB.1.raw
  modified_base (293)..(293): a, c, t, g, unknown or other
  misc_feature (293)..(293): n is a, c, g, or t
tcagtacacgtgatcacgaccggtgctcgattttagtgtcgtcgcaagagagagggggacccaacaaccacaccccctcctaagaagaagccccctagaccacagctccacaccatggactggacctggaggatcctcttcttggtggcagcagcaacaggtgcccactcccaggtgcagctggtgcaatctgggtctgagttgaagaagcctggggctcagtgaaggtttcctgcgaagccttcgtggatacacctttacactagctatcgctactgctattgggtgccganacggccctaggacgaaggtcttggaggtgagtgggatggagacacaacaacgacgtacggaacccaagtcgtacgacccgtaggtcttcagtacggtacggtttgtcttcgtccgtacgacctaccgttcctagtccgataccgacgggtctagtacgtcgtcgacgtacgtactcgagaccagtaaccgtaagtacggtccgtaggacgtaacgtacggttcgtaacccgttagtttaagtttaccgtaggtacggcggtaacggtcggtaacctttacttaaacgtagttacgtaaggtttacggtaaaggtttacgttaaggttttaagtcggttaaacgg

SEQ ID NO: 93376 - DNA, 624 bp, Homo sapiens
  misc_feature: GYAE6OF02GQPIE.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacacggcccctggacgaagggtcttggagtggatgggatggatacaacaccaacacgtacgggaacccaacgtacgtcgacccgagggtccttacgacgtacgggtacggttttcgtcctttctccgtttacggacctacccgttcgtgtccagccgacggctacttactctcgcagtactacgacgacgacgtacctaagtcggactaggacgacgtaccgttcgtaccggttagttaacgttacgtgttacggacggtaaggtacggtaactttaacgtttaacgttaacgtagtaacgttaaggttaaggtttaggtttaatttacggtagtttaaccgg

SEQ ID NO: 93377 - DNA, 727 bp, Homo sapiens
  misc_feature: GYAE6OF02F2PF7.34.71.G05.1.454.CMB.1.raw
  modified_base (242)..(242): a, c, t, g, unknown or other
  misc_feature (242)..(242): n is a, c, g, or t
  modified_base (251)..(251): a, c, t, g, unknown or other
  misc_feature (251)..(251): n is a, c, g, or t
  modified_base (277)..(277): a, c, t, g, unknown or other
  misc_feature (277)..(277): n is a, c, g, or t
  modified_base (285)..(285): a, c, t, g, unknown or other
  misc_feature (285)..(285): n is a, c, g, or t
  modified_base (460)..(460): a, c, t, g, unknown or other
  misc_feature (460)..(460): n is a, c, g, or t
  modified_base (713)..(713): a, c, t, g, unknown or other
  misc_feature (713)..(713): n is a, c, g, or t
tcagtacacgtgatcacgaccggtgctcgatttagtgtcgtcgcaagagagagggggacccgaacaaccacacccctcctaagaagaagcccctagaccacagctccacaccatggactggacctggaggatcctcttcttgggtggcagcagcaacaggtgcccactcccaggtcgcagtctggtgcaatcgtggggttctggagttgaagaacggccgtggggcctcagtgaagtttccngcagccttnggatacgccttcactgctatgctatncatgggtnacggactacggccctgggacgaaggggtccttagggaggttcgggaagtggggacttgggtaactaccgaacaaccaaccgtaagacgggggaaaccccaaggtactcggaccccgaaggggtcttaccgaacgtagggtaccggtttcgtacctttcgttacccgtggtaaccnccgttactcggttaccagggtaccttaaccgggctaacgttattcccgtgtaccgaacggtacttaccgaggacccggaacgttacccgttaaacgggtcgggttaaccgacggggtaacgaacccgttaacggtccggttaccgttaagtttaccgttaacgttcggttacgagggtacggtaaccggtttacgttaactaaccgtttagaccgtttaacggtaacggttagggttaggttttacgttttanagggttttaaccgg

SEQ ID NO: 93378 - DNA, 638 bp, Homo sapiens
  misc_feature: GYAE6OF02JUCIP.34.71.G05.1.454.CMB.1.raw
  modified_base (150)..(150): a, c, t, g, unknown or other
  misc_feature (150)..(150): n is a, c, g, or t
  modified_base (236)..(236): a, c, t, g, unknown or other
  misc_feature (236)..(236): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (472)..(472): a, c, t, g, unknown or other
  misc_feature (472)..(472): n is a, c, g, or t
tcagtacacgtgatcacgaccggtgctcgatttagtgtcgtcgcaagagagagggggacccaacaaccacacccctcctaagaagaagcccctagaccacagactccacaccatggactggacctggaggatcctcttcttggtggcagnagcaacgaggtcgcccactcccaggtgcagctggtgcaatcgtggtctgagttgaagaagccgtgggcctgagtgtacggtttccngcaacgtccttcgtggactacctaccttcactagctactgctatgctagttgggncgacncgccctaggacaggtcttaggagtcggagtgggcttaggactaacgaacaccaacgacggtaaccggaaaccctagtacgcgacccgaggtctacgaacggtaggtcgtttcgtaccttcgttctacggactctcgtcgtacacgcgtaccgataacgtctccgtgaactagttanaccgacgtcaaccgtacgttaagcggtaaccgttggaaacgctcccgtaggttacccgtaaagttacgtttcgacggtcgtaacggtacgggtcttaacgtttacgtaaacttgggtataacggttaacgtaggtttaacggtttattaaccggtactttacgggg

SEQ ID NO: 93379 - DNA, 698 bp, Homo sapiens
  misc_feature: GYAE6OF02GTU2U.34.71.G05.1.454.CMB.1.raw
  modified_base (173)..(173): a, c, t, g, unknown or other
  misc_feature (173)..(173): n is a, c, g, or t
tcagtacacgtgatcacgaccggtgctcgatttagtgtcgtcgcaagagagagggggctgggcctcaggaagcagcatcggaggtgcctcagccatggcatggatccctctcttcctcggcgtcttgcttactgcacaggactccgtcggcctcctatgacgtctgactcacncccgaccctcgagtcgtccgtcgtccccgacggacacgacacgccgacgcactcctaccgtcgtctcgtaggagtaagttaaacggttagggggtaaataaatagtcgtcgttaggcgttaggtactacgtacgacgtaacgaacggaccgacggaccgtaccgttcccgtggtacgtccgtacggtactacgtacgtactacgaagtacgtacgaccgaacgcccgtaccgtacggacggtactccgtagacgtcgttacttcgtcgtcgtacctacctacgtacgtacggaaccaccgacgtacctcgtactaccgctacgcggacgcccggaactacggtcgtagtcggaacgtcggacgtacgttaggtaaccttaacggtgtaccggtacggtaacgggtcgtaacgggaaccaagggtaacccgagggttgttaccgggtggtaacccggggtaggaacccggtaaccggacgtaccggttaccggacccgttggtaaccgtcggtaccccgtaaccgg

SEQ ID NO: 93380 - DNA, 609 bp, Homo sapiens
  misc_feature: GYAE6OF02H1NTN.34.71.G05.1.454.CMB.1.raw
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
  modified_base (252)..(252): a, c, t, g, unknown or other
  misc_feature (252)..(252): n is a, c, g, or t
  modified_base (264)..(264): a, c, t, g, unknown or other
  misc_feature (264)..(264): n is a, c, g, or t
  modified_base (281)..(281): a, c, t, g, unknown or other
  misc_feature (281)..(281): n is a, c, g, or t
  modified_base (448)..(448): a, c, t, g, unknown or other
  misc_feature (448)..(448): n is a, c, g, or t
  modified_base (466)..(466): a, c, t, g, unknown or other
  misc_feature (466)..(466): n is a, c, g, or t
  modified_base (507)..(507): a, c, t, g, unknown or other
  misc_feature (507)..(507): n is a, c, g, or t
  modified_base (519)..(519): a, c, t, g, unknown or other
  misc_feature (519)..(519): n is a, c, g, or t
  modified_base (572)..(572): a, c, t, g, unknown or other
  misc_feature (572)..(572): n is a, c, g, or t
  modified_base (601)..(601): a, c, t, g, unknown or other
  misc_feature (601)..(601): n is a, c, g, or t
tcagtacacgtgatcacgaccggtgctcgatttagtgtcgtcgcaagagagagggacccaacaaccacacccctcctaagaagaagccctagaccacagctccacaccatggactggacctggaggatcctcttcttggtggcagcagcaaacaggtgcccactcccaggtgcagctggtgcaatctgggtctgagttgaagagtccgtggggcctnaggtgaaggtttccngcaagtccttcgtggatacnccttcatagctntgctatgctagttgggncgacacggcccctaggaccgtaagggtccttaggacgttggagtggggtaattcgggaatcgaaaccaccgtaacgtaccggacgggaaacccctaagtacgtacggacctacgggtacttcgaacgtacgggtacgtttctacgttcctcgtttacggactccgtntcgcgtacgcgaccggtnaacgtctccgtggaccaggtatcagtccaggaccttaaggngtaccaggtacncgtacgtcgtaccgtagtacttacgggttcgagtacggatcgttatacgtagngttactaacggtagttacgtttattacgngttaacgg

SEQ ID NO: 93381 - DNA, 665 bp, Homo sapiens
  misc_feature: GYAE6OF02F2ZBH.34.71.G05.1.454.CMB.1.raw
  modified_base (551)..(551): a, c, t, g, unknown or other
  misc_feature (551)..(551): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatcgtggtctgagttgaagaacgccgtggggcctcagtgtaacggtttcctgacagccttctggtataccgaccttacactaggctatgtctagtcgtactaggttgggtacgtcgaccgacggaccccgtggaaccgaacgggtcttggagtcgggagttacggggtagtacggacttaccgaaacgaccgtaacgtaccgtaccgggaaaccctaacgtacgtaccgaccgtacgggacctttacgaaggtacggttacggtttcgtccttaccgttccgttacggacctaccttcgtacgtcgacgtaccgtaggtacctagtacctcgtacgcgtacggctacgacgcgtacgtacgtacgnggacgtgacgacgtcgtacgtcgtacgttagtcgtcgtaggacgtacgtacggtacttaaggttacgtagtacgttagttacggtagttaggtttacttaggtacgttaacggg

SEQ ID NO: 93382 - DNA, 712 bp, Homo sapiens
  misc_feature: GYAE6OF02HV2YE.34.71.G05.1.454.CMB.1.raw
  modified_base (183)..(183): a, c, t, g, unknown or other
  misc_feature (183)..(183): n is a, c, g, or t
  modified_base (541)..(541): a, c, t, g, unknown or other
  misc_feature (541)..(541): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtncaatctgggtctgagttagaagaagccgtggggcctcgaggtggtaacggtttccctgacaagtcccttacgtggatactaccttcactagctatgactatcgctaggttgggtgcccgaacgtaccggccccgtaggaacgtaacggtccgttaggaggtggacggtgggagtagggactacgaaccaacccgaacaccggtaacgggaaaccctaacgtagtccggaccgtacggggtaccttacgaaccggtacgggttaccggttttcgttcctttaccgttccgttacggtacccttaccgttcgttcgtctacggccgtaaccggtctaacggtacttcctagactaacgtntaccgataacgtcgtaacttaagtcgggtatacggacgtaagttccgtcgttaccggttagttacttcggtagttacggaggtaaccggaggtttaacccttaagttacgttaacggtagttaagtaacgggtttaaaggtttgttttaacgttacggttagttaaccggg

SEQ ID NO: 93383 - DNA, 571 bp, Homo sapiens
  misc_feature: GYAE6OF02FQXEP.34.71.G05.1.454.CMB.1.raw
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttccngcaagccttnggtatacacctttcactagctatgctatgctagttgggtgcgacaggcccctggaccaagggtcttggagtggatgggatggatcaacacccaacgacgtacgggaacccaacgtactcgcccgagggtcttacgaaccgagggtaccggttttgtcctttctccgtttggactacccgttctcgtcgagccgacggcctataactcgtggacagatcgacgctagaccttaagcggcgtagaacgacacgtgccgttagtacttactgtggcgtaggaggtcttattaactagtagaagttagtaaggtgtttaattagtagtaacgg

SEQ ID NO: 93384 - DNA, 862 bp, Homo sapiens
  misc_feature: GYAE6OF02HMSIK.34.71.G05.1.454.CMB.1.raw
  modified_base (627)..(627): a, c, t, g, unknown or other
  misc_feature (627)..(627): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagcgtggtgcaatcgtgggtctgtagttgaagaagccgtcgggcctcgagtgtaacggtttcctgcaagtccttcgtggactacctaccttacacgtacgtctagtgtactagtgactagtttaggggtcgaccgaccggtaccggtccccggtgggaaaccggtaacggggttccgttaagggtacgggttgggtacgggtaggggtacgttcgggaaacttacccgaaaaccgaaccctaaaccggtaaccggtaaccggggaaaacccgtaaacggttacggtaccggacccggttacggggtacccttaaccggaaccgggttacggggtttaccgggttttcgttccttttacccggtacgtttaccgggtaaccctcccgtttcgtacggtaccgtacggaccgtaaccgggtctaaacgttgtacccggttgacgttaacgtacnccggtaagcgtaacctaccgggtaacgcgggtacgtacggtaaccgtaacgtaccggttccggttaccggttaaagtttacgtttaccggtagggtacccgggtacggttaaacggggtaccgtttaaaacgtttttcgtaaaaccgtttaggtaaccggtttaaaaggtttaacggggttaacggtttttaaacggtttaagtttttaccggtaaacgggttttaacccggggg

SEQ ID NO: 93385 - DNA, 683 bp, Homo sapiens
  misc_feature: GYAE6OF02G5G7F.34.71.G05.1.454.CMB.1.raw
  modified_base (608)..(608): a, c, t, g, unknown or other
  misc_feature (608)..(608): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatcgtgggtctggagttagaagaaggccgtggggcctcgaggtaggtaaggttttcctggaccaacgtccctttcgtggaacttaccacctttccacgttacgtcttatcgtcttagtcgacgtagtttggggtgacggaccgacggccccgttagggacgaagggtcttggaaggtcggagtcgggagtggacgtacaaaccgaacccaacgacgtaccgggaaacccgtaacgtagtaccgcccgagggtcttacgaggtacggttacggtttctccgtttctccgtttacgacctcctcgttcgtcgacgtcgacggtactactatccgtgactacgataccgacgactaccgtaccttaagtcggtaccgtaggaacgttcgaaccgttcgtccgttaaggtttaatccgttggtacgnggtaggtcgttacgtttaatacgttataaggttaagtaggttaaaggtttggtttaaactttggttaagtaacgg

SEQ ID NO: 93386 - DNA, 628 bp, Homo sapiens
  misc_feature: GYAE6OF02FMYN3.34.71.G05.1.454.CMB.1.raw
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacaggcccctggacaagggcttgagtggagtgggatggatcaacgaccaacacgtagggaacccaaggtactgacccgagggtcttacgacgtaggtacggttttcgtcttcttccgttaggacctacccgttctcgtcgagccgtacggcaattactctagccaaggtactcgaacgtcacgtaccctaaagtcggacgttaggaacgggacctaacgtcggtacccgttaggtaacgtttaccgtggtacgtccgggtaaggtaacggtaccttaacgtttaaccgttaagttacggtaacgttaaggtaagggtttacggtttaagtttaacggtagttaaccgg

SEQ ID NO: 93387 - DNA, 792 bp, Homo sapiens
  misc_feature: GYAE6OF02GYRLD.34.71.G05.1.454.CMB.1.raw
  modified_base (183)..(183): a, c, t, g, unknown or other
  misc_feature (183)..(183): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtncaatcgtgggtactgagttgaagaacgccgtagggcctcgaggtaggtaacggtttcctgacgtaacgtccgttacgtaggtaataccgtaccctttacgaacgttacgtaccgttaagtgtaccgttaatcggtaccgtaaggtttcgggacgtacggtaaccgacggtcccccgtagggaaaccgtaaggggtaccgtttaggagggttacggacggttagggtataacgggtactacgaaaaccctaacccgaaaacgtaccgtaaccggaaaacccgtaaggtaacgtccggaaccgtacgggtaccttacgaacggtacggtacggttttacctacgtttaccgtaccgtttacgacctaccgtatcgtaaccgacgtacggaccggtactactagtacgtacgtactaagtaccttacgaccgtagtaaccgtagttaacggtcgtacgtcgggaaagtccgtacgttacgggtcggttaagtaccgttaaggtttcggtacggtacgtaaacgggtacgtaactttaggttaacccgtttaagaacggttaacggtaacggttaaaggtttagtttaaacggtttagtacggtttaaacggg

SEQ ID NO: 93388 - DNA, 650 bp, Homo sapiens
  misc_feature: GYAE6OF02GK9AO.34.71.G05.1.454.CMB.1.raw
  modified_base (235)..(235): a, c, t, g, unknown or other
  misc_feature (235)..(235): n is a, c, g, or t
  modified_base (255)..(255): a, c, t, g, unknown or other
  misc_feature (255)..(255): n is a, c, g, or t
  modified_base (372)..(372): a, c, t, g, unknown or other
  misc_feature (372)..(372): n is a, c, g, or t
tcagtacacgtgatcacgaccggtgctcgatttagtgtcgtcgcaagagagaggggacccaacaaccacacacctcctaagaagaagcccctagaccacagctccacaccatggactggacctggaggatcctcttcttggtggcagcagcaacaggtgcccactcccaggtgcagctggtgcaatctgggtctgagttgaagaacgccgtggggcctcgagtgtaaggtttccngacaagtccttctggatacnccttcactagctatgctatgctagttggtgcgacgcggccccgtggacgaagggtcttggaggtggagtgggatggactaccaaactaccaacacggtacggaaaccctaacgtacncggacccgaggtctacgacgtagggttacgttcggttcctttcgtcgtcggaacctccttcgtcgtacgacggtcgaccggtactagttacgttcgtcgactaagtacgtacgaacgtcacgtaacctagtacggtactagtaacctacgtcgtcggtacgttagttaacgttgtcggtacggtaaggtacggttaaccgttacttaacgtttaacgtacgtttaaggtaacggtttaagggttaacggtttttaacggtttagtaggtttaaacggg

SEQ ID NO: 93389 - DNA, 650 bp, Homo sapiens
  misc_feature: GYAE6OF02IXVY3.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttgggtggcagcagcaacaggtgcccactcccaggtgcagctggtgcaatcgtgggtctgtagttgaagaagccgtgggcctcagtgtaacggtttcctgacaagtccttcgtggactaccaccttacactagactatgtctatcgctagttggtcgacgtacgacggccctaggacgaggtacgttcgaggtggatcgggggggggatacggtacgtacaacgaccgaacgaccgtacggaaacccgtaacgtacgtaccggaccgacggtacctacgtaacgacggtacggtttcgtacgttccttaccgtacgtacgtaccgttcgtcgtcgacgtacgacgacgtactacgtcgtacgtacgagtactacgactacgacgtactacgtcggtacgtacgtacgacgtacgtcgtcgtacgtacgttacgtcgtacgtacgtaggtacgtacgtacgttacgttagtagtaagtacggtaaggttaggttaacgttagtacgttaacgg

SEQ ID NO: 93390 - DNA, 772 bp, Homo sapiens
  misc_feature: GYAE6OF02GAOH5.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcctactcccaggtgcagctggtgcaatctgggtctggagttgaagaagcctgggggcctcgaggtgaacggtttcctgcaacgtccttcgtggatacaccttcactagctatcgctatgcagttgggtgcgacgaggccccgtaggacgaaggggtcttaggacgtggacgtgggatgggaactacgaaacctaccaacgacggtacgggaaaccctaacggtactacggacccgaggggtccttacgaacgtacggggttaaccggttttcgtaccgtttccttaccggtttacgggaccgtacccgttcgttaggtaccgtaacggcccgtaaccgggtcctaaagttaccgttcgtacggtactaacgtacgttacggacgaccgtaacgtaacccgttaaaggttccgggtaccgtaagggtaaccggtaaccgtaaccgtttacccggggttaccggtttaccggtttaacggttttaccgttacgggttaggtaacccgggaacgggtaagggttaccgtttaacgtttaaaccgttacgtaacggttaaggtttaacgggttaagggttaaggtttttaacgtttagttacgggtttaaaccggg

SEQ ID NO: 93391 - DNA, 865 bp, Homo sapiens
  misc_feature: GYAE6OF02HVUIN.34.71.G05.1.454.CMB.1.raw
  modified_base (165)..(165): a, c, t, g, unknown or other
  misc_feature (165)..(165): n is a, c, g, or t
tcagtacacgtgatcacgaccggtgctcgatttagtgtcgtcgcaagagagagggaccgaacaaccacacccctcctaacgaagaagccctacgaccacagctccaccaccactggactggacctggaggatcctcttcttggtggcagcagcaacaggtgcccncctcccaggtgcagctggtgctaatcgtggtctgagttgaagaacgcgtcgggtctcgagtagtaacgggtttcctgacgaacgtccgttttacgcggggtaacttaaccgtaacccgtttccaaaccgttggaccttaaggtacgtccgttaaagtttcgaacgttacgtttgggggtacgtaccggtaccgtaacggggccccccttggggaaaccgtaaaccgggggtccttaggtaccggtttagggaaggttccgggggtaaatttggggacttaacgtaaaacccgaacccaacgtaacgttaaccgggggaaaacccctaacgggttacgtaaccgccccggttaaggtaacccgttctaaaccggtacggggtttaacgttttgtaacccgtttttcccgacgttttacccgggaacgttacccgttaccgtgtttaccgacggtcgaaccgggtcgtaacttactacggttcaaccgtacggtactacgtaacggtacgtaactaaccgtaacgtaccgggtactaccgggttaaggaccttaacccgtgggtacccgttaggttaacgttaaccgtttggccgtaagggtaccgtaaagggttaccctaagttttaaccgtttactagggtaaagtttaacccgggttaaggtttaagggtttaattttaccggtagtttaaacccgggg

SEQ ID NO: 93392 - DNA, 690 bp, Homo sapiens
  misc_feature: GYAE6OF02FOT14.34.71.G05.1.454.CMB.1.raw
  modified_base (356)..(356): a, c, t, g, unknown or other
  misc_feature (356)..(356): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagccgtggggcctcaggtgtaagggtttccctgcaacgtccttctggataccacttcactgctatgctatgactagttgggtgtcggacacgggcccctgggaacgaagggtccttggaggttggagtgggatgggatcgaacaccaaacncggtacggaaccctaacgtgtacgacccgaggggtccttacgacggtacggttaccggttttagtcctttaccgtcctttgggaaccctccgttacgttcgttaccgcgaccgtacgggtactagttaccgttcgtacggtacgaacgtcgtaccgtaggacccgtacggtacccgtaaaggtccggtaccgttaggaacggtacctaacgttcgtacgtttagttacgttacgttacggtacgtacggcggttaacgttacgtttaagttaccgttagtagggttacctaagggttaaggtttaccgggtttaatttggttaccggttaacgg

SEQ ID NO: 93393 - DNA, 590 bp, Homo sapiens
  misc_feature: GYAE6OF02JGU74.34.71.G05.1.454.CMB.1.raw
  modified_base (369)..(369): a, c, t, g, unknown or other
  misc_feature (369)..(369): n is a, c, g, or t
  modified_base (539)..(539): a, c, t, g, unknown or other
  misc_feature (539)..(539): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgctagttgggtgcgaacacgggccccctgggaaccaagggtcttggaggtggatggggataggactacaacaccaaacgacgtaggggaacccaagtacncggacccagggcttcgacacgggtagtttcgttcttcttccttggacctacctctcgtctagccacggcatactctcgcacgtataccgagccacgcccttaagtggtacctagacggtacacgttgtaccgtagttaacgttcgtaggtcgtacgggaggtaacggttnttaaacgttctaacgttagacttacgggtagttggttattagtgttaccgg

SEQ ID NO: 93394 - DNA, 739 bp, Homo sapiens
  misc_feature: GYAE6OF02FP2IF.34.71.G05.1.454.CMB.1.raw
tcagtacacgtgatcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccctcctatgagctgactcacgcccaccctcagtcgtccgtcgtccccaggacagacacgccagaccactaccacctcgcctcgtacggaagtaagttaaaggttagggggaaattaaaagttagtacgtcgtttcggcgtaggttactcaagacgaaggaacgccgacggcctaccggttccctggtccgtcgtaggtactattccttatacgtaagatacgaccgaacggtccccggaccctcggacggtacctacccggtagacgtaccgtacttcctcgtaccgtaccgtacctaacccgtacgtacgggtaaacccacggaacccgtacccgttaccgtccgtttaccgaacccgtaagttccccggaaacccggggaacccgggttccccggacggtaaacctttcggtaacccgggttagggaacggtacggtcgtttaacggtaccgtttaagtttacccgtcggttacgacggttccgggaggtaaccgaggtacccgtaggtacggtggtaaccgggtcgggaaccggacgggaacctagggtccgacgttacccggacttacgggacgtaccgacccgg

SEQ ID NO: 93395 - DNA, 735 bp, Homo sapiens
  misc_feature: GYAE6OF02I64G2.34.71.G05.1.454.CMB.1.raw
tcagtacacgtgatcacgaccggtgctcgatttagtgtcgtcgcaagagagaggggacccaacaaccacacccctcctaagaagaagcccctagaccacagctccacaccatggactggacctggaggatcctcttcttggtggcacgcacgcaacaggtcgacccactcccaggtcgacacgcgtggtcgacctaagtcgtgggtcgtgtacgttagaaggaacgccggtcggggtcctagagtcggtaacggtttccacgtacgaacgtccttgtacgtacttaccgtaccttcacgtagactatcgtacgtatacggtactaggttgggtacgccgtaaccgtacccgggtccccgtaagggtaaccggaacgggtttccgttagggtaaagggtgggtaacggtagggtaagtacggtaaccgtaacaaaccgtaaccgtacgtaaccggaaccgggtaaacctaggttactaccggtaccggacgggtcctacggaacgtacggttacgtttcgtctttccgtcgttagaccctcgttcgtactacgacgcgtaccgtactactccgtactaggactacgactcgtacactcgtacgtagtcggcgttaacgcgtaacaccgttacgggttaccgtacggtttataccggtgtaggtcgttaacggtagttacttacttagttacgaagttacgttaggttaaccgtttagttaactgttaaccgtacgg

SEQ ID NO: 93396 - DNA, 767 bp, Homo sapiens
  misc_feature: GYAE6OF02GNZ6L.34.71.G05.1.454.CMB.1.raw
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactccccaggtgccagctggtgcaatctgggtctgagttgaagaagccgtggggccctcaggttgtaaaggtttccctgcaaacggccttcgtaggactaccaccgttcacttagactatgactagtgctagttgggtgccgaacgacgggtcccccgtagggaaccgaaggggtcctttaggaggttacgggaagttgggggattagggaacttaccgaaaccgaacccctaaaaccgtaccggtaccggggaaaaccccctaaaggtacgtaccggaacccccggtaacgggggtaccctttaccgaaaccggtacggggttaaccggttttacggtttcctttacccgttacccgtttaacgggaacccttaccccgtttaccggttacggtaccgaacggtccgaaccgggtactaacgtaaccttccgtagaccgacgtaactccgaagcctacgaccgttaacggtcggtacgtaggaacgtacacgttcgtaccgttggtaacttcgtacgcgtacggacggtaaggtacctttaagttaacgtacgtaaggtacgttaagggttaacggttggtttaattaccgttaggtaaccgg

SEQ ID NO: 93397 - DNA, 732 bp, Homo sapiens
  misc_feature: GYAE6OF02G9REG.34.71.G05.1.454.CMB.1.raw
  modified_base (147)..(147): a, c, t, g, unknown or other
  misc_feature (147)..(147): n is a, c, g, or t
  modified_base (326)..(326): a, c, t, g, unknown or other
  misc_feature (326)..(326): n is a, c, g, or t
  modified_base (412)..(412): a, c, t, g, unknown or other
  misc_feature (412)..(412): n is a, c, g, or t
  modified_base (422)..(422): a, c, t, g, unknown or other
  misc_feature (422)..(422): n is a, c, g, or t
  modified_base (477)..(477): a, c, t, g, unknown or other
  misc_feature (477)..(477): n is a, c, g, or t
  modified_base (499)..(499): a, c, t, g, unknown or other
  misc_feature (499)..(499): n is a, c, g, or t
  modified_base (523)..(523): a, c, t, g, unknown or other
  misc_feature (523)..(523): n is a, c, g, or t
  modified_base (554)..(554): a, c, t, g, unknown or other
  misc_feature (554)..(554): n is a, c, g, or t
tcagtacacgtgatcacgaccggtgctcgatttagtgtcgtcgcaagagagaggggacccaacaaccacacccctcctaagaagaacgcccctagaccacagctccacaccatggactcggacctggagatcctcttctggtgcagnagcaacaggtcgcccactcccgaggtagcaggtccgttggtgcctaagttccgtgggtcttaggagttagaagacgtcccgtaggggccttacgaggttacgtacgggtttccctggacctaacggccctttagacggtattaaccggacccttttagaaccgttacgtaccttaaggnggtaccctaggtacaccggttagttagggaacgtcgaccaccggtacccgtggtaacgacggtcgttacgaggtccgaacgttcgngttaggatanaccgtacacgtacggtacgactaacgcgacacgtaacggcacctggtacacggtntacggtcagttcgacgtccgtnacgtccgtagtaccctcggtaacnccgtacgtagaccgcgggtaaaccttccggnggaacccttaagccgtaaacccgttagcccgttaaggtcgtacgtaacggaccgttcgacggtaaacctttacgccgttagaccgggtataaccgggacctttaccggacccttttaacgggactaagggttaacccacgggtacctttttaagaccggtttaacgccgttaacccgg

SEQ ID NO: 93398 - DNA, 692 bp, Homo sapiens
  misc_feature: GYAE6OF02JYNBK.34.71.G05.1.454.CMB.1.raw
  modified_base (293)..(293): a, c, t, g, unknown or other
  misc_feature (293)..(293): n is a, c, g, or t
  modified_base (309)..(309): a, c, t, g, unknown or other
  misc_feature (309)..(309): n is a, c, g, or t
  modified_base (344)..(344): a, c, t, g, unknown or other
  misc_feature (344)..(344): n is a, c, g, or t
  modified_base (559)..(559): a, c, t, g, unknown or other
  misc_feature (559)..(559): n is a, c, g, or t
  modified_base (634)..(634): a, c, t, g, unknown or other
  misc_feature (634)..(634): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccaggtgcagctggtgcaatctggggtctggtagttggaagaagccgtgggggcctcaggtgtaagggtttcctagacgagtccttcgtggatacaccttcactagctatgctatgcgattgggtnacggacacgggccccnggtaaccgaagggtcttgtaggtggacgttagggnttagggaactaccaacgtaaccgaacctacgaaccgggggaaacccctaaggtaactcccgggacccgtaacggggtactttaccggtaacggtacggggttaacggtttttcggttaaccgtttcccgttacgtttacggtacccgtaccggtttactacggttcgaaccgtcgtaccggactagtaccttcgacgtcgtaacgagtaccgtanacgggtcaccgtacgtaaggtccgtagtacgacacgttcgttccggtaattaccgtcgtttcggacgtggtaacncggttaacgtatacgtagtgtaaggtttacgtaaggtttattagttacgtgttaacgg

SEQ ID NO: 93399 - DNA, 597 bp, Homo sapiens
  misc_feature: GYAE6OF02G1BCC.34.71.G05.1.454.CMB.1.raw
  modified_base (485)..(485): a, c, t, g, unknown or other
  misc_feature (485)..(485): n is a, c, g, or t
  modified_base (539)..(539): a, c, t, g, unknown or other
  misc_feature (539)..(539): n is a, c, g, or t
tcagtacacgtgatcacgaccggtgctcgatttagtgtcgtcgcaagagagagggggacccaacaaccacacccctcctaagaagaagcccctagaccacagctccacaccatggactggacctggaggatcctcttcttggtggcagcagcaacaggtgcccactcccagttgcagctggtgcaatctgggtctgagttgaagaagccgtgggcctcagtgaaggtttcctgacaagtccttcgtggatacctaccttcactagctagtgctatcgactagttgggtgcgacgacggtcccctaggacgaaggtcttaggaggtggagtgggatggatcgacaccaacgacgtacgggaaaccctaacgtagtcgaccgagggtcttacgacgtagggtaccggtttgtcgttccttccgtagtacctaccgttcgtgtaccgagtaccgacggactagtactcgtcgactagtactcgtaacncgtacaccgtagtcgacgtagacgtaacaccgttcgtccgttagtacgttacgnggtcgagacgtagtacttaagtactagtagtagtaggtagttacgttatagtatacgg

SEQ ID NO: 93400 - DNA, 147 bp, Homo sapiens
  misc_feature: GYAE6OF01ELDNR.29.85.H08.1.454.CMB.1.raw
  modified_base (147)..(147): a, c, t, g, unknown or other
  misc_feature (147)..(147): n is a, c, g, or t
tcagatagagtactcacgaccggtgctcgatttagtatcactcagtcgcggacacgactggagattaacgaactgtggctgcaccatctgtcttcatcttccgccatctgaatagcgtactctgagcgggctggcaaggcgcatagn

SEQ ID NO: 93401 - DNA, 150 bp, Homo sapiens
  misc_feature: GYAE6OF01EM39K.29.85.H08.1.454.CMB.1.raw
  modified_base (150)..(150): a, c, t, g, unknown or other
  misc_feature (150)..(150): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgagcgggctggcaaggcgcatagn

SEQ ID NO: 93402 - DNA, 165 bp, Homo sapiens
  misc_feature: GYAE6OF01EGPZB.29.85.H08.1.454.CMB.1.raw
  modified_base (151)..(165): a, c, t, g, unknown or other
  misc_feature (151)..(165): n is a, c, g, or t
tcagatagagtactcacgaccggtgctcgatttagtatcactcagtcgcgggacgacgactggagattaaacgaactgtggctgcaccatctgtcttcatcttcccgccatctgaatagcgtactctgagcgggctggcaaggcgcatagnnnnnnnnnnnnnnn

SEQ ID NO: 93403 - DNA, 181 bp, Homo sapiens
  misc_feature: GYAE6OF01D5QEA.29.85.H08.1.454.CMB.1.raw
  modified_base (152)..(154): a, c, t, g, unknown or other
  misc_feature (152)..(154): n is a, c, g, or t
  modified_base (156)..(181): a, c, t, g, unknown or other
  misc_feature (156)..(181): n is a, c, g, or t
tcagatagagtactcacgaccggtgctcgatttagtatcactcaggtcgcgggacacgactggagattaaacgaactgtggctgcaccatctgtccttcatcttcccgccatctgaatagcgtactctgagcgggctggcaaggcgcatagnnncnnnnnnnnnnnnnnnnnnnnnnnnnn

SEQ ID NO: 93404 - DNA, 152 bp, Homo sapiens
  misc_feature: GYAE6OF01BOSYN.29.85.H08.1.454.CMB.1.raw
  modified_base (149)..(152): a, c, t, g, unknown or other
  misc_feature (149)..(152): n is a, c, g, or t
tcagatagagtactcacgaccggtgctcgatttagtatcactcagtcgcgggacacgactggagattaaacgaactgtggctgcaccatctgtcttcatcttccgccatctgaatagcgtactctgagcgggctggcaaggcgcatagnnnn

SEQ ID NO: 93405 - DNA, 150 bp, Homo sapiens; identical to SEQ ID NO: 93401
  misc_feature: GYAE6OF01BN44H.29.85.H08.1.454.CMB.1.raw
  modified_base (150)..(150): a, c, t, g, unknown or other
  misc_feature (150)..(150): n is a, c, g, or t

SEQ ID NO: 93406 - DNA, 158 bp, Homo sapiens
  misc_feature: GYAE6OF01AHPL3.29.85.H08.1.454.CMB.1.raw
  modified_base (149)..(158): a, c, t, g, unknown or other
  misc_feature (149)..(158): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgagcggctggcaaggcgcatagnnnnnnnnnn

SEQ ID NO: 93407 - DNA, 149 bp, Homo sapiens
  misc_feature: GYAE6OF01DOP4C.29.85.H08.1.454.CMB.1.raw
  modified_base (149)..(149): a, c, t, g, unknown or other
  misc_feature (149)..(149): n is a, c, g, or t
tcagatagagtactcacgaccggtgctcgatttagtatcactcagtcgcgggacacgactggagattaaacgaactgtggctgcaccatctgtcttcatcttccgccatctgaatagcgtactctgagcgggctggcaaggcgcatagn

SEQ ID NO: 93408 - DNA, 149 bp, Homo sapiens
  misc_feature: GYAE6OF01CLL20.29.85.H08.1.454.CMB.1.raw
  modified_base (148)..(149): a, c, t, g, unknown or other
  misc_feature (148)..(149): n is a, c, g, or t
tcagatagagtactcacgaccggtgctcgatttagtatcactcagtcgcgggacacgactggagattaacgaactgtggctgcaccatctgtcttcatcttcccgccatctgaatagcgtactctgagcggctggcaaggcgcatagnn

SEQ ID NO: 93409 - DNA, 151 bp, Homo sapiens
  misc_feature: GYAE6OF01BX3KF.29.85.H08.1.454.CMB.1.raw
  modified_base (150)..(151): a, c, t, g, unknown or other
  misc_feature (150)..(151): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgagcgggctggcaaggcgcatagnn

SEQ ID NO: 93410 - DNA, 150 bp, Homo sapiens; identical to SEQ ID NO: 93401
  misc_feature: GYAE6OF01COQM9.29.85.H08.1.454.CMB.1.raw
  modified_base (150)..(150): a, c, t, g, unknown or other
  misc_feature (150)..(150): n is a, c, g, or t

SEQ ID NO: 93411 - DNA, 181 bp, Homo sapiens
  misc_feature: GYAE6OF01CI5QS.29.85.H08.1.454.CMB.1.raw
  modified_base (153)..(181): a, c, t, g, unknown or other
  misc_feature (153)..(181): n is a, c, g, or t
tcagatagagtactcacgaccggtgctcgatttagtatcactcaggtcggcgggacacgactggagattaaacgaactgtggctgcaccagtctgtcttcactcttcccgcatctgaatagcgtactctgagcgggctggcaaggcgcatagnnnnnnnnnnnnnnnnnnnnnnnnnnnnn

SEQ ID NO: 93412 - DNA, 155 bp, Homo sapiens
  misc_feature: GYAE6OF01A8X32.29.85.H08.1.454.CMB.1.raw
  modified_base (149)..(155): a, c, t, g, unknown or other
  misc_feature (149)..(155): n is a, c, g, or t
tcagatagagtactcacgaccggtgctcgatttagtatcactcagtcgcgggacacgactggagattaaacgaactgtggctgcaccatctgtcttcatcttccgccatctgaatagcgtactctgagcgggctggcaaggcgcatagnnnnnnn

SEQ ID NO: 93413 - DNA, 150 bp, Homo sapiens; identical to SEQ ID NO: 93401
  misc_feature: GYAE6OF01BV5J4.29.85.H08.1.454.CMB.1.raw
  modified_base (150)..(150): a, c, t, g, unknown or other
  misc_feature (150)..(150): n is a, c, g, or t

SEQ ID NO: 93414 - DNA, 151 bp, Homo sapiens; identical to SEQ ID NO: 93409
  misc_feature: GYAE6OF01BITBD.29.85.H08.1.454.CMB.1.raw
  modified_base (150)..(151): a, c, t, g, unknown or other
  misc_feature (150)..(151): n is a, c, g, or t

SEQ ID NO: 93415 - DNA, 190 bp, Homo sapiens
  misc_feature: GYAE6OF01B9MSK.29.85.H08.1.454.CMB.1.raw
  modified_base (150)..(190): a, c, t, g, unknown or other
  misc_feature (150)..(190): n is a, c, g, or t
tcagatagagtactcacgaccggtgctcgatttagtatcactcagtcgcggacacgactggagattaaacgaactgtggctgcaccatctgtcttcatcttacccgccatctgaatagcgtactctgagcgggctggcaaggcgcatagnnnnnnnnnnnnnnnnnnnnnnnnnnnnnnnnnnnnnnnnn

SEQ ID NO: 93416 - DNA, 197 bp, Homo sapiens
  misc_feature: GYAE6OF01DLIWR.29.85.H08.1.454.CMB.1.raw
  modified_base (150)..(197): a, c, t, g, unknown or other
  misc_feature (150)..(197): n is a, c, g, or t
tcagatagagtactcacgaccggtgctcgatttagtatcactcagtcgcgggacacgactggagattaaacgaactgtggctgcaccatctgtcttcatcttacccgcatctgaatagcgtactctgagcgggctggcaaggcgcatagnnnnnnnnnnnnnnnnnnnnnnnnnnnnnnnnnnnnnnnnnnnnnnnn

SEQ ID NO: 93417 - DNA, 150 bp, Homo sapiens; identical to SEQ ID NO: 93401
  misc_feature: GYAE6OF01CENLC.29.85.H08.1.454.CMB.1.raw
  modified_base (150)..(150): a, c, t, g, unknown or other
  misc_feature (150)..(150): n is a, c, g, or t

SEQ ID NO: 93418 - DNA, 150 bp, Homo sapiens; identical to SEQ ID NO: 93401
  misc_feature: GYAE6OF01EW983.29.85.H08.1.454.CMB.1.raw
  modified_base (150)..(150): a, c, t, g, unknown or other
  misc_feature (150)..(150): n is a, c, g, or t

SEQ ID NO: 93419 - DNA, 149 bp, Homo sapiens
  misc_feature: GYAE6OF01BXDCW.29.85.H08.1.454.CMB.1.raw
  modified_base (149)..(149): a, c, t, g, unknown or other
  misc_feature (149)..(149): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgagcggctggcaaggcgcatagn

SEQ ID NO: 93420 - DNA, 145 bp, Homo sapiens
  misc_feature: GYAE6OF01CT3ZV.29.85.H08.1.454.CMB.1.raw
  modified_base (145)..(145): a, c, t, g, unknown or other
  misc_feature (145)..(145): n is a, c, g, or t
tcagatagagtactcacgaccggtgctcgattagtatcactcagtcgcggacacgactggagattaacgaactgtggctgcaccatctgtcttcatcttccgccatctgaatagcgtactctgagcggctggcaaggcgcatagn

SEQ ID NO: 93421 - DNA, 150 bp, Homo sapiens; identical to SEQ ID NO: 93401
  misc_feature: GYAE6OF01AVWZ7.29.85.H08.1.454.CMB.1.raw
  modified_base (150)..(150): a, c, t, g, unknown or other
  misc_feature (150)..(150): n is a, c, g, or t

SEQ ID NO: 93422 - DNA, 150 bp, Homo sapiens; identical to SEQ ID NO: 93401
  misc_feature: GYAE6OF01DFCTQ.29.85.H08.1.454.CMB.1.raw
  modified_base (150)..(150): a, c, t, g, unknown or other
  misc_feature (150)..(150): n is a, c, g, or t

SEQ ID NO: 93423 - DNA, 150 bp, Homo sapiens; identical to SEQ ID NO: 93401
  misc_feature: GYAE6OF01ECVTM.29.85.H08.1.454.CMB.1.raw
  modified_base (150)..(150): a, c, t, g, unknown or other
  misc_feature (150)..(150): n is a, c, g, or t

SEQ ID NO: 93424 - DNA, 150 bp, Homo sapiens; identical to SEQ ID NO: 93401
  misc_feature: GYAE6OF01EEFIY.29.85.H08.1.454.CMB.1.raw
  modified_base (150)..(150): a, c, t, g, unknown or other
  misc_feature (150)..(150): n is a, c, g, or t

SEQ ID NO: 93425 - DNA, 150 bp, Homo sapiens; identical to SEQ ID NO: 93401
  misc_feature: GYAE6OF01DCYCR.29.85.H08.1.454.CMB.1.raw
  modified_base (150)..(150): a, c, t, g, unknown or other
  misc_feature (150)..(150): n is a, c, g, or t

SEQ ID NO: 93426 - DNA, 150 bp, Homo sapiens; identical to SEQ ID NO: 93401
  misc_feature: GYAE6OF01D095H.29.85.H08.1.454.CMB.1.raw
  modified_base (150)..(150): a, c, t, g, unknown or other
  misc_feature (150)..(150): n is a, c, g, or t

SEQ ID NO: 93427 - DNA, 149 bp, Homo sapiens
  misc_feature: GYAE6OF01CEMO5.29.85.H08.1.454.CMB.1.raw
  modified_base (149)..(149): a, c, t, g, unknown or other
  misc_feature (149)..(149): n is a, c, g, or t
tcagatagagtactcacgaccggtgctcgatttagtatcactcagtcgcgggacacgactggagattaaacgaactgtggctgcaccatctgtcttcatttcccgccatctgaatagcgtactctgagcgggctggcaaggcgcatagn

SEQ ID NO: 93428 - DNA, 151 bp, Homo sapiens; identical to SEQ ID NO: 93409
  misc_feature: GYAE6OF01AYX6E.29.85.H08.1.454.CMB.1.raw
  modified_base (150)..(151): a, c, t, g, unknown or other
  misc_feature (150)..(151): n is a, c, g, or t

SEQ ID NO: 93429 - DNA, 150 bp, Homo sapiens; identical to SEQ ID NO: 93401
  misc_feature: GYAE6OF01ANH8D.29.85.H08.1.454.CMB.1.raw
  modified_base (150)..(150): a, c, t, g, unknown or other
  misc_feature (150)..(150): n is a, c, g, or t

SEQ ID NO: 93430 - DNA, 151 bp, Homo sapiens; identical to SEQ ID NO: 93409
  misc_feature: GYAE6OF01ADOU6.29.85.H08.1.454.CMB.1.raw
  modified_base (150)..(151): a, c, t, g, unknown or other
  misc_feature (150)..(151): n is a, c, g, or t

SEQ ID NO: 93431 - DNA, 150 bp, Homo sapiens; identical to SEQ ID NO: 93401
  misc_feature: GYAE6OF01D9E89.29.85.H08.1.454.CMB.1.raw
  modified_base (150)..(150): a, c, t, g, unknown or other
  misc_feature (150)..(150): n is a, c, g, or t

SEQ ID NO: 93432 - DNA, 150 bp, Homo sapiens; identical to SEQ ID NO: 93401
  misc_feature: GYAE6OF01D6B4U.29.85.H08.1.454.CMB.1.raw
  modified_base (150)..(150): a, c, t, g, unknown or other
  misc_feature (150)..(150): n is a, c, g, or t

SEQ ID NO: 93433 - DNA, 150 bp, Homo sapiens; identical to SEQ ID NO: 93401
  misc_feature: GYAE6OF01EY5AA.29.85.H08.1.454.CMB.1.raw
  modified_base (150)..(150): a, c, t, g, unknown or other
  misc_feature (150)..(150): n is a, c, g, or t

SEQ ID NO: 93434 - DNA, 150 bp, Homo sapiens
  misc_feature: GYAE6OF01DL20N.29.85.H08.1.454.CMB.1.raw
  modified_base (149)..(150): a, c, t, g, unknown or other
  misc_feature (149)..(150): n is a, c, g, or t
tcagatagagtactcacgaccggtgctcgatttagtatcactcagtcgcgggacacgactggagattaacgaactgtggctgcaccatctgtcttcatcttcccgccatctgaatagcgtactctgagcgggctggcaaggcgcatagnn

SEQ ID NO: 93435 - DNA, 464 bp, Homo sapiens
  misc_feature: GYAE6OF01E15GF.29.85.H08.1.454.CMB.1.raw
  modified_base (334)..(334): a, c, t, g, unknown or other
  misc_feature (334)..(334): n is a, c, g, or t
  modified_base (460)..(464): a, c, t, g, unknown or other
  misc_feature (460)..(464): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgccctccctgaccatctctgggctccaggctgacgatgacggtgattattactgctgctcatttgcaggcacccgnactgtgatcttcgggcggagggaccaagcctgaccgtccaggtcagctcaaggctcgccccctcggtcactctcgttccccgccctcctcagtactctatctgagcgggctggcaaggcgcatagnnnnn

SEQ ID NO: 93436 - DNA, 425 bp, Homo sapiens
  misc_feature: GYAE6OF01CYRZF.29.85.H08.1.454.CMB.1.raw
  modified_base (412)..(425): a, c, t, g, unknown or other
  misc_feature (412)..(425): n is a, c, g, or t
tcagatagagtactcacgaccggtgctcgatttagtatcactcagtcagtcaccatactcctgcactggaaccagcagcgatgtcggtggttataactttgtctcctggtaccaacaacacccaggcgaggcccccgactcataatttatgatgtcattaagcggccctcaggggtccctgatcgcttctctggctccaagtctggcaacactgcctccctgaccatctctgggctccaggctgacgatgacggtgattattactgctgctcatttgcaggcaccgcactgtgatcttcggcgagggaccaagctgaccgtctaggtcagctcaaggctgccccctggtcactctcgttcccaccctcctcacgtactctatctgagcgggctgggcaagggcgcagtacgnnnnnnnnnnnnnn

SEQ ID NO: 93437 - DNA, 153 bp, Homo sapiens
  misc_feature: GYAE6OF01CEYC7.29.85.H08.1.454.CMB.1.raw
  modified_base (150)..(153): a, c, t, g, unknown or other
  misc_feature (150)..(153): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgagcgggctggcaaggcgcatagnnnn

SEQ ID NO: 93438 - DNA, 150 bp, Homo sapiens; identical to SEQ ID NO: 93401
  misc_feature: GYAE6OF01DWPO2.29.85.H08.1.454.CMB.1.raw
  modified_base (150)..(150): a, c, t, g, unknown or other
  misc_feature (150)..(150): n is a, c, g, or t

SEQ ID NO: 93439 - DNA, 150 bp, Homo sapiens; identical to SEQ ID NO: 93401
  misc_feature: GYAE6OF01DG3XU.29.85.H08.1.454.CMB.1.raw
  modified_base (150)..(150): a, c, t, g, unknown or other
  misc_feature (150)..(150): n is a, c, g, or t

SEQ ID NO: 93440 - DNA, 149 bp, Homo sapiens
  misc_feature: GYAE6OF01COBU1.29.85.H08.1.454.CMB.1.raw
  modified_base (148)..(149): a, c, t, g, unknown or other
  misc_feature (148)..(149): n is a, c, g, or t
tcagatagagtactcacgaccggtgctcgatttagtatcactcagtcgcggacacgactggagattaaacgaactgtggctgcaccatctgtcttcatcttcccgccatctgaatagcgtactctgagcggctggcaaggcgcatagnn

SEQ ID NO: 93441 - DNA, 501 bp, Homo sapiens
  misc_feature: GYAE6OF01A86F9.29.85.H08.1.454.CMB.1.raw
  modified_base (224)..(224): a, c, t, g, unknown or other
  misc_feature (224)..(224): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
  modified_base (427)..(427): a, c, t, g, unknown or other
  misc_feature (427)..(427): n is a, c, g, or t
tcagatagagtactcacgaccggtgctcgatttagtatcactcagtcggcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtggttataactttgtctctggtaccaacaacaccaggcacggcccccgactcataatttatgatgtacattaacgcgccctcgacggggtccctgactcgcttctctggctccaagtctggcaacactcgcctcctgaccatctctcgggctccgagctgacgntgacggtnattacttactgctgcctntattgcacggcaccgcacgtgtcatcgttcgggcggaggacaagctacgacccgtcgtacgcagcctcgaacgg

SEQ ID NO: 93442 - DNA, 194 bp, Homo sapiens
  misc_feature: GYAE6OF01C50RG.29.85.H08.1.454.CMB.1.raw
  modified_base (156)..(194): a, c, t, g, unknown or other
  misc_feature (156)..(194): n is a, c, g, or t
tcagatagagtactcacgaccggtgctcgatttagtatcactcagtcggcgggacacgactggagatttaaacgaacctgtggctgcaaccatctgtcttcatcttcccgccatctgaatagcgtactctgagcgggactggcaaaggcgcatagnnnnnnnnnnnnnnnnnnnnnnnnnnnnnnnnnnnnnnn

SEQ ID NO: 93443 - DNA, 150 bp, Homo sapiens
  misc_feature: GYAE6OF01EYCZ4.29.85.H08.1.454.CMB.1.raw
tcagatagagtactcacgaccggtgctcgatttagtatcactcagtcgcgggacacgactggagattaaacgaactgtggctgcaccatctgtcttcatcttcccgccatctgaatagcgtactctgagcgggctggcaaggcgcatagt

SEQ ID NO: 93444 - DNA, 155 bp, Homo sapiens
  misc_feature: GYAE6OF01C03K2.29.85.H08.1.454.CMB.1.raw
  modified_base (150)..(155): a, c, t, g, unknown or other
  misc_feature (150)..(155): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgagcgggctggcaaggcgcatagnnnnnn

SEQ ID NO: 93445 - DNA, 150 bp, Homo sapiens; identical to SEQ ID NO: 93401
  misc_feature: GYAE6OF01D7OWD.29.85.H08.1.454.CMB.1.raw
  modified_base (150)..(150): a, c, t, g, unknown or other
  misc_feature (150)..(150): n is a, c, g, or t

SEQ ID NO: 93446 - DNA, 150 bp, Homo sapiens; identical to SEQ ID NO: 93401
  misc_feature: GYAE6OF01AS5KX.29.85.H08.1.454.CMB.1.raw
  modified_base (150)..(150): a, c, t, g, unknown or other
  misc_feature (150)..(150): n is a, c, g, or t

SEQ ID NO: 93447 - DNA, 292 bp, Homo sapiens
  misc_feature: GYAE6OF01DCA50.29.85.H08.1.454.CMB.1.raw
  modified_base (290)..(292): a, c, t, g, unknown or other
  misc_feature (290)..(292): n is a, c, g, or t
tcagatagagtactcacgaccggtgctcgatttagtatcactcagtcgcgggtccctgatcgcttctctggctccaagtctggcaacactgcctccctgaccatctctgggctccaggctgacgatgacggtgattattactgctgctcatttgcaggcacccgcactgtgatcttcggcggagggaccaagctgaccgtcctaggtcagctcaaggctgccccctcggtcacctctcgttcccgccctcctcacgtactctatctgagcgggctggcaaggcgcatagnnn

SEQ ID NO: 93448 - DNA, 159 bp, Homo sapiens
  misc_feature: GYAE6OF01BYJPO.29.85.H08.1.454.CMB.1.raw
  modified_base (150)..(159): a, c, t, g, unknown or other
  misc_feature (150)..(159): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgagcgggctggcaaggcgcatagnnnnnnnnnn

SEQ ID NO: 93449 - DNA, 154 bp, Homo sapiens
  misc_feature: GYAE6OF01EK4DI.29.85.H08.1.454.CMB.1.raw
  modified_base (150)..(154): a, c, t, g, unknown or other
  misc_feature (150)..(154): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgagcgggctggcaaggcgcatagnnnnn

SEQ ID NO: 93450 - DNA, 150 bp, Homo sapiens; identical to SEQ ID NO: 93401
  misc_feature: GYAE6OF01EPNZD.29.85.H08.1.454.CMB.1.raw
  modified_base (150)..(150): a, c, t, g, unknown or other
  misc_feature (150)..(150): n is a, c, g, or t

SEQ ID NO: 93451 - DNA, 176 bp, Homo sapiens
  misc_feature: GYAE6OF01DFBKZ.29.85.H08.1.454.CMB.1.raw
  modified_base (153)..(176): a, c, t, g, unknown or other
  misc_feature (153)..(176): n is a, c, g, or t
tcagatagagtactcacgaccggtgctcgatttagtatcactcagtcgcgggacacgactggagattaaacgaactgtggctgcaccgatctgtcttcatcttcccgccatcgtgaatagcgtactctgaggcgggctggcaaggcgcatagnnnnnnnnnnnnnnnnnnnnnnnn

SEQ ID NO: 93452 - DNA, 150 bp, Homo sapiens; identical to SEQ ID NO: 93401
  misc_feature: GYAE6OF01ESTAJ.29.85.H08.1.454.CMB.1.raw
  modified_base (150)..(150): a, c, t, g, unknown or other
  misc_feature (150)..(150): n is a, c, g, or t

SEQ ID NO: 93453 - DNA, 150 bp, Homo sapiens; identical to SEQ ID NO: 93401
  misc_feature: GYAE6OF01C7PID.29.85.H08.1.454.CMB.1.raw
  modified_base (150)..(150): a, c, t, g, unknown or other
  misc_feature (150)..(150): n is a, c, g, or t

SEQ ID NO: 93454 - DNA, 497 bp, Homo sapiens
  misc_feature: GYAE6OF01BV7H0.29.85.H08.1.454.CMB.1.raw
  modified_base (407)..(407): a, c, t, g, unknown or other
  misc_feature (407)..(407): n is a, c, g, or t
tcagatagagtactcacgaccggtgctcgatttagtatcactcagtcgcggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacacccaggcgacggccccccgactcataatttatgatgtcattaagcggccctcaggggtccctgatcgcttctctggctccaagtctggcaacactgccctccctgaccatctctgggctccaggctgacgatgacggtnattattactgctgcttcatttgcaggccacccgcactgtgatcgttcgggcggtagggaccagctgacccgtctaggtcagctcgaacgg

SEQ ID NO: 93455 - DNA, 161 bp, Homo sapiens
  misc_feature: GYAE6OF01BZADD.29.85.H08.1.454.CMB.1.raw
  modified_base (150)..(161): a, c, t, g, unknown or other
  misc_feature (150)..(161): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgagcgggctggcaaggcgcatagnnnnnnnnnnnn

SEQ ID NO: 93456 - DNA, 150 bp, Homo sapiens; identical to SEQ ID NO: 93401
  misc_feature: GYAE6OF01BE8ZA.29.85.H08.1.454.CMB.1.raw
  modified_base (150)..(150): a, c, t, g, unknown or other
  misc_feature (150)..(150): n is a, c, g, or t

SEQ ID NO: 93457 - DNA, 150 bp, Homo sapiens; identical to SEQ ID NO: 93401
  misc_feature: GYAE6OF01AHZOO.29.85.H08.1.454.CMB.1.raw
  modified_base (150)..(150): a, c, t, g, unknown or other
  misc_feature (150)..(150): n is a, c, g, or t

SEQ ID NO: 93458 - DNA, 149 bp, Homo sapiens
  misc_feature: GYAE6OF01CWUNF.29.85.H08.1.454.CMB.1.raw
  modified_base (149)..(149): a, c, t, g, unknown or other
  misc_feature (149)..(149): n is a, c, g, or t
tcagatagagtactcacgaccggtgctcgatttagtatcactcagtcgcgggacacgactggagattaaacgaactgtggctgcaccatctgtcttcatcttccagccatctgaatagcgtactctgagcggctggcaaggcgcatagn

SEQ ID NO: 93459 - DNA, 208 bp, Homo sapiens
  misc_feature: GYAE6OF01B274H.29.85.H08.1.454.CMB.1.raw
  modified_base (157)..(208): a, c, t, g, unknown or other
  misc_feature (157)..(208): n is a, c, g, or t
tcagatagagtactcacgaccggtgctcgatttagtatcactcagtcgcgggactacgggactggagattaaacgaactgtggctgcaccatctgtcttcatcttcccggccatctgaatagcgtactctgagcgggctgggcaaggcgcagtacgnnnnnnnnnnnnnnnnnnnnnnnnnnnnnnnnnnnnnnnnnnnnnnnnnnnn

SEQ ID NO: 93460 - DNA, 191 bp, Homo sapiens
  misc_feature: GYAE6OF01C5DUZ.29.85.H08.1.454.CMB.1.raw
  modified_base (154)..(191): a, c, t, g, unknown or other
  misc_feature (154)..(191): n is a, c, g, or t
tcagatagagtactcacgaccggtgctcgatttagtatcactcaggtacggcgggacacgacgtggagattaaacgaactgtggctgcaccatctgtcttcatcttcccgccatctgaatagcgtactctgagcgggctggcaaggcgcatagnnnnnnnnnnnnnnnnnnnnnnnnnnnnnnnnnnnnnn

SEQ ID NO: 93461 - DNA, 559 bp, Homo sapiens
  misc_feature: GYAE6OF01CMD3V.29.85.H08.1.454.CMB.1.raw
  modified_base (292)..(292): a, c, t, g, unknown or other
  misc_feature (292)..(292): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatctcctgcactggaaccagcagcgatgtcgtgttatacttgtctctgtaccaacaacaccaggcgacggcccccgatcataattangatgtcattaacgcggcctcacggggtccctgatcgcttctctggctccaagtctcggacaacactcgcctccctgaccctatctcgtcgggcctacccgaggtctacggacgatcggacggttacgtatttacttactgcctgtctactatttggacctacgggccaaccccggctaacgtgtcgacgttccgttcggggacggaagggacccaaaggcccttaggacccgttaccgtacggtactacggcccgttcgaaaccggg

SEQ ID NO: 93462 - DNA, 467 bp, Homo sapiens
  misc_feature: GYAE6OF01BNSDQ.29.85.H08.1.454.CMB.1.raw
  modified_base (333)..(333): a, c, t, g, unknown or other
  misc_feature (333)..(333): n is a, c, g, or t
  modified_base (455)..(467): a, c, t, g, unknown or other
  misc_feature (455)..(467): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattattactgctgctcatttgcaggcacccgnactgtgatcttcggcggagggaccaagctgaccgtcctaggtcagctcaaggctcgcccctcggtcactctcgttcccgccctcctcagtactctatctgagcggctggcaaggcgcatagnnnnnnnnnnnnn

SEQ ID NO: 93463 - DNA, 150 bp, Homo sapiens; identical to SEQ ID NO: 93401
  misc_feature: GYAE6OF01A36XG.29.85.H08.1.454.CMB.1.raw
  modified_base (150)..(150): a, c, t, g, unknown or other
  misc_feature (150)..(150): n is a, c, g, or t

SEQ ID NO: 93464 - DNA, 149 bp, Homo sapiens
  misc_feature: GYAE6OF01EG5O3.29.85.H08.1.454.CMB.1.raw
tcagatagagtactcacgaccggtgctcgatttagtatcactcagtcgcgggacacgactggagattaaacgaactgtggctgcaccatctgtcttcatcttcccgccatctgaatagcgtactctgagcgggctggcaaggcgcatag

SEQ ID NO: 93465 - DNA, 150 bp, Homo sapiens
  misc_feature: GYAE6OF01A54KV.29.85.H08.1.454.CMB.1.raw
  modified_base (149)..(150): a, c, t, g, unknown or other
  misc_feature (149)..(150): n is a, c, g, or t
tcagatagagtactcacgaccggtgctcgatttagtatcactcagtcgcggacacgactggagattaaacgaactgtggctgcaccatctgtcttcatcttcccgccatctgaatagcgtactctgagcgggctggcaaggcgcatagnn

SEQ ID NO: 93466 - DNA, 150 bp, Homo sapiens; identical to SEQ ID NO: 93401
  misc_feature: GYAE6OF01D0F5X.29.85.H08.1.454.CMB.1.raw
  modified_base (150)..(150): a, c, t, g, unknown or other
  misc_feature (150)..(150): n is a, c, g, or t

SEQ ID NO: 93467 - DNA, 490 bp, Homo sapiens
  misc_feature: GYAE6OF01EWOJA.29.85.H08.1.454.CMB.1.raw
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcgtggttataactttgtctcctggtaccaacaacacccaggcgaggccccccgactcataatttatgatgtcattaagcggccctcaggggtccctgatcgcttctctggctccaagtctggccaacactgcctcctgaccatctctgggctccaggctgacgatgacgtgattattactgctgctcatttgctaggcacccgcactgtgatctcgggcggaggaccaagctgacccgtctaggtcagctcgaacgg

SEQ ID NO: 93468 - DNA, 151 bp, Homo sapiens; identical to SEQ ID NO: 93409
  misc_feature: GYAE6OF01CBIGG.29.85.H08.1.454.CMB.1.raw
  modified_base (150)..(151): a, c, t, g, unknown or other
  misc_feature (150)..(151): n is a, c, g, or t

SEQ ID NO: 93469 - DNA, 150 bp, Homo sapiens; identical to SEQ ID NO: 93401
  misc_feature: GYAE6OF01DI2QK.29.85.H08.1.454.CMB.1.raw
  modified_base (150)..(150): a, c, t, g, unknown or other
  misc_feature (150)..(150): n is a, c, g, or t

SEQ ID NO: 93470 - DNA, 509 bp, Homo sapiens
  misc_feature: GYAE6OF01ACZNK.29.85.H08.1.454.CMB.1.raw
  modified_base (340)..(340): a, c, t, g, unknown or other
  misc_feature (340)..(340): n is a, c, g, or t
  modified_base (407)..(407): a, c, t, g, unknown or other
  misc_feature (407)..(407): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgttataactttgtctctggtaccaacaacacccaggcgacggccccccgatcataatttatgatgtcattaagcggccctcgaggggtccctgactcgcttcnctggctccaagtctggcaacactgcctccctgaccatctctgggctccgaggctgacgatgacggtnattatactgctgctctatttgcacggtccacccgctacgtgtgtactcgttacgggcggaaggaccaagccgtcgacccgtctacggtcagtcctgaaccgg

SEQ ID NO: 93471 - DNA, 177 bp, Homo sapiens
  misc_feature: GYAE6OF01ER2OP.29.85.H08.1.454.CMB.1.raw
  modified_base (154)..(177): a, c, t, g, unknown or other
  misc_feature (154)..(177): n is a, c, g, or t
tcagatagagtactcacgaccggtgctcgatttagtatcactcagtcgtcggggacacgactggagattaaacgaactgtggctgcaccatctgtcttcatcttccccgccatctgaatagcgtactctgagcgggctggcaaggcgcatagcnnnnnnnnnnnnnnnnnnnnnnnn

SEQ ID NO: 93472 - DNA, 150 bp, Homo sapiens; identical to SEQ ID NO: 93401
  misc_feature: GYAE6OF01CHF8J.29.85.H08.1.454.CMB.1.raw
  modified_base (150)..(150): a, c, t, g, unknown or other
  misc_feature (150)..(150): n is a, c, g, or t

SEQ ID NO: 93473 - DNA, 608 bp, Homo sapiens
  misc_feature: GYAE6OF01BA67O.29.85.H08.1.454.CMB.1.raw
  modified_base (229)..(229): a, c, t, g, unknown or other
  misc_feature (229)..(229): n is a, c, g, or t
  modified_base (509)..(509): a, c, t, g, unknown or other
  misc_feature (509)..(509): n is a, c, g, or t
tcagatagagtactcacgaccggtgctcgatttagtatcactcagtcgggcggggggggtctcaggaggcagcactctcgggacgtctccaccatggcctgggctctgctcctcctcagcctcctcactcagggcacaggatccgtgggctcagtctgccctgactcagcctcgctcagtcgtccgggtctcctggacagtcagtcaccatcctcctgcactggaaccngcagcgatggtcggtggttataactttgtctctggtaccaacaacaccaggcgacggcccccgatcaattaatttatgatgtcaattaagcggccctcgacggggtccctgactcgcttctctggctccaagtctggaccaacactcgccttccagacctatctcgtgggccttccgaggcctaggaccgagtacggacgggttgtaactttacgtttacgtcgtacgttgtaccttactacgttttcgcgtacgggtacccaacccggactacggggtnttcggtacttccggtttaccggggaccggggaacgggaacccgtaaaggtccgtacggtacccggttccggtaaggtccgacggtctaccggtaaccgg

SEQ ID NO: 93474 - DNA, 416 bp, Homo sapiens
  misc_feature: GYAE6OF01C2QZH.29.85.H08.1.454.CMB.1.raw
  modified_base (407)..(416): a, c, t, g, unknown or other
  misc_feature (407)..(416): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattattactgctgctcatttgcaggcacccgcactgtgatcttcggcggagggaccaagctgaccgtctaggtcagctcaggctcgcccctggtcactctcgttcccaccctctcagtactctatctgagcgggctggcaaggcgcatagnnnnnnnnnn

SEQ ID NO: 93475 - DNA, 152 bp, Homo sapiens
  misc_feature: GYAE6OF01A4JY3.29.85.H08.1.454.CMB.1.raw
  modified_base (150)..(152): a, c, t, g, unknown or other
  misc_feature (150)..(152): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgagcgggctggcaaggcgcatagnnn

SEQ ID NO: 93476 - DNA, 151 bp, Homo sapiens; identical to SEQ ID NO: 93409
  misc_feature: GYAE6OF01C2S7U.29.85.H08.1.454.CMB.1.raw
  modified_base (150)..(151): a, c, t, g, unknown or other
  misc_feature (150)..(151): n is a, c, g, or t

SEQ ID NO: 93477 - DNA, 514 bp, Homo sapiens
  misc_feature: GYAE6OF01C23JO.29.85.H08.1.454.CMB.1.raw
  modified_base (363)..(363): a, c, t, g, unknown or other
  misc_feature (363)..(363): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgttataactttgtctctgtaccaacaacaccaggcgacggccccccgatcataatttatgatgtcattaacgcggaccctcgacggggtccctgactcgcttctctgctccaagtctggacaacnctcgcctcctgacctactctcgtgggccttccgaggctgacgatggacggtgattattacgtgtctgtctctatttcgcacggtccacccgcactgtcgacttcgtcggcggaggaccaagccgtgacccgtcgtaggcacgcgtgtacgg

SEQ ID NO: 93478 - DNA, 508 bp, Homo sapiens
  misc_feature: GYAE6OF01CSFBH.29.85.H08.1.454.CMB.1.raw
  modified_base (220)..(220): a, c, t, g, unknown or other
  misc_feature (220)..(220): n is a, c, g, or t
  modified_base (438)..(438): a, c, t, g, unknown or other
  misc_feature (438)..(438): n is a, c, g, or t
tcagatagagtactcacgaccggtgctcgatttagtatcactcagtcgcggggggtctcaggaggcagcactctcgggacgtctccaccatggcctggctctgctcctcctcagcctcctcactcagggcacaggatcctgggctcagtctgccctgactcagcctcgctcagtgtccggtctcctggacagtcagtcaccatctcctgcactggaaccngcagcgatgcgtggttataactttgtctcctggtaccaacaacacccaggcgaggccccccgatcataatttatcgatgtcatttaagccggccctcaggggtccctgactcgcttctctggctccaagtctggcaacactgcctcctgaccatctctggctccaggctgacgatgacgtgattattactgcttgcttcattttgctaggccacccgnaccgtgtcgactcgttcgggcggagggaccaagtcctgtacccgtcctaaggtcacggcctcgtaacggg

SEQ ID NO: 93479 - DNA, 485 bp, Homo sapiens
  misc_feature: GYAE6OF01C6NTS.29.85.H08.1.454.CMB.1.raw
  modified_base (298)..(298): a, c, t, g, unknown or other
  misc_feature (298)..(298): n is a, c, g, or t
  modified_base (408)..(408): a, c, t, g, unknown or other
  misc_feature (408)..(408): n is a, c, g, or t
  modified_base (415)..(415): a, c, t, g, unknown or other
  misc_feature (415)..(415): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacacccaggcgaggcccccgatcataatttangatgtcattaagcgcctcagggtccctgactcgcttctctggctcaagtctggcaacactgcctcctgaccatctctgggctccagctgacgatgacggtgattattacngctgctnatttgctacggcacccgcactgtgactcttcggcggaggaccaagctgaccgtctaggtcagctgaacgg

SEQ ID NO: 93480 - DNA, 156 bp, Homo sapiens
  misc_feature: GYAE6OF01DQZNF.29.85.H08.1.454.CMB.1.raw
  modified_base (151)..(156): a, c, t, g, unknown or other
  misc_feature (151)..(156): n is a, c, g, or t
tcagatagagtactcacgaccggtgctcgatttagtatcactcagtcgcgggacgacgactggagattaaacgaactgtggctgcaccatctgtcttcatcttcccgccatctgaatagcgtactctgagcgggctggcaaggcgcatagnnnnnn

SEQ ID NO: 93481 - DNA, 415 bp, Homo sapiens
  misc_feature: GYAE6OF01A6GCE.29.85.H08.1.454.CMB.1.raw
  modified_base (411)..(415): a, c, t, g, unknown or other
  misc_feature (411)..(415): n is a, c, g, or t
tcagatagagtactcacgaccggtgctcgatttagtatcactcagtaagtcaccatctcctgcactggaaccagcagcgatgtcggtggttataactttgtctcctggtaccaacaacacccaggcgaggcccccgactcataatttatgatgtcattaagcggccctcaggggtccctgatcgcttctctggctccaagtctggcaacactgcctccctgaccatctctgggctccaggctgacgatgacggtgattattactgctgctcatttgcaggcacccgcactgtgatcttcggcggagggaccaagctgaccgtcctaggtcagctcaaggctcgccccctcggtcactctcgttccccgccctcctcagtactctatctgagcggctggcaaggcgcatagnnnnn

SEQ ID NO: 93482 - DNA, 150 bp, Homo sapiens; identical to SEQ ID NO: 93401
  misc_feature: GYAE6OF01BNPGB.29.85.H08.1.454.CMB.1.raw
  modified_base (150)..(150): a, c, t, g, unknown or other
  misc_feature (150)..(150): n is a, c, g, or t

SEQ ID NO: 93483 - DNA, 612 bp, Homo sapiens
  misc_feature: GYAE6OF01AUOAN.29.85.H08.1.454.CMB.1.raw
  modified_base (224)..(224): a, c, t, g, unknown or other
  misc_feature (224)..(224): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcgtgttatacttgtctctgtaccaacaacaccaggcgacggcccccgatcacttaattatgatgtacattagcgcctcgacgggtccctgactcgtcttctctgctccgagtctcgacaactactcgccctcctacgacctactccgtcgtcggtcctccgacggtctacgaccgagtcggaccggttagtaacgtttacttacgtcgtcttcgtccttacgtacgtttcggaccgtaccgggtacccaccccggtactaccggttggttaccgtacgttccggttaccgggaccggggtaacgggtacccgaaacggtcccgttacgggtaaccccgttccggtaacgggtacctacggccgttacccggaaccggg

SEQ ID NO: 93484 - DNA, 152 bp, Homo sapiens; identical to SEQ ID NO: 93475
  misc_feature: GYAE6OF01BV065.29.85.H08.1.454.CMB.1.raw
  modified_base (150)..(152): a, c, t, g, unknown or other
  misc_feature (150)..(152): n is a, c, g, or t

SEQ ID NO: 93485 - DNA, 511 bp, Homo sapiens
  misc_feature: GYAE6OF01DKJ94.29.85.H08.1.454.CMB.1.raw
  modified_base (241)..(241): a, c, t, g, unknown or other
  misc_feature (241)..(241): n is a, c, g, or t
  modified_base (318)..(318): a, c, t, g, unknown or other
  misc_feature (318)..(318): n is a, c, g, or t
tcagatagagtactcacgaccggtgctcgatttagtatcactcagtcgcggggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcgccatctcctgcactggaaccagcagtgatgttgagaattangactgtctcccttggtaccaacaacacccagacacagtccacaaacacatgatatacaatgtcaatactcggccctnacggggtccctgatcgtttctctggctcaagtctgcaatgcgcctcatcgaccatctctggactccaggctgaggacgaggctggatttatagtgctgctcatatataagcagtgtacagttaaaggggtgttacgggcggagggaccaaaggctaggacccgtcgtcgggtacacggtcccgaaaggtcccg

SEQ ID NO: 93486 - DNA, 152 bp, Homo sapiens; identical to SEQ ID NO: 93475
  misc_feature: GYAE6OF01BIO2V.29.85.H08.1.454.CMB.1.raw
  modified_base (150)..(152): a, c, t, g, unknown or other
  misc_feature (150)..(152): n is a, c, g, or t

SEQ ID NO: 93487 - DNA, 537 bp, Homo sapiens
  misc_feature: GYAE6OF01AKVO2.29.85.H08.1.454.CMB.1.raw
  modified_base (297)..(297): a, c, t, g, unknown or other
  misc_feature (297)..(297): n is a, c, g, or t
  modified_base (360)..(360): a, c, t, g, unknown or other
  misc_feature (360)..(360): n is a, c, g, or t
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgttataactttgtctcctggtaccaacaacacccaggcgacgcccccgatcataattangatgtcattaacgcggccctcgaggggtccctgactcgcttctctggctccaagtctgcaacnctcgcctccctgaccatctcgtgggcctcccgaggctgacgatgacggtnatttacttactgctgcttntatttgctacgccacccgctacgtgtgtacgttcgttacgggcggtaacgggtacccaggcccgtcggaccccggttaccgtaggtaccacgtccgtacgtaaccggg

SEQ ID NO: 93488 - DNA, 150 bp, Homo sapiens; identical to SEQ ID NO: 93401
  misc_feature: GYAE6OF01CYUV7.29.85.H08.1.454.CMB.1.raw
  modified_base (150)..(150): a, c, t, g, unknown or other
  misc_feature (150)..(150): n is a, c, g, or t

SEQ ID NO: 93489 - DNA, 194 bp, Homo sapiens
  misc_feature: GYAE6OF01DJY52.29.85.H08.1.454.CMB.1.raw
  modified_base (158)..(194): a, c, t, g, unknown or other
  misc_feature (158)..(194): n is a, c, g, or t
tcagatagagtactcacgaccggtgctcgatttagtatcactcagtcggacggggacgacgactggagattaaacgaactggtggctgcaccatctgtcttcatcttcccgccatctgaatagcgtactctgagcgggctgggccaaggcgcaatagnnnnnnnnnnnnnnnnnnnnnnnnnnnnnnnnnnnnn

SEQ ID NO: 93490 - DNA, 528 bp, Homo sapiens
  misc_feature: GYAE6OF01EYWLY.29.85.H08.1.454.CMB.1.raw
  modified_base (224)..(224): a, c, t, g, unknown or other
  misc_feature (224)..(224): n is a, c, g, or t
  modified_base (299)..(299): a, c, t, g, unknown or other
  misc_feature (299)..(299): n is a, c, g, or t
  modified_base (409)..(409): a, c, t, g, unknown or other
  misc_feature (409)..(409): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtggttataactttgtctcctgtaccaacaacaccaggcgacggcccccgactcataatttangatgtcattaagccggccctcgacggggtccctgactcgcttctctggctccaagtctggcaacactgcctcctgaccatctctgggctccgaggctgacgatgacggtnattatactgctgctctatttgcaggtccacccgcactgtcgtatcggttcgggaccggaggggacccaaggcccgtacggacccgttccggtacggtaccaggtccctacggtaaccgg

SEQ ID NO: 93491 - DNA, 534 bp, Homo sapiens
  misc_feature: GYAE6OF01CQWI3.29.85.H08.1.454.CMB.1.raw
  modified_base (223)..(223): a, c, t, g, unknown or other
  misc_feature (223)..(223): n is a, c, g, or t
  modified_base (422)..(422): a, c, t, g, unknown or other
  misc_feature (422)..(422): n is a, c, g, or t
  modified_base (459)..(459): a, c, t, g, unknown or other
  misc_feature (459)..(459): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcacatctcctgcactggaaccngcagcgatgtcggtggttataactttgtctctggtaccaacaacaccaggcgacggccccccgactcataatttatgatgtcattaagccggaccctcgacggggtccctgactcgtcttctctgctcaagtctggacaacactcgccctccctcgacctatctcgtcgggcctcccgaggctcgacgatcggacggtntattagttactgctgctctatttgccaggccacccgnactgtgactcgttcgggacggtacgggaccaaggtccgtacgacccgtccgtaggtccacgtccgtacgaaccgg

SEQ ID NO: 93492 - DNA, 560 bp, Homo sapiens
  misc_feature: GYAE6OF01BA6XT.29.85.H08.1.454.CMB.1.raw
  modified_base (224)..(224): a, c, t, g, unknown or other
  misc_feature (224)..(224): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttataacttgtctctgtaccaacacaccaggcgacggccccccgatcataatttatgatgtcattaagcgcctcgacgggtccctgactcgcttctctcggctccaagtctggcaacactcgccctccctgaccctattcctcgtcgggtccttcccgaggtcctaggaccgtagtggacggttgatttacttactgcctgcttctagtttcgcacggcccacccgcacgttgtacgtacgttccggttcgggaccgggagggtaacccaaggtcccgtacggtacccgttaccgtaggtaccacgtccgtacgaaccggg

SEQ ID NO: 93493 - DNA, 151 bp, Homo sapiens
  misc_feature: GYAE6OF01C4RJB.29.85.H08.1.454.CMB.1.raw
  modified_base (151)..(151): a, c, t, g, unknown or other
  misc_feature (151)..(151): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgaggcgggctggcaaggcgcatagn

SEQ ID NO: 93494 - DNA, 178 bp, Homo sapiens
  misc_feature: GYAE6OF01A1YUJ.29.85.H08.1.454.CMB.1.raw
  modified_base (154)..(154): a, c, t, g, unknown or other
  misc_feature (154)..(154): n is a, c, g, or t
  modified_base (162)..(178): a, c, t, g, unknown or other
  misc_feature (162)..(178): n is a, c, g, or t
tcagatagagtactcacgaccggtgctcgatttagtatcactcagtcggcgggacaccgactggagagttaaaccggtaactgtggctgcaccatctgtcttcatcttcccgccagtctagaatagcgtactctgacgcgggctcggcaaggcncatagccnnnnnnnnnnnnnnnnn

SEQ ID NO: 93495 - DNA, 151 bp, Homo sapiens; identical to SEQ ID NO: 93409
  misc_feature: GYAE6OF01AK8RK.29.85.H08.1.454.CMB.1.raw
  modified_base (150)..(151): a, c, t, g, unknown or other
  misc_feature (150)..(151): n is a, c, g, or t

SEQ ID NO: 93496 - DNA, 504 bp, Homo sapiens
  misc_feature: GYAE6OF01EWF31.29.85.H08.1.454.CMB.1.raw
  modified_base (397)..(397): a, c, t, g, unknown or other
  misc_feature (397)..(397): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcgtgtataacttgtctctgtaccaacaacaccaggcgacggccccccgatcataatttatgatgtcattaagcggccctcagggtccctgatcgcttctctgctcaagtctggcaacactgcctccctgacctatctctcggctccaggctgacgatgacggtnattatactgctgctctatttgctaggccacccgctacgtgtcagttccgttcgggcgggtaagggaccctaaggcctggacccgtcgtacggtacagcctcgaacgg

SEQ ID NO: 93497 - DNA, 533 bp, Homo sapiens
  misc_feature: GYAE6OF01DJCEZ.29.85.H08.1.454.CMB.1.raw
  modified_base (295)..(295): a, c, t, g, unknown or other
  misc_feature (295)..(295): n is a, c, g, or t
  modified_base (337)..(337): a, c, t, g, unknown or other
  misc_feature (337)..(337): n is a, c, g, or t
  modified_base (408)..(408): a, c, t, g, unknown or other
  misc_feature (408)..(408): n is a, c, g, or t
  modified_base (421)..(421): a, c, t, g, unknown or other
  misc_feature (421)..(421): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatggtcggtgttataactttgtctcctgtaccaacaacaccagcgacggcccccatcataattangatgtcattaagcggcctcgagggtccctgactcgtctctcnggctacagtctaggcaacactcgccctcctacgacctactctcgtcggctccgagctgacgagtgacggtntatttacttacgngtcgtcgtcttcttagtttcgacgacggccaacccggctactgtcgtacttcgttcgggacggtacgggacacggtcgtacgacccgtcgtacggcacggtcctgtaaccgg

SEQ ID NO: 93498 - DNA, 624 bp, Homo sapiens
  misc_feature: GYAE6OF01EX23B.29.85.H08.1.454.CMB.1.raw
  modified_base (255)..(255): a, c, t, g, unknown or other
  misc_feature (255)..(255): n is a, c, g, or t
  modified_base (290)..(290): a, c, t, g, unknown or other
  misc_feature (290)..(290): n is a, c, g, or t
  modified_base (321)..(321): a, c, t, g, unknown or other
  misc_feature (321)..(321): n is a, c, g, or t
tcagatagagtactcacgaccggtgctcgatttagtatcactcagtcggtcggggggggtctcaggaggcaggcaccttctccgggacgtctccaaccgacttcggccttgggctctgctcctccgtcagcctcctcgacctcagggcaacagggactccgtgggctcgtacgttctgcccttgtactcgagcctgctcgaggttgtccggtctcgtggactagtcgagtcacagtcctctgcactaggaacccngcagcatggtcgtgtatacttgtctctgtacctanactactaggcacggccccatcgactacttancgtactggtacgattagcggtcctcgacgggtacctagaactcgcttcgacgtaggactacaaggtcaggtacaacgtacgtacgcccttacctacgacctacttcctcgtagggcctaccgacggctaagaccgtatcggtacggtagtacttacgttactacgctacgtctactagttcgacgacggaccacccgacgtacgtggtacttaccgttcgttcggggacgggtacgggaaccgtaacggtccgttacggtacccggttccgtaacggttccgtacgttccgtacgtaaccggg

SEQ ID NO: 93499 - DNA, 181 bp, Homo sapiens
  misc_feature: GYAE6OF01DYN0Y.29.85.H08.1.454.CMB.1.raw
  modified_base (154)..(181): a, c, t, g, unknown or other
  misc_feature (154)..(181): n is a, c, g, or t
tcagatagagtactcacgaccggtgctcgatttagtatcactcagtcggcgggacacgactggacgattaaacgaactgtggctgcaccatctgtcttcatcttcccgccatctgaatagcgtactctgagtcgggctggcaaggcgtcatagnnnnnnnnnnnnnnnnnnnnnnnnnnnn

SEQ ID NO: 93500 - DNA, 150 bp, Homo sapiens; identical to SEQ ID NO: 93401
  misc_feature: GYAE6OF01CWJOZ.29.85.H08.1.454.CMB.1.raw
  modified_base (150)..(150): a, c, t, g, unknown or other
  misc_feature (150)..(150): n is a, c, g, or t

SEQ ID NO: 93501 - DNA, 501 bp, Homo sapiens
  misc_feature: GYAE6OF01CXAQ0.29.85.H08.1.454.CMB.1.raw
  modified_base (292)..(292): a, c, t, g, unknown or other
  misc_feature (292)..(292): n is a, c, g, or t
  modified_base (420)..(420): a, c, t, g, unknown or other
  misc_feature (420)..(420): n is a, c, g, or t
  modified_base (438)..(438): a, c, t, g, unknown or other
  misc_feature (438)..(438): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccagcagcgatgtcggtgttataactttgctctgtaccaacacaccaggcgacgcccccgatcatactttangatgtcattaagcgccctcgaggggtccctgactcgcttctctgctcaagtctggcaacactgaccctcctgaccatcctcgtcggcctccgaggctcgacgatggacgtgtattattactgctgctntatttgcaggccacccgntactgtcgattcgtcggcggacggaccaacgcgtcgaccgtcctaggtcacgcgtcgaaccgg

SEQ ID NO: 93502 - DNA, 557 bp, Homo sapiens
  misc_feature: GYAE6OF01CG775.29.85.H08.1.454.CMB.1.raw
  modified_base (242)..(242): a, c, t, g, unknown or other
  misc_feature (242)..(242): n is a, c, g, or t
tcagatagagtactcacgaccggtgctcgatttagtatcactcagtcgcgggggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcgccatctcctgcactggaaccagcagtgatgttgagaattangactgtctccttggtaccaacaacaccagacacagtccaacaaacacatgatatacaatgtacagtactccggccctcgacggggtcctggtacttcgtttctcgtggctccaagtctggacaatgccgctccatcgacctatctctggacctcgaggctagagggacgagctagtaatttagttagtgtctgcttactaatattaactaagacgtagttcgtacgtaaggtttaacggggtgttacgggacggtaggggaaccaacggtcgtacggacccgttcggtacgggactaccggcccgtaaggtcccg

SEQ ID NO: 93503 - DNA, 469 bp, Homo sapiens
  misc_feature: GYAE6OF01BP2LQ.29.85.H08.1.454.CMB.1.raw
  modified_base (414)..(414): a, c, t, g, unknown or other
  misc_feature (414)..(414): n is a, c, g, or t
  modified_base (453)..(453): a, c, t, g, unknown or other
  misc_feature (453)..(453): n is a, c, g, or t
  modified_base (459)..(469): a, c, t, g, unknown or other
  misc_feature (459)..(469): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattattactgctgctcatttgcaggcacccgcactgtgatcttcgggcggagggaccagctgaccgtctaggtcagctcaaggctcgccccctcggtccactctcgttccccnccctcctcacgtactctatctgagcgggctggcaaggcncatagnnnnnnnnnnn

SEQ ID NO: 93504 - DNA, 472 bp, Homo sapiens
  misc_feature: GYAE6OF01B9GOZ.29.85.H08.1.454.CMB.1.raw
  modified_base (335)..(335): a, c, t, g, unknown or other
  misc_feature (335)..(335): n is a, c, g, or t
  modified_base (459)..(472): a, c, t, g, unknown or other
  misc_feature (459)..(472): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataacttttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattattactgctgctcatttgcaggccacccgnactgtgatcgttcggcggaggaccaagctcgaccgtcctaggtcagctcaggctcgcccctcggtcactccgttcccaccctcctcacgtacctctactctggacgcggctggcaggcgcatgnnnnnnnnnnnnnn

SEQ ID NO: 93505 - DNA, 553 bp, Homo sapiens
  misc_feature: GYAE6OF01CSJPY.29.85.H08.1.454.CMB.1.raw
  modified_base (289)..(289): a, c, t, g, unknown or other
  misc_feature (289)..(289): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcacatctcctgcactggaaccagcagcgatgtcggtggttataactttgctctgtaccaacacaccagcgacgcccccgatcatattngatgtcatagcgcctgacgggtccctgactcgcttctctcggctaccagtctggacaacactcgccctcctacgacctatctcgtcggcctccgacggtctgacgagtcggtacggttgtaatttacgtactgtcttgtctacgtacgtttcgccgtaacggcccaacccgtctaaccgtggttacgacgttccgttccgggacggtacgggacctaacggccgtacgtacccgttccgtaggtaccacgtcgtcggtaaccgg

SEQ ID NO: 93506 - DNA, 495 bp, Homo sapiens
  misc_feature: GYAE6OF01C1ZFV.29.85.H08.1.454.CMB.1.raw
  modified_base (223)..(223): a, c, t, g, unknown or other
  misc_feature (223)..(223): n is a, c, g, or t
  modified_base (293)..(293): a, c, t, g, unknown or other
  misc_feature (293)..(293): n is a, c, g, or t
  modified_base (409)..(410): a, c, t, g, unknown or other
  misc_feature (409)..(410): n is a, c, g, or t
  modified_base (434)..(434): a, c, t, g, unknown or other
  misc_feature (434)..(434): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtggttataactttgctcctggtaccaacaacaccaggcgagcccccgatcatattangatgtcattaagcggccctcaggggtccctgatcgcttctctggctccaagtctggcaacactgcctccctgaccatctctgggctccaggctagacgatgacggtgattattacnnctgctcatttcgctaggcacccgnactgtgatcttcgggcggagggaccaagcctacgaccgtccgtaaggccaagctcgaacgg

SEQ ID NO: 93507 - DNA, 149 bp, Homo sapiens; identical to SEQ ID NO: 93464
  misc_feature: GYAE6OF01BY94J.29.85.H08.1.454.CMB.1.raw

SEQ ID NO: 93508 - DNA, 150 bp, Homo sapiens; identical to SEQ ID NO: 93401
  misc_feature: GYAE6OF01E3NCU.29.85.H08.1.454.CMB.1.raw
  modified_base (150)..(150): a, c, t, g, unknown or other
  misc_feature (150)..(150): n is a, c, g, or t

SEQ ID NO: 93509 - DNA, 150 bp, Homo sapiens; identical to SEQ ID NO: 93401
  misc_feature: GYAE6OF01CMZRB.29.85.H08.1.454.CMB.1.raw
  modified_base (150)..(150): a, c, t, g, unknown or other
  misc_feature (150)..(150): n is a, c, g, or t

SEQ ID NO: 93510 - DNA, 150 bp, Homo sapiens; identical to SEQ ID NO: 93401
  misc_feature: GYAE6OF01D0UMJ.29.85.H08.1.454.CMB.1.raw
  modified_base (150)..(150): a, c, t, g, unknown or other
  misc_feature (150)..(150): n is a, c, g, or t

SEQ ID NO: 93511 - DNA, 155 bp, Homo sapiens; identical to SEQ ID NO: 93444
  misc_feature: GYAE6OF01A7YFV.29.85.H08.1.454.CMB.1.raw
  modified_base (150)..(155): a, c, t, g, unknown or other
  misc_feature (150)..(155): n is a, c, g, or t

SEQ ID NO: 93512 - DNA, 641 bp, Homo sapiens
  misc_feature: GYAE6OF01BLATV.29.85.H08.1.454.CMB.1.raw
  modified_base (622)..(641): a, c, t, g, unknown or other
  misc_feature (622)..(641): n is a, c, g, or t
tcagatagagtactcacgaccggtgctcgatttagtatcactcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcagggggtcccctgactcgtcttctcgtggcctaccaagttcgtggaccaaacctacgtcgccccttcccgtcgaccctattcctcggtcgggcctacccgagggtctacggaaccgtagtacgggtaccgggtagttaattttaactttaccgtggtccttcggtccttacttagttttcggaccggacgggaccccaccccggctacgttggtacgtacttccggttccggggacggggaacgggaaccaacggtcgtacggtaccccgttaccgtagggtacacggtcctacggaacggtccgtcccggtccccccgttgggtaccctaccgttccgtttcccggttccccccgtccccttcccttacgtaccgttaccttacttacttccgtggacgggcggtcgtcgggacgacgggcgacagtacgnnnnnnnnnnnnnnnnnnnn

SEQ ID NO: 93513 - DNA, 494 bp, Homo sapiens
  misc_feature: GYAE6OF01BVS0E.29.85.H08.1.454.CMB.1.raw
  modified_base (222)..(222): a, c, t, g, unknown or other
  misc_feature (222)..(222): n is a, c, g, or t
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
  modified_base (392)..(392): a, c, t, g, unknown or other
  misc_feature (392)..(392): n is a, c, g, or t
  modified_base (399)..(399): a, c, t, g, unknown or other
  misc_feature (399)..(399): n is a, c, g, or t
  modified_base (438)..(438): a, c, t, g, unknown or other
  misc_feature (438)..(438): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccngcagcgatgtcggtgttataactttgtctctgtaccaacaacaccaggcgacggcccccgactcataatttatgatgtcattaagcggccctcgacgggtccctgatcgcttctctcgctccaagtctggcaacnctcncctcctgaccatctctggctcgagctgacgntgacgtntattatactgtctgctctatttgcagccaccgcactgtncttacgtcggcggtacggacaagcctagacccgttcgaggtacacgtctcgaacgg

SEQ ID NO: 93514 - DNA, 152 bp, Homo sapiens
  misc_feature: GYAE6OF01AU097.29.85.H08.1.454.CMB.1.raw
  modified_base (151)..(152): a, c, t, g, unknown or other
  misc_feature (151)..(152): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgaggcgggctggcaaggcgcatagnn

SEQ ID NO: 93515 - DNA, 463 bp, Homo sapiens
  misc_feature: GYAE6OF01EE897.29.85.H08.1.454.CMB.1.raw
  modified_base (454)..(463): a, c, t, g, unknown or other
  misc_feature (454)..(463): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgacccatctctgggctccaggctgacgatgacggtgattattactgctgctcatttgcaggcacccgcactgtgatcttcggcggagggaccaagctgaccgtctaggtcagctcaagctgcccctcggtcactctcgttcccaccctcctcagtactctatctgagcgggctggcaaggcgcatagnnnnnnnnnn

SEQ ID NO: 93516 - DNA, 599 bp, Homo sapiens
  misc_feature: GYAE6OF01DR8IP.29.85.H08.1.454.CMB.1.raw
  modified_base (424)..(424): a, c, t, g, unknown or other
  misc_feature (424)..(424): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgattcagcctcgctcagtgtccgggtctcctggacagtcagtcaccatcctcctgcactggaaccagcagcgatggtcggtagttataactttgtctctgtaccaacaacaccagcgacggcccccgactcataattatgatgtcattaagccgcctcgacgggtcctgactcgcttctctggctccaagtctggacaacactcgccctccctgacctactctcgtggctccgagctagacgatggacggttgatttattacgtntctgtccttctagtttcgcgtacggaccctacccggtctacgttcggtacgtaccgtttaccggttccggggacggggtaacgggaaccccgtaaagggtacccggttaccgggtaacccccggtttccggttaaaccgggttccgaaaccgggtccttaccgggaaacccgggg

SEQ ID NO: 93517 - DNA, 150 bp, Homo sapiens; identical to SEQ ID NO: 93401
  misc_feature: GYAE6OF01DLKOT.29.85.H08.1.454.CMB.1.raw
  modified_base (150)..(150): a, c, t, g, unknown or other
  misc_feature (150)..(150): n is a, c, g, or t

SEQ ID NO: 93518 - DNA, 497 bp, Homo sapiens
  misc_feature: GYAE6OF01BGYLO.29.85.H08.1.454.CMB.1.raw
  modified_base (195)..(195): a, c, t, g, unknown or other
  misc_feature (195)..(195): n is a, c, g, or t
  modified_base (482)..(483): a, c, t, g, unknown or other
  misc_feature (482)..(483): n is a, c, g, or t
  modified_base (485)..(485): a, c, t, g, unknown or other
  misc_feature (485)..(485): n is a, c, g, or t
  modified_base (487)..(497): a, c, t, g, unknown or other
  misc_feature (487)..(497): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgacggccccccgatcataatttangatgtcattaagcggccctcaggggtccctgatcgcttctctggctccaagtctggcaacactgcctcctgaccatctctgggctccaggctgacgatgacggtgatttatactgctgctctatttgcaggccacccgcactgtgatcgttcgggcgggaggaccaagctcgaccgtccgtaggtcagctacgacggcctcgtcccctcggtcaccttcgtccgtccccgtccctcctctacgtctcgtatcgtgtacggcggtcgtcggacacggcgacgagtagnngncnnnnnnnnnnn

SEQ ID NO: 93519 - DNA, 843 bp, Homo sapiens
  misc_feature: GYAE6OF01AZO5M.29.85.H08.1.454.CMB.1.raw
  modified_base (285)..(285): a, c, t, g, unknown or other
  misc_feature (285)..(285): n is a, c, g, or t
tcagatagagtactcacgaccggtgctcgatttagtatcactcagttcggtcggggggggtctcgaggacggcacgcactcttccgggacggttcttccacctatggcctgggctctgctcctacctcagcctcctcacctcaggggctacgaggtatcctggggcttcttagtttcgtcgtacccctttaaggacttccaggtcccttcggacttcagttggtccggggttctccgtgggacgtaggtccaggttcaccattcctcctgcctactggaaacccngtccaggcgatggtcggtgttataactttgtacttctggtaccaacaacaccaggcgacggcccccgagttccgacttaactttactcgtagtacggtacctaagtttaacggccgggtccccttcgtacgggggttacccttggtaacgttccggtaccgtttccgttaccggttacggtacctttacccgtaaacggttccgttacggggaccctaaacctaccgttcggaccccgttaccccgtacggtacccctaacgttcccttccgttccggggaccctttacccggaagggacccttaacgggaaccgtaaggttaccggtaaccgggtttacgttaacgttttaaccgttttaaccgttcggtaacctttacgggtaccttacttaacggttttcggaccggtaacgggtaccctaaccccgggactaacccggttcggttacgttactttaccggtttccgggaccggggtaacgggaacccgtaaacgggtccgttacggtaccccggttccgtaacgggttacctacggtccgttacgtaacccggg

SEQ ID NO: 93520 - DNA, 611 bp, Homo sapiens
  misc_feature: GYAE6OF01A4PGY.29.85.H08.1.454.CMB.1.raw
  modified_base (223)..(223): a, c, t, g, unknown or other
  misc_feature (223)..(223): n is a, c, g, or t
  modified_base (338)..(338): a, c, t, g, unknown or other
  misc_feature (338)..(338): n is a, c, g, or t
  modified_base (360)..(360): a, c, t, g, unknown or other
  misc_feature (360)..(360): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtggttatactttgtctcctgtaccaacaacaccaggcgacggccccatcattaattatgatgtcattaacgcggccctcgacggggtccctgactcgcttcnctggctcgaagtctggacaacnctcgccctccctgacctatccgtcgtcgggcctccgaggcctagacgtagtcggacggttgtaatttacgtacgttcgtccttgtccttctacgtttcgaccgtacgggcccaacccggtctaaccgttggtacgtacgttccggtttaccggggaccgggtaacggggaacccgtaacgggtcccgttaccggttaaccccgggttcccgttaacgggtacccgtaacggtcccgtaaccggtaaccggg

SEQ ID NO: 93521 - DNA, 544 bp, Homo sapiens
  misc_feature: GYAE6OF01ELRVX.29.85.H08.1.454.CMB.1.raw
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (354)..(354): a, c, t, g, unknown or other
  misc_feature (354)..(354): n is a, c, g, or t
  modified_base (460)..(460): a, c, t, g, unknown or other
  misc_feature (460)..(460): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcacgtggaaccagcagcgatgtcggtgttatacttgtctctgtaccaacacaccgagcgacggccccgatcataattngtatntcattacgccggtcctcgacgggtcctgactcgtcttctctcgctacagtctgacacnctcgccctcctcgacctactcgtcgtcgggtcctcgacgtcgtagacgtgtaggtacggtagtacttatactgtctgtcttactacgttcgacgacgcctacccgntaccgtgtacgtacttcgtacgggacggtacggacctaagtccgtacggacccgttcggtacgtccgacgtccgcgtaaccggg

SEQ ID NO: 93522 - DNA, 499 bp, Homo sapiens
  misc_feature: GYAE6OF01EA3NG.29.85.H08.1.454.CMB.1.raw
  modified_base (309)..(309): a, c, t, g, unknown or other
  misc_feature (309)..(309): n is a, c, g, or t
  modified_base (488)..(499): a, c, t, g, unknown or other
  misc_feature (488)..(499): n is a, c, g, or t
tcagatagagtactcacgaccggtgctcgattttagtatcactcagtcgtgccctgactcagccttcgctcagtgtccgggtcgtccgtggacagtcagtcaccatctcctgcactggaaccagcagcgatgtcggtggttataactttgtctcctggtaccaacaacacccaggcgaggccccccgatcataatttatgatgtcattaagcggccctcaggggtccctgatcgcttctctggctccaagtctggcaacactgccctccctgaccatcctctcgggctccaggctgacgatgacgggtnatttattactgctgctcatttgcaggcacccgcactgtgatcttcgggcggaggaccaagctgacccgtcgtaggtcagctcgaagctcgcccccgtcggtcctaccgtctcgttccccgccctcctccacgtactctatcgtggtagccgggtctgggaccgaaggtcgctagtacgnnnnnnnnnnnn

SEQ ID NO: 93523 - DNA, 455 bp, Homo sapiens
  misc_feature: GYAE6OF01DJW58.29.85.H08.1.454.CMB.1.raw
  modified_base (438)..(455): a, c, t, g, unknown or other
  misc_feature (438)..(455): n is a, c, g, or t
tcagatagagtactcacgaccggtgctcgatttagtatcactcagtgtccgggtctcctggacagtcagtcaccatctcctgcactggaaccagcagcgatgtcggtggttataactttgtctcctggtaccaacaacacccaggcgaggcccccccgactcataatttatgatgtcattaagcggccctcaggggtccctgatcgcttctctggctccaagtctggcaacactgccctccctgaccatctctgggctccaggctgacgatgacggtgattatactgctgctcatttgcaggcacccgcactgtgatcgttcggcggagggaccaagctgaccgtcctaggtcagctcaaggcctcgccccctggtccactctcgttccccgccctcctcagtactctatctgacgcgggctggcaaggcgcatacgnnnnnnnnnnnnnnnnnn

SEQ ID NO: 93524 - DNA, 740 bp, Homo sapiens
  misc_feature: GYAE6OF01CI15L.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctatttaaaaggtgtccagtgtgaagtgcagctgggtggagtcgtgggggagtcggtggtacaggccgtggggggtccctggagactctcctgtgcagcctcgtggattctaagtttaatgttatttttccatacacgttcggggtcccgtacaacggtccgtacccgggggtaaagggttccgtggggtaacggttcggggtccttaccgttaccgttttaaagttaaacgtccgggtaagggtaccgggttagtaccttaaacgttactaacttttcctaagttcggactaagtaacccttgtaggtaggaaacggggtcccgtaacttacccaacctactaccctacccgaagaacgaaaccaaaccgaaaccgtaaacgttacccttaccccgttagttaacctccgttagaacctaaatacgaaactagtacgtaggaaacgtaaggtcgaacgtaacgaggtaccggtactttacttaagtttacttaggtacgaacgaaaaaggtacggaaacgggacgaagggtacttacggttaaagggttcggggtaccggttggtttaccgg

SEQ ID NO: 93525 - DNA, 467 bp, Homo sapiens
  misc_feature: GYAE6OF01CAFCA.29.85.H08.1.454.CMB.1.raw
  modified_base (235)..(235): a, c, t, g, unknown or other
  misc_feature (235)..(235): n is a, c, g, or t
  modified_base (458)..(467): a, c, t, g, unknown or other
  misc_feature (458)..(467): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttcnctggctccaagtctggcaacactgcctccctgaccatctctgggctccaggctgacgatgacggtgatttattactgctgctcatttgcaggcacccgcactgtgatcgttcgggcgagggaccaagctgaccgtcctaggtcagctcaaggctcgcccctcggtcactctcgttcccgccctcctcagtctctatctgacgcgggctggcaaggcgcatagnnnnnnnnnn

SEQ ID NO: 93526 - DNA, 558 bp, Homo sapiens
  misc_feature: GYAE6OF01D741C.29.85.H08.1.454.CMB.1.raw
  modified_base (224)..(224): a, c, t, g, unknown or other
  misc_feature (224)..(224): n is a, c, g, or t
  modified_base (402)..(402): a, c, t, g, unknown or other
  misc_feature (402)..(402): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttataacttgtctctgtaccaacaacaccaggcgacgcccccgatcataattatgatgtcattaagcgcctcgacggggtccctgactcgcttctctgctcagtctgcacactgccctcctcaccatcctcgtgggcctcgaggtctgacgagtcgtacggtntatttacttactgtctgcttctatttcggctacggcccacccgctacgtggtacgtacttccggttccggggaccgggtaacgggacccgtaacggcccgttaccggtaaccccggttccgtaacgggtcccaacggtcccgtacggaaacccggg

SEQ ID NO: 93527 - DNA, 543 bp, Homo sapiens
  misc_feature: GYAE6OF01CP1CH.29.85.H08.1.454.CMB.1.raw
  modified_base (296)..(296): a, c, t, g, unknown or other
  misc_feature (296)..(296): n is a, c, g, or t
  modified_base (388)..(388): a, c, t, g, unknown or other
  misc_feature (388)..(388): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcgtgttataactttgtctctggtaccaacaacacccaggcgacggcccccgatcataatttangatgtcattaagcggccctgacggggtccctgactcgcttctctggctcaagtctggcaacactgcctcctgacctatctctgggcctccgngctgacgagtggcggtagattacttactgctgctctatttgcacggccaacccggctacgtgtacgacttcgttcgggcgggaacgggacccaaacggtccttacggaaccccgttccgtaacgggtcccaacggtcccgttacggaaacccggg

SEQ ID NO: 93528 - DNA, 555 bp, Homo sapiens
  misc_feature: GYAE6OF01DMMY7.29.85.H08.1.454.CMB.1.raw
  modified_base (347)..(347): a, c, t, g, unknown or other
  misc_feature (347)..(347): n is a, c, g, or t
  modified_base (508)..(508): a, c, t, g, unknown or other
  misc_feature (508)..(508): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcgtggtacagccgtggggggtccctgagactctcctgtgcagcctctggattcaagtttaatgtatttttccatacactgggtccgtcaagcgtccggggaggtctggagtggtctctcttattaancgagacggtgctactacattctatgcagactctggtaggaacgggcctattccaaccatcctccaagacgaacaaacaaacaacgtacctccctgtactctagacaaatgaacagtctagaagtaagtgacgacaggcggtcttactatttattgtagaanaaaaggagaaaggcaaggtatacgtaaggtcgggtcgtggtttacgg

SEQ ID NO: 93529 - DNA, 160 bp, Homo sapiens
  misc_feature: GYAE6OF01A8OGZ.29.85.H08.1.454.CMB.1.raw
  modified_base (150)..(160): a, c, t, g, unknown or other
  misc_feature (150)..(160): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgagcgggctggcaaggcgcatagnnnnnnnnnnn

SEQ ID NO: 93530 - DNA, 163 bp, Homo sapiens
  misc_feature: GYAE6OF01A49EA.29.85.H08.1.454.CMB.1.raw
  modified_base (151)..(163): a, c, t, g, unknown or other
  misc_feature (151)..(163): n is a, c, g, or t
tcagatagagtactcacgaccggtgctcgatttagtatcactcagtcgcgggacgacgactggagattaaacgaactgtggctgcaccatctgtcttcatcttcccgccatctgaatagcgtactctgagcgggctggcaaggcgcatagnnnnnnnnnnnnn

SEQ ID NO: 93531 - DNA, 497 bp, Homo sapiens
  misc_feature: GYAE6OF01A9H7P.29.85.H08.1.454.CMB.1.raw
  modified_base (222)..(222): a, c, t, g, unknown or other
  misc_feature (222)..(222): n is a, c, g, or t
  modified_base (294)..(294): a, c, t, g, unknown or other
  misc_feature (294)..(294): n is a, c, g, or t
  modified_base (352)..(352): a, c, t, g, unknown or other
  misc_feature (352)..(352): n is a, c, g, or t
tcagatagagtactcacgaccggtgctcgatttagtatcactcagtcgcggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcgtgttataacttgtctctggtaccaacaacaccaggcgacggcccccgatcataactttangatgtcattaagcgcctcagggtccctgatcgcttctctggctccaagtctggcaacnctgcctcctgaccatccgtctcgggctccgaggctgacgatggacggtgatttattactgactgctctatttgcaggccaccgcactgtgatcgttcggcggaggaccaagcgtcgaccgttcgtaggtaccagtccgtgaacgg

SEQ ID NO: 93532 - DNA, 586 bp, Homo sapiens
  misc_feature: GYAE6OF01DAPGN.29.85.H08.1.454.CMB.1.raw
  modified_base (279)..(279): a, c, t, g, unknown or other
  misc_feature (279)..(279): n is a, c, g, or t
  modified_base (314)..(314): a, c, t, g, unknown or other
  misc_feature (314)..(314): n is a, c, g, or t
  modified_base (353)..(353): a, c, t, g, unknown or other
  misc_feature (353)..(353): n is a, c, g, or t
  modified_base (568)..(568): a, c, t, g, unknown or other
  misc_feature (568)..(568): n is a, c, g, or t
  modified_base (571)..(571): a, c, t, g, unknown or other
  misc_feature (571)..(571): n is a, c, g, or t
  modified_base (574)..(586): a, c, t, g, unknown or other
  misc_feature (574)..(586): n is a, c, g, or t
tcagatagagtactcacgaccggtgctcgatttagtatcactcagtctgccctgactcagcctcgctcagtgtccgggtctcctggacagtcagtcaccatctcctgcactggaccagcagcgatgtcgtggttatactttgctcctgtaccaacaacacccaggccgacgccccccgatcataatttatgatgtcattaacgcggccctcgacggggtccctgactcgtcttctcgtcggcctaccgagtctcggacaacactcgccctcctgacctntctcgtcggctcgagctgacgtagtcggtcggttntattacttactgtctgtctctgttcggcaccggcaccgntacgtgtcgtcgtcgtcgggacggacgacagtccgtcgtaccgtcctaggtccacgtacgtccgtacggtccccttccggtcccccgttaccgttccctaccgtttcccccgttacccgttacccccttacccgtccgtttacctaccgttacgttaccgttacgtaccggtcgggacgggtccgggtacgtacgggacgtaacggcgtacgtanagngcnnnnnnnnnnnnn

SEQ ID NO: 93533 - DNA, 615 bp, Homo sapiens
  misc_feature: GYAE6OF01BQQFK.29.85.H08.1.454.CMB.1.raw
  modified_base (224)..(224): a, c, t, g, unknown or other
  misc_feature (224)..(224): n is a, c, g, or t
  modified_base (295)..(295): a, c, t, g, unknown or other
  misc_feature (295)..(295): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccngcagcgatgtcggtgttatactttgctctggtaccaacaaccaccaggcacggcccccgatcataatttangtatgtactagttaacgcgtcctacgacgggtccctgactcgcttctcgtgctcaagtctgaccaacactcgcctccgtgacctatccgtcgtcggtcctaccgacggtctacggaacgtacttacggtaccggtagtaactttaacgttaccgtaggtacctttcggtccttcgttaacgttttcgggaccgtaacgggtccctacccggtactaccggttcgtacgtacgttccggttaccggggacgggtaacgggacctacggtccgtaccgggttacccgttaccgtaggtccctacggtcctacggtaacccgg

SEQ ID NO: 93534 - DNA, 479 bp, Homo sapiens
  misc_feature: GYAE6OF01D2LF7.29.85.H08.1.454.CMB.1.raw
  modified_base (333)..(333): a, c, t, g, unknown or other
  misc_feature (333)..(333): n is a, c, g, or t
  modified_base (467)..(479): a, c, t, g, unknown or other
  misc_feature (467)..(479): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcagggggtccctgatcgcttctctggctccaagtctggcaacactgcctccctgaccatctctgggctccaggctgacgatgacggtgattatactgctgctcatttgcaggcacccgnactgtgatcttcggcggagggaccaagctgaccgtcctaggtcagctacgaaggctcgccccctcggtccacttcctcgttccccaccctcctcacgtactctatcgtgagcgggctggcgacggcgcatagcnnnnnnnnnnnnn

SEQ ID NO: 93535 - DNA, 499 bp, Homo sapiens
  misc_feature: GYAE6OF01BJH5Z.29.85.H08.1.454.CMB.1.raw
  modified_base (222)..(222): a, c, t, g, unknown or other
  misc_feature (222)..(222): n is a, c, g, or t
  modified_base (350)..(350): a, c, t, g, unknown or other
  misc_feature (350)..(350): n is a, c, g, or t
  modified_base (395)..(395): a, c, t, g, unknown or other
  misc_feature (395)..(395): n is a, c, g, or t
  modified_base (404)..(404): a, c, t, g, unknown or other
  misc_feature (404)..(404): n is a, c, g, or t
  modified_base (412)..(412): a, c, t, g, unknown or other
  misc_feature (412)..(412): n is a, c, g, or t
  modified_base (424)..(424): a, c, t, g, unknown or other
  misc_feature (424)..(424): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccngcagcgatggtcggtgttataacttgtctctgtaccaacacaccaggcgacggcccccgatcataattatgatgtcattacgcgcctgacgggtcctgactcgcttctctgctccaagtctggcaacnctcgccctcctcgaccactctcgtcggcctccgaggtctgaacgntggtacgtntaagtttntactgtctgctntattgccagcccaccgcactgtagtctcggtcggcggaggacacgctcgaccgtcgaggccacgcgtcgtaccgg

SEQ ID NO: 93536 - DNA, 151 bp, Homo sapiens; identical to SEQ ID NO: 93409
  misc_feature: GYAE6OF01D65X0.29.85.H08.1.454.CMB.1.raw
  modified_base (150)..(151): a, c, t, g, unknown or other
  misc_feature (150)..(151): n is a, c, g, or t

SEQ ID NO: 93537 - DNA, 150 bp, Homo sapiens; identical to SEQ ID NO: 93401
  misc_feature: GYAE6OF01C7YQW.29.85.H08.1.454.CMB.1.raw
  modified_base (150)..(150): a, c, t, g, unknown or other
  misc_feature (150)..(150): n is a, c, g, or t

SEQ ID NO: 93538 - DNA, 478 bp, Homo sapiens
  misc_feature: GYAE6OF01BLMBM.29.85.H08.1.454.CMB.1.raw
  modified_base (334)..(334): a, c, t, g, unknown or other
  misc_feature (334)..(334): n is a, c, g, or t
  modified_base (468)..(478): a, c, t, g, unknown or other
  misc_feature (468)..(478): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttatgatgtcattaagcggccctcaggggtccctgatcgcttctctggctccaagtctggcaacactgccctccctgaccatctctgggctccaggctgacgatgacggtgatttattactgctgctcatttgcaggcacccgnactgtgactcgttcgggcggagggaccaagctgaccgtctaggtcagctacaaggctcgccccctcggtcaccttccgtcgttccccaccctcctctacgtactctactctgacgcggctggcaggcgcatagnnnnnnnnnnn

SEQ ID NO: 93539 - DNA, 150 bp, Homo sapiens; identical to SEQ ID NO: 93401
  misc_feature: GYAE6OF01AJDPD.29.85.H08.1.454.CMB.1.raw
  modified_base (150)..(150): a, c, t, g, unknown or other
  misc_feature (150)..(150): n is a, c, g, or t

SEQ ID NO: 93540 - DNA, 466 bp, Homo sapiens
  misc_feature: GYAE6OF01DI67F.29.85.H08.1.454.CMB.1.raw
  modified_base (422)..(422): a, c, t, g, unknown or other
  misc_feature (422)..(422): n is a, c, g, or t
  modified_base (437)..(437): a, c, t, g, unknown or other
  misc_feature (437)..(437): n is a, c, g, or t
  modified_base (453)..(453): a, c, t, g, unknown or other
  misc_feature (453)..(453): n is a, c, g, or t
  modified_base (459)..(466): a, c, t, g, unknown or other
  misc_feature (459)..(466): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctggccatctctgggctccaggctgacgatgacggtgattattactgctgctcatttgcaggccacccgcactgtgatcttcgggcggagggaccaagctgaccgtctagtcagctcaggctcgccccctcggtccactctcgttccccgcccttccncagtactctatctgngcgggctggcaaggcncatagnnnnnnnn

SEQ ID NO: 93541 - DNA, 490 bp, Homo sapiens
  misc_feature: GYAE6OF01CKSJ5.29.85.H08.1.454.CMB.1.raw
  modified_base (350)..(350): a, c, t, g, unknown or other
  misc_feature (350)..(350): n is a, c, g, or t
  modified_base (441)..(441): a, c, t, g, unknown or other
  misc_feature (441)..(441): n is a, c, g, or t
  modified_base (480)..(480): a, c, t, g, unknown or other
  misc_feature (480)..(480): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcgtggttataactttgtctctgtaccaacaacaccaggcgacggcccccgatcataattatgatgtcattaagcgcctcagggtccctgactcgcttctctggctcagtctgcaacnctgcctccctgaccatctcgtgggcctccgaggctgacgatggacgtgatttattactgctgctctatttcgcaggccacccgcacgtgtnacttcgtcgggcggaggaccagcctgaccgtctaggacncgctcgacgg

SEQ ID NO: 93542 - DNA, 151 bp, Homo sapiens; identical to SEQ ID NO: 93409
  misc_feature: GYAE6OF01EMFM4.29.85.H08.1.454.CMB.1.raw
  modified_base (150)..(151): a, c, t, g, unknown or other
  misc_feature (150)..(151): n is a, c, g, or t

SEQ ID NO: 93543 - DNA, 493 bp, Homo sapiens
  misc_feature: GYAE6OF01EQW5V.29.85.H08.1.454.CMB.1.raw
  modified_base (224)..(224): a, c, t, g, unknown or other
  misc_feature (224)..(224): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttataacttgtctctgtacaacaacaccagcgacgcccccgactcataatttatgatgtcattaagcggccctcgagggtccctgatcgcttctctgctccaagtctggacaacactcgccctccctgaccattcctcgtgggctccaggctgacgatggacgtgattattactgctgctcatttgcaggccacccgctacgtgtgactcgttcgggcggaggacagctcgaccgtctaggccagccgtgacgg

SEQ ID NO: 93544 - DNA, 420 bp, Homo sapiens
  misc_feature: GYAE6OF01A4TQF.29.85.H08.1.454.CMB.1.raw
  modified_base (414)..(420): a, c, t, g, unknown or other
  misc_feature (414)..(420): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattattactgctgctcatttgcaggcacccgcactgtgatcttcggcggagggacccaagctgaccgtcctaggtcagctcaaggctcgccccctcggtcactctcgttcccgccctcctcacgtactctatctgagcgggctggcaaggcgcatagnnnnnnn

SEQ ID NO: 93545 - DNA, 645 bp, Homo sapiens
  misc_feature: GYAE6OF01C2DRC.29.85.H08.1.454.CMB.1.raw
  modified_base (225)..(225): a, c, t, g, unknown or other
  misc_feature (225)..(225): n is a, c, g, or t
  modified_base (289)..(290): a, c, t, g, unknown or other
  misc_feature (289)..(290): n is a, c, g, or t
  modified_base (293)..(293): a, c, t, g, unknown or other
  misc_feature (293)..(293): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatcctggctcagtctgccctgactcagcctcgctcagtcgtccggtctccgtggacagtcagtcaccatctcctgcactggaaccngcagcgatgtcggtgttatacttgtctctgtaccaacacaccaggcgacgccccatcatattannatntcatagcgtccctcgacgggtccctgactccgtcttctcgtcggtcctacccgtaagtccgtaggacctaacgtaccgtccgtaccctcccgtaccgacctacgttccgtccgtcgggtcctacccgtaggtccgtacggaacgtagttacggacggttacgtaatttaccgttacgtgccttcgtccttacgttacgtttcgaccgtaccggtccgtaccccgtacgtaacgtcggttacgtccgttacccggttaccggggtaccgggaaccgggtaaccgtaccgggtaccgttacccgtacccgggttacccggtacggtaccgaaccgtcccgaacggttaacccgg

SEQ ID NO: 93546 - DNA, 555 bp, Homo sapiens
  misc_feature: GYAE6OF01AZLBZ.29.85.H08.1.454.CMB.1.raw
  modified_base (264)..(264): a, c, t, g, unknown or other
  misc_feature (264)..(264): n is a, c, g, or t
  modified_base (541)..(541): a, c, t, g, unknown or other
  misc_feature (541)..(541): n is a, c, g, or t
  modified_base (545)..(551): a, c, t, g, unknown or other
  misc_feature (545)..(551): n is a, c, g, or t
  modified_base (553)..(555): a, c, t, g, unknown or other
  misc_feature (553)..(555): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttatgatgtcattaagcggccctcaggggtccctgatcgcttctctggctccaagtctggcaacactgcctccngaccatctctgggctccgaggctgacgatgacggtgatttataatgctgctctattcgcaggccaccgctactgtgactcgttcggcgggacggaccaagcctacggacccgttccgtacggtccacgtccgtacgaacggtcctccggcccccgttcgggtcctaccgttaccgttccgtttacccccgaccccttccctacctacgttacctccttactccgtacggtacggtccgggtcgtacgggaccgtaagggccgtacgactagcgcgtngtcnnnnnnncnnn

SEQ ID NO: 93547 - DNA, 151 bp, Homo sapiens; identical to SEQ ID NO: 93409
  misc_feature: GYAE6OF01A9LFX.29.85.H08.1.454.CMB.1.raw
  modified_base (150)..(151): a, c, t, g, unknown or other
  misc_feature (150)..(151): n is a, c, g, or t

SEQ ID NO: 93548 - DNA, 578 bp, Homo sapiens
  misc_feature: GYAE6OF01BA7IT.29.85.H08.1.454.CMB.1.raw
  modified_base (259)..(259): a, c, t, g, unknown or other
  misc_feature (259)..(259): n is a, c, g, or t
  modified_base (323)..(323): a, c, t, g, unknown or other
  misc_feature (323)..(323): n is a, c, g, or t
  modified_base (352)..(352): a, c, t, g, unknown or other
  misc_feature (352)..(352): n is a, c, g, or t
  modified_base (405)..(405): a, c, t, g, unknown or other
  misc_feature (405)..(405): n is a, c, g, or t
  modified_base (467)..(467): a, c, t, g, unknown or other
  misc_feature (467)..(467): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcgtggtttcgtgtaggctatttaaagtgtcagtgtgaagtgcagctggtggagtctgggggagtcgtggtacagcctggggggtccctgagactctcctgtgcagcctntggattcaagtttaatgtatttttcatacacgtgggtcctcaagcgtccggggaaggtctgggngtgggtctcgtcttataatcgagacggtnctactactattctatcgctagtctcgtggtaggaacgggccgtacttccactntcctacagaacgaacaacaaactaacgttacctcctagtactctagaactaagtacgaacgngtacgtaggaagtaagtacgaacgacgaggtcgtcgttacttattagttagtagaaacgaaaggacgaacggagaaggtacgttaacgtaaggtcggtacgttcgttacgg

SEQ ID NO: 93549 - DNA, 151 bp, Homo sapiens
  misc_feature: GYAE6OF01BIU0O.29.85.H08.1.454.CMB.1.raw
  modified_base (150)..(151): a, c, t, g, unknown or other
  misc_feature (150)..(151): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtacgctgagcgggctggcaaggcgcatagnn

SEQ ID NO: 93550 - DNA, 462 bp, Homo sapiens
  misc_feature: GYAE6OF01CWSMR.29.85.H08.1.454.CMB.1.raw
  modified_base (328)..(328): a, c, t, g, unknown or other
  misc_feature (328)..(328): n is a, c, g, or t
  modified_base (450)..(462): a, c, t, g, unknown or other
  misc_feature (450)..(462): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctgcaacactgcctcctgaccatctctggctcaggctgacgatgacggtgattatactgctgctctattgcaggcacccgnactgtgatcttcggcggagggaccaagctgccgtctaggtcagctcaggctgcccctggcactctcgtcccgccctcctcacgtctctatccgtgacgcggctggcaaggccgcatagctgnnnnnnnnnnnnn

SEQ ID NO: 93551 - DNA, 522 bp, Homo sapiens
  misc_feature: GYAE6OF01CRH1L.29.85.H08.1.454.CMB.1.raw
  modified_base (443)..(443): a, c, t, g, unknown or other
  misc_feature (443)..(443): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccagcagcgatgtcggtggttataactttgtctcctggtaccaacaacaccaggcgagcccccgatcataacttatgatgtcattaagcggccctcgaggggtccctgactcgcttctctggctccaagtctgcaacactgccctcctgaccatcctctcgggcctccaggctagacgatgacgtgatttatactgactgctctatttcgctacggcacccgtnacgttgtacgtattccgttcgggcggtagggaccaagtccgtacgtacccgtccgtaagggctaacgccgtcgaacggg

SEQ ID NO: 93552 - DNA, 532 bp, Homo sapiens
  misc_feature: GYAE6OF01DOIIQ.29.85.H08.1.454.CMB.1.raw
  modified_base (355)..(355): a, c, t, g, unknown or other
  misc_feature (355)..(355): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtccaccatctcctgcactggaaccagcagcgatgtcgtgtatacttgtctctgtaccaacacaccaggcgacgcccccgatcattaattatgatgtcattaacgccgtccctcgacgggtccctgactcgcttctctggctccaagtctgcaacnctcgcctcctgaccatctcgtcggcctccgacggctgacgtagtgacggtgtattattactgtctgtctctatttcgctacgccacccgtcacgtagtgtacgtcgttccgggacggacgggaccctaggtccgtacggacccgttccgtacggtaccacggtcctcggtaaccggg

SEQ ID NO: 93553 - DNA, 553 bp, Homo sapiens
  misc_feature: GYAE6OF01D4FDR.29.85.H08.1.454.CMB.1.raw
  modified_base (224)..(224): a, c, t, g, unknown or other
  misc_feature (224)..(224): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtggttataactttgtctcctggtaccaacaacaccaggccgacggcccccgactcataatttatgatgtcattaagcggccctcgacgggtccctgactcgcttctctggctccaagtctggcaacactcgccctccctgaccatcctcgtgggcctcaggctgacgatgacggtgattattactgctgtctctatttcgctacggccacccgctacgtgtacgtacttcgttccgggaccgggtaagggacccaaggtcccgtacggaaccccggttccgtaacgggttccaacggtccgtccggtaaacccggg

SEQ ID NO: 93554 - DNA, 467 bp, Homo sapiens
  misc_feature: GYAE6OF01ECLYI.29.85.H08.1.454.CMB.1.raw
  modified_base (332)..(332): a, c, t, g, unknown or other
  misc_feature (332)..(332): n is a, c, g, or t
  modified_base (418)..(418): a, c, t, g, unknown or other
  misc_feature (418)..(418): n is a, c, g, or t
  modified_base (457)..(467): a, c, t, g, unknown or other
  misc_feature (457)..(467): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttatgatgtcattaagcggccctcaggggtccctgatcgcttctctggctccaagtctggcaacactgcctccctgaccatctctgggctccaggctgacgatgacggtgattattactgctgctcatttgcaggcacccgnactgtgatcttcgggcggagggaccaagctgaccgtctaggtcagctcaaggctcgcccctcgtcactctcgttcccgccctctcncgtactctatctgacgcgggctggcgaaggcgacatagnnnnnnnnnnn

SEQ ID NO: 93555 - DNA, 296 bp, Homo sapiens
  misc_feature: GYAE6OF01BB78E.29.85.H08.1.454.CMB.1.raw
  modified_base (288)..(296): a, c, t, g, unknown or other
  misc_feature (288)..(296): n is a, c, g, or t
tcagatagagtactcacgaccggtgctcgatttagtatcactcagtcgcgggtccctgatcgcttctctggctccaagtctggcaacactgcctccctgaccatctctgggctccaggctgacgatgacggtgattattactgctgctcatttgcaggcacccgcactgtgatcttcggcggagggaccaagctgaccgtcctaggtcagctcaaggctcgccccctcggtcactctcgttcccaccctcctcagtactctatctgagcggctggcaaggcgcatagnnnnnnnnn

SEQ ID NO: 93556 - DNA, 474 bp, Homo sapiens
  misc_feature: GYAE6OF01DK1O9.29.85.H08.1.454.CMB.1.raw
  modified_base (256)..(256): a, c, t, g, unknown or other
  misc_feature (256)..(256): n is a, c, g, or t
  modified_base (344)..(344): a, c, t, g, unknown or other
  misc_feature (344)..(344): n is a, c, g, or t
  modified_base (404)..(404): a, c, t, g, unknown or other
  misc_feature (404)..(404): n is a, c, g, or t
  modified_base (416)..(416): a, c, t, g, unknown or other
  misc_feature (416)..(416): n is a, c, g, or t
  modified_base (463)..(474): a, c, t, g, unknown or other
  misc_feature (463)..(474): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcattaatttatgatgtcattaagcggccctcaggggtccctgatcgcttctctggctccagtctggcaacnctgcctcctgaccatctctgggcctccgaggctgacgatggacggtgtatttattactgctgctctatttgcaggccaccgcactgtnactcgtcggcggaggacagctcgaccgtcgtacggcagcacgagctcgtcccctcggtcnctcctcgtcccncctcctctacgtctctactcgtgacgtcggctggcacggcacatagnnnnnnnnnnnn

SEQ ID NO: 93557 - DNA, 544 bp, Homo sapiens
  misc_feature: GYAE6OF01CS770.29.85.H08.1.454.CMB.1.raw
  modified_base (294)..(294): a, c, t, g, unknown or other
  misc_feature (294)..(294): n is a, c, g, or t
  modified_base (416)..(416): a, c, t, g, unknown or other
  misc_feature (416)..(416): n is a, c, g, or t
  modified_base (436)..(436): a, c, t, g, unknown or other
  misc_feature (436)..(436): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgttataactttgtctcctggtaccaacacaccaggcgacgcccccgatcatattangatgtcattaagcggccctcgacggggtccctgactcgtcttctcgtcggctccaagtctggcaacactcgccctcctgacctatccgtcgtcgggcctccgaggtctgacgagtgacggtntattacttactgtctgtctntagtttcgctacggcctaacccgctacgtgtcgtacgttcgttacgggcggagggacccacggtccgtacggacccgttaccgtaggtaccacgtccgtacgaaccgg

SEQ ID NO: 93558 - DNA, 681 bp, Homo sapiens
  misc_feature: GYAE6OF01CCX9N.29.85.H08.1.454.CMB.1.raw
  modified_base (272)..(272): a, c, t, g, unknown or other
  misc_feature (272)..(272): n is a, c, g, or t
  modified_base (425)..(425): a, c, t, g, unknown or other
  misc_feature (425)..(425): n is a, c, g, or t
tcagatagagtactcacgaccggtgctcgatttagtatcactcagtcggtcggggggggtcttcaggaggcagcacgtctcgggacgtctccaccatggacctgggctctgctccttccttccacgcctcctcgacgtcgacgggccacgaggtagttcccttggggccttcaagttctcgcccgttgaccgtcaggccctggcttcgagtacgttccggggtccttccgtcggacagttcagttcaccatcgtaccttgcactaggaaccngcagccgatggtcgtggttataacttcgtctcctggtaaccgacacaccaggcgacggccccgatcactaatttatgagtcgtcacttaacgcggcctcgacgggtccctgacgtcgtcttccgtctcggctaccgaacgtctacggcaaacnctacgtaccctcccttcgaccctatcctcgtacgggctccgaggtcctcgacgtagtacgacgtgtatttaacttactgtccgttgaccttcgtaacgttttcgaccgtacgggtcctaacccggtcgtaccgttgtccggtaaaccgtttccggttaccgggtaccgggtaacgggtaaccccgtaagggtcccgtttacgggaaccccgttacgtttacggggtacccggacggtccggttcccggtaaccggg

SEQ ID NO: 93559 - DNA, 474 bp, Homo sapiens
  misc_feature: GYAE6OF01DQ6GF.29.85.H08.1.454.CMB.1.raw
  modified_base (439)..(439): a, c, t, g, unknown or other
  misc_feature (439)..(439): n is a, c, g, or t
  modified_base (462)..(474): a, c, t, g, unknown or other
  misc_feature (462)..(474): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttatgatgtcattaagcggccctcaggggtccctgatcgcttctctggctccaagtctggcaacactgcctccctgaccatctctgggctccaggctgacgatgacggtgatttattactgctgctcatttgcaggcacccgcactgtgactcgttcggcggagggaccaagctcgaccgtccgtaggtcagctcaaggtctcgccccgtcggtcactctcgtcccgccctcctcagtctctatcgtgngcggctggcgaaggcacatagcnnnnnnnnnnnnn

SEQ ID NO: 93560 - DNA, 568 bp, Homo sapiens
  misc_feature: GYAE6OF01CMNK1.29.85.H08.1.454.CMB.1.raw
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgtataacttgtctctgtaccaacaacaccaggcgacggccccccgatcataatttatgatgtcattaagcggccctcgaggggtccctgactcgtcttctctggctccaagtctggacaacactcgcctccctgaccatctcgtgggcctccgaggtctgacgagtcggacggtgtatttattactgtcgtgtcctctatttcgacctacggccctaaccccggctaccgttgtcgtacgttcgttacgggacgggaacggggaacccaaaggtcccgtacggtaaccccggttcccgtaacgggttccaacggtccgttacgaaccggg

SEQ ID NO: 93561 - DNA, 537 bp, Homo sapiens
  misc_feature: GYAE6OF01BCO31.29.85.H08.1.454.CMB.1.raw
  modified_base (293)..(293): a, c, t, g, unknown or other
  misc_feature (293)..(293): n is a, c, g, or t
  modified_base (330)..(330): a, c, t, g, unknown or other
  misc_feature (330)..(330): n is a, c, g, or t
  modified_base (350)..(350): a, c, t, g, unknown or other
  misc_feature (350)..(350): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgttataactttgtctcctgtaccaacaacaccaggcgagcccccgatcataattangatgtcattaagcgcctcagggtccctgatcgcttcnctggctcaagtctggcaacnctcgcctccctgaccatctcgtcgggcctccgaggctagaccgtagtgtacggtgtatttattactgcttgctctatttgccgtagccacccgctactgtcgtactccgttcgggccgggtaagggacccaacggccgttacggacccgttaccgtacgggtaccaacggtccgttcgtaaaccggg

SEQ ID NO: 93562 - DNA, 443 bp, Homo sapiens
  misc_feature: GYAE6OF01CVYN8.29.85.H08.1.454.CMB.1.raw
  modified_base (431)..(443): a, c, t, g, unknown or other
  misc_feature (431)..(443): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgatcataatttatgatgtcattaagcggccctcaggggtccctgatcgcttctctggctccaagtctggcaacactgccctccctgacccatctcgtgggcctccaggctgacgatgacgttgattatactgctgctcatttgcacggccacccgcactgtgactcgttcgggcggaggaccaagctgaccgtctaggtcagctcgaaggcctcgccccgtggtcactcctcgtccccgccctcctcacgtactctactcgtggacggtcggcgtggacgaagggccgacatagnnnnnnnnnnnnn

SEQ ID NO: 93563 - DNA, 474 bp, Homo sapiens
  misc_feature: GYAE6OF01ESNJP.29.85.H08.1.454.CMB.1.raw
  modified_base (332)..(332): a, c, t, g, unknown or other
  misc_feature (332)..(332): n is a, c, g, or t
  modified_base (428)..(428): a, c, t, g, unknown or other
  misc_feature (428)..(428): n is a, c, g, or t
  modified_base (461)..(474): a, c, t, g, unknown or other
  misc_feature (461)..(474): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattatactgctgctcatttgcaggcacccgnactgtgactcttcgggcggagggaccaagctagacccgtcgtaggtcagctcgaagctcgcccctcggcactcctcgttcccgccctctcagttcnctatcgtgagcggtctggcaaggcgcagtacgnnnnnnnnnnnnnn

SEQ ID NO: 93564 - DNA, 541 bp, Homo sapiens
  misc_feature: GYAE6OF01EHVIY.29.85.H08.1.454.CMB.1.raw
  modified_base (223)..(223): a, c, t, g, unknown or other
  misc_feature (223)..(223): n is a, c, g, or t
  modified_base (352)..(352): a, c, t, g, unknown or other
  misc_feature (352)..(352): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccngcagcgatgtcggtgttatacttgtctctgtaccaacaacaccagcgacgcccccgatcataatttatgatgtacattaacgcggcctcgacggggtcctgactcgcttctctgctcagtctggcaacnctcgcctcctgaccatctcgtggcctcgaggctgacgatggacggtgtattattctgctgccttactagtttcgaccgacggtcccacccggctacgttgtacgtacgttccggttccgggacgggtacgggaccaacggtccgtcggtaccccgtaccgttacggtaccacggtccgtcggaacccgg

SEQ ID NO: 93565 - DNA, 468 bp, Homo sapiens
  misc_feature: GYAE6OF01B0EZ3.29.85.H08.1.454.CMB.1.raw
  modified_base (437)..(437): a, c, t, g, unknown or other
  misc_feature (437)..(437): n is a, c, g, or t
  modified_base (456)..(468): a, c, t, g, unknown or other
  misc_feature (456)..(468): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattattactgctgctcatttgcaggccacccgcactgtgatcgttcgggcggagggaccaagctcgacccgtcctaggtcagctcaggctcgcccctcggtcactctcgtcccgccctcctcacgtctctatctgngcggctggcaggcgcatgnnnnnnnnnnnnn

SEQ ID NO: 93566 - DNA, 690 bp, Homo sapiens
  misc_feature: GYAE6OF01AS0HZ.29.85.H08.1.454.CMB.1.raw
tcagatagagtactcacgaccggtgctcgatttagtatcactcagtcgcggggggggtctcaggaggcagcgctctggggatgtctccaccatggcctgggctctgctcctcctcacctcctcactcagggcacaggctcttgggcccagtctgccctgactcagccctccctccgtgtccgggtctcctggacagtcagtcaccgtctcctgcagtggaaccagcagtgacgttggtgcttataaccgtgtctcctggtaccagcacgccccaggcacacgcccccaaactcatgtattttgacgtcagtaactccggccctcgacgggtccctgactcgcttctcgtggtaccaagtcgtggcacgcgaccggtccctccctgtacttactccttcgtcgggtcctccgagtacgtggaacggacggaggtacgtagtaacttagtttacgttgacctaggtacctactaattaacgtaaaccgtaaacgggaaccctaaacgtaacgttttaacgttacgttaccggtttacccgggaaaccgttacggggaaaccctaaaacggttaccccgtaaacccggtttacccgtaacggttacccgtaacccggacccccggtaaaaccgggacccccttaaacccccgaccgtttaccgtacccgttacccgttacccgtttacccccg

SEQ ID NO: 93567 - DNA, 569 bp, Homo sapiens
  misc_feature: GYAE6OF01DT5OZ.29.85.H08.1.454.CMB.1.raw
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgttataactttgtctcctggtaccaacaacacccaggcgacggcccccgactcataatttatgatgtcattaagccggccctcgacggggtccctgactcgtcttctctcggctacaagtctggcaaccactcgccctccctgacccactcctcgtcgggcctccgaggctagacgtagtggacggtgtatttaacttactgtctgcttctagtttcgccgacggtccacccgtctacgttcggtcgtacgttccgttcggggcgggtaacgggaccctaaggcccgttacggaccccgttcgttaacggtcaacggcctaacgaaccggg

SEQ ID NO: 93568 - DNA, 510 bp, Homo sapiens
  misc_feature: GYAE6OF01DV6NU.29.85.H08.1.454.CMB.1.raw
  modified_base (224)..(224): a, c, t, g, unknown or other
  misc_feature (224)..(224): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttataactttgtctcctggtaccaacaacacccaggcgacggccccccgatcataatttatgatgtcattaagcggccctcaggggtccctgactcgcttctctggctcaagtctgcaacactgcctccctgaccatctctgggcctccgaggctgacgtatgtacggtgtattattactgctgctctatttgcaggcacccgcactgtgacttcgttcgggcggtaagggacctagccgtgacccgttcgtaggtccagcctcgtaacgg

SEQ ID NO: 93569 - DNA, 495 bp, Homo sapiens
  misc_feature: GYAE6OF01EKLG9.29.85.H08.1.454.CMB.1.raw
  modified_base (237)..(237): a, c, t, g, unknown or other
  misc_feature (237)..(237): n is a, c, g, or t
  modified_base (425)..(425): a, c, t, g, unknown or other
  misc_feature (425)..(425): n is a, c, g, or t
  modified_base (480)..(480): a, c, t, g, unknown or other
  misc_feature (480)..(480): n is a, c, g, or t
  modified_base (482)..(495): a, c, t, g, unknown or other
  misc_feature (482)..(495): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgacggccccccgactcataatttatgatgtcattaagcggccctcgaggggtccctgatcgcttcnctggctccaagtctggcaacactgccctcctgaccatctctgggctccaggctgacgatggacggtgattattactgctgctctattgcaggccacccgcactgtgtatcgttcgggcggagggaccaagctagacccgtcctaggtcagctcgaaggctcgcccctcggtctactcctcgttccccnccctcctcacgtactctactcgtgacggcgggcgtggacgaacggcgacagtagngnnnnnnnnnnnnnn

SEQ ID NO: 93570 - DNA, 578 bp, Homo sapiens
  misc_feature: GYAE6OF01B1CCA.29.85.H08.1.454.CMB.1.raw
  modified_base (357)..(357): a, c, t, g, unknown or other
  misc_feature (357)..(357): n is a, c, g, or t
  modified_base (520)..(520): a, c, t, g, unknown or other
  misc_feature (520)..(520): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcgtggtacagccgtgggggtccctgagactctcctgtgcagcctctggattcaagtttaatgtatttttccatacactgggtccgtcaagcgtccggggaaggtctggagtgggtctctcttataatcgagacggtnctactacattctatgcagactctggtgaagggccgtattccacctatcctccagacgaacaacaaacaagtacctccctagtatctagacaaatcgaactgtctaggagtaagtgaacgacgagcggtcttacttaattagtttaggtagtaacgaaaaaggnggtaaacgggcctaaagggtacttacgtaaagggtttcgggtacgtcggttttaacgg

SEQ ID NO: 93571 - DNA, 150 bp, Homo sapiens; identical to SEQ ID NO: 93401
  misc_feature: GYAE6OF01DQAVQ.29.85.H08.1.454.CMB.1.raw
  modified_base (150)..(150): a, c, t, g, unknown or other
  misc_feature (150)..(150): n is a, c, g, or t

SEQ ID NO: 93572 - DNA, 582 bp, Homo sapiens
  misc_feature: GYAE6OF01EJPYZ.29.85.H08.1.454.CMB.1.raw
  modified_base (224)..(224): a, c, t, g, unknown or other
  misc_feature (224)..(224): n is a, c, g, or t
  modified_base (287)..(287): a, c, t, g, unknown or other
  misc_feature (287)..(287): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcgtgttatacttgtctctgtaccaacacaccagcgacgccccgatcatattangatgtcattaacgcgtcctcgtacgggtccctgactcgtcttcgtctcggctaccgaagtcgtggaccaacactcgccctccctacgaccctactcctcgtcggtcctccgacggtctgacgtagtggtacggtagtatttacttactgctcgcttctagtttcgaccgtacggcccaccccgtctacgttcgtgtaccgttccggttcgggaccgggtaacgggacccgtaacggtccgtaccggtaccccggttccgttaacgggtccgacggtccgtaccggtaaacccggg

SEQ ID NO: 93573 - DNA, 467 bp, Homo sapiens
  misc_feature: GYAE6OF01EFYAW.29.85.H08.1.454.CMB.1.raw
  modified_base (301)..(301): a, c, t, g, unknown or other
  misc_feature (301)..(301): n is a, c, g, or t
  modified_base (332)..(332): a, c, t, g, unknown or other
  misc_feature (332)..(332): n is a, c, g, or t
  modified_base (450)..(450): a, c, t, g, unknown or other
  misc_feature (450)..(450): n is a, c, g, or t
  modified_base (456)..(467): a, c, t, g, unknown or other
  misc_feature (456)..(467): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtnattattactgctgctcattgcaggcacccgnactgtgactcgtcgggcggagggaccaagctagccgtctaggtcagctacaagctcgccccgtcggtcactctcgtcccaccctctcagtactctatcgtgagcggctggacaaggcncatagnnnnnnnnnnnn

SEQ ID NO: 93574 - DNA, 561 bp, Homo sapiens
  misc_feature: GYAE6OF01C955O.29.85.H08.1.454.CMB.1.raw
  modified_base (552)..(552): a, c, t, g, unknown or other
  misc_feature (552)..(552): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtctgggggagtcggtggtacaggccgtggggggtccctgagaccctctgtgcagcctctggagttctaagtttaattgatttttcctatactacctgggttccgtcaagcgtccggggaagggtcgtggaggtgggtctcttcttattaatcgagacggtgctactacattctatgcagactctgtggaagggccgacttcaccatctccaagacgaacaaacaacaaagaccttccctgtactctcgacaaatagaacagtcctagacgaagtcgaacgacagcggtacttcttaattattgagtacgaaaagaggaaggcaaggactagtaaggtgggtcgngtttgaccg

SEQ ID NO: 93575 - DNA, 586 bp, Homo sapiens
  misc_feature: GYAE6OF01A0DO2.29.85.H08.1.454.CMB.1.raw
  modified_base (223)..(223): a, c, t, g, unknown or other
  misc_feature (223)..(223): n is a, c, g, or t
  modified_base (290)..(290): a, c, t, g, unknown or other
  misc_feature (290)..(290): n is a, c, g, or t
  modified_base (352)..(352): a, c, t, g, unknown or other
  misc_feature (352)..(352): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccngcagcgatgtcgtgttataacttgtctctgtaccaacacaccaggcgacgcccccgatcataattangatgtcattaagcgcctcgacgggtccctgactcgtcttctctggctccaagtctggcaacnctcgccctcctgaccctatcctcgtcgggtcctcccgagggtcctacgaaccggtagttcggaacggttgtaactttagtttacgtaggccttgtccttacgttagtttcgccgaacgggtcccacccggtctacgtggtacgtaccttccggttccgggacgggtacggacccgaaggtcccgtaccggtaacccgttccggttaacggtccacgtccgtccggtaaaccggg

SEQ ID NO: 93576 - DNA, 150 bp, Homo sapiens; identical to SEQ ID NO: 93401
  misc_feature: GYAE6OF01D317K.29.85.H08.1.454.CMB.1.raw
  modified_base (150)..(150): a, c, t, g, unknown or other
  misc_feature (150)..(150): n is a, c, g, or t

SEQ ID NO: 93577 - DNA, 578 bp, Homo sapiens
  misc_feature: GYAE6OF01APPG5.29.85.H08.1.454.CMB.1.raw
  modified_base (295)..(295): a, c, t, g, unknown or other
  misc_feature (295)..(295): n is a, c, g, or t
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttatactttgtctctggtaccaacaacaccaggcgacggcccccatcatatttangatgtcattaagcgccctcgaggggtccctgactcgcttctctggctccaagtctggcaacnctcgccctcctcgacccntcctcgtcgggcctcccgaggtcctgacgagtcggacggtgtaatttacttactgtctgcttcgtagtttcgccacggtccaccccgctacgttcggtacgtacgtttccgttaccggggccgggtaacgggaacccgtaacgggtcctacgggtaaccccgttccgtaacgggtcccaaacgggtcccttaccggaaccggg

SEQ ID NO: 93578 - DNA, 517 bp, Homo sapiens
  misc_feature: GYAE6OF01CFS1Q.29.85.H08.1.454.CMB.1.raw
  modified_base (301)..(301): a, c, t, g, unknown or other
  misc_feature (301)..(301): n is a, c, g, or t
  modified_base (329)..(329): a, c, t, g, unknown or other
  misc_feature (329)..(329): n is a, c, g, or t
  modified_base (451)..(451): a, c, t, g, unknown or other
  misc_feature (451)..(451): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacacccaggccgacggccccccgatccataattangatgtcataagcgccctcgagggtcccngactcgcttctctggctcaagtctggcaacactcgccctcctcgaccatctcgtggctccaggctgacgatgacggtgattatactgactgtctctatttgctacggctacccgctactgtntacgtcgttcggcgggagggtaaccacggctacgacccgttcgtacggtcacgtcgtacgaaccgg

SEQ ID NO: 93579 - DNA, 592 bp, Homo sapiens
  misc_feature: GYAE6OF01CFTFE.29.85.H08.1.454.CMB.1.raw
  modified_base (223)..(223): a, c, t, g, unknown or other
  misc_feature (223)..(223): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
tcagatagagtactcacgaccggtgctcgatttagtatcactcagtcggcggggggtctcaggaggcagcactctcgggacgtctccaccatggcctggctctgctcctcctcagcctcctcactcgagggcacaggatcctgggctcagtctgccctgactcagcctcgctcagtcgtccggtctcctggacagtcagtcaccatctctagcactggaaccngcagcgatgtcgtgtatacttgctctgtaccaacacaccagcgacgcccccgatcatattangatgtnattagcgcctgagggtcccngactcgtcttctctggctacaagtctggaccaacgactcgaccctccctagacctatcgtcgtcgggctcccgaggtcctagaccgtagtcgacggtagtatttaagttactgtaccttgccttacgtatttcgacctaacgggtccctacccgacctacgttacggtcgtaaccgtttccggtaccggggtaccgggaacgggaacccctaaacgggtccgttaacccggaacccggtttaccgttaacgggtaccaacggtcctaccgggtaaacccgg

SEQ ID NO: 93580 - DNA, 487 bp, Homo sapiens
  misc_feature: GYAE6OF01AP4Z4.29.85.H08.1.454.CMB.1.raw
  modified_base (475)..(487): a, c, t, g, unknown or other
  misc_feature (475)..(487): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggcccctcgactcataatttatgatgtcattaagcggccctcaggggtccctgatcgcttctctggctccaagtctggcaacactgcctccctgaccatctctgggcctccaggctgacgatgacggtgatttattactgctgctctatttgctaggccacccgcactgtgattcgttcggcggtacggaccaagctcgaccgtcctaggtcagctcaaggcctcgcccccgtcggtcctactcctccgttccccaccctcctcagtacctctactctgacgcggctcggcgaggcgcatgnnnnnnnnnnnnn

SEQ ID NO: 93581 - DNA, 573 bp, Homo sapiens
  misc_feature: GYAE6OF01C0X5A.29.85.H08.1.454.CMB.1.raw
  modified_base (558)..(558): a, c, t, g, unknown or other
  misc_feature (558)..(558): n is a, c, g, or t
  modified_base (561)..(573): a, c, t, g, unknown or other
  misc_feature (561)..(573): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgatttattactgctgctcatttgcaggcacccgcactgtgatcgttcgggcggagggaccaaggcctacggtacccggtccttacgggtccacggtccgtccgaaacggtccgtaccggtccccccgtccgggtcctaaccgttcccgttcggtttccccccggtcccctttccccgtccgtaacggtttaaccttccgttaacttccgttcggacggtccgggtccgttcgggcgtaacgggccggaccagtacggngcnnnnnnnnnnnnn

SEQ ID NO: 93582 - DNA, 662 bp, Homo sapiens
  misc_feature: GYAE6OF01CX0GI.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcttgggttttccttgttgcttaattttaaaaggtgtccagtgtgaagtgcagctggtggagtcgtgggggagtcggtggtacaggccgtggggggtccctggacgactctcctgtcgcacgcctctggattctaaagttttaatgttactttttccaattaccacgttcgggtccgtacaacggtccggtaccgggggtaagggtcgtagggaggttcggggtccttcgttctttaattaagtccggaggtacggtgtacctaactactatttctaatcgacagtactcgttggtaggaacgggccgtattccaacctactcctaccaagaacgaaccaaacaaacaacgttacctccgtatactctacgaactaaagtcgaaactagtctaaggaacgtaagtcggaacgtacagccggtactttacttaatttgttagtacgaaagaaaaacggtggaaacggacgtaaggtacttaacggtaagggttcgggtcggttcggtttaacgg

SEQ ID NO: 93583 - DNA, 491 bp, Homo sapiens
  misc_feature: GYAE6OF01CAIT8.29.85.H08.1.454.CMB.1.raw
  modified_base (221)..(221): a, c, t, g, unknown or other
  misc_feature (221)..(221): n is a, c, g, or t
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
  modified_base (397)..(397): a, c, t, g, unknown or other
  misc_feature (397)..(397): n is a, c, g, or t
  modified_base (405)..(405): a, c, t, g, unknown or other
  misc_feature (405)..(405): n is a, c, g, or t
  modified_base (436)..(436): a, c, t, g, unknown or other
  misc_feature (436)..(436): n is a, c, g, or t
tcagatagagtactcacgaccggtgctcgatttagtatcactcagtcgcgggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtggttataactttgtctcctggtaccaacaacacccaggccaggccccccgatcataatttangatgtcattaagcggccctnaggggtccctgatcgcttctctggctccaagtctggcaacactgcctccctgacccatcctctgggctccaggctgacgntgacggtnattatactgctgctcatttgcaggcacccgnactgtgatcgttcggcggagggaccaaggcctgaccgtcaggtcagctcgaacgg

SEQ ID NO: 93584 - DNA, 682 bp, Homo sapiens
  misc_feature: GYAE6OF01C3F5U.29.85.H08.1.454.CMB.1.raw
  modified_base (206)..(206): a, c, t, g, unknown or other
  misc_feature (206)..(206): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccntctcctgcactggaccagcagcgatggtcggtgttatactttgtctctgtaccaacaacaccagcgaccggcccccgatcaattaattatgtatgtactaacgttaacgccggccctacgacggggttccctgactccgtcttcgtcgtcggtactaccgtaacgtcgtacggacctaaaccgtacgttccgtcccttacccgtacgtaccctacgttccgtccgtacggggtccctacccggtacgggtccttacggaaccgtaggtttacggaaccgggtttagtaacttttacgtttaacgtcggtaccttgtcccgttaatttacgtttccggacgtaccggaccccgtacccggacttacggtcggttaggtaccgtttccgggacccggggtacgggtaaccgggaaccctaacggtccgttaccgtaccccggttaccgtacggtaccacggtcgttccggaaacccgg

SEQ ID NO: 93585 - DNA, 648 bp, Homo sapiens
  misc_feature: GYAE6OF01CZKQA.29.85.H08.1.454.CMB.1.raw
  modified_base (227)..(227): a, c, t, g, unknown or other
  misc_feature (227)..(227): n is a, c, g, or t
  modified_base (296)..(296): a, c, t, g, unknown or other
  misc_feature (296)..(296): n is a, c, g, or t
tcagatagagtactcacgaccggtgctcgatttagtatcactcagtcggcggggggggtctcaggaggcagcactctcgggacgtctccaccatggcctgggctctgcctcctcctcagcctcctcactcagggcacaggatcctgggctcagtctgccctgactcagcctcgctcagtcgtccggtctccgtggacagtcagtcaccatcctctgcactggaaccngcagcgatggtcggtgttatacttgtctctgtaccaacaacaccagcgacgcccccgatcattaattancgtatgtcaagttaacgccggtcctcgacgggtccctgactcgtcttcgtcgtcggtctaccgaagtcgtcggacaactactccgtccctcctaccgacctacgttccgtaccgtcgggtcctcccggtacggtccgtacggtacgtacgttacggtaaccgggttataacgttttacgttacgtcgtcgttacgtccgttacttacgtttcggccgaccgggtacctaccccggtactaaccgttggttaccgtacgtttccggtaccggggtaccgggaacgggtaccctaacggtccgtaccggtaccccggtaccgttaacggtcgaccggtccgtacgtaacccggg

SEQ ID NO: 93586 - DNA, 671 bp, Homo sapiens
  misc_feature: GYAE6OF01BBJME.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtggggggagtcggtggtacagccgtggggggtccctggagactctcctgtgcagcctctggattcaagtttaatgtatttttccatacacgtgggtccgccgaggctccgaggggaacggggctgggaggtgggtctcgggctagttaggtggcaggtgggtggcgtctatatattatgacaggaccgcccgtgggaacggggtccggtttaccacccgtactttacccgaaggtacgaacctaaagttacggaaagaaccgacgtcttagtactcgtagacaaagtgggagacgtccgtaggacgtaccgtccggaacgaccgaccgggtacccgttacttaagtttacgttaggttaacgggttaaacgggacggtaggtcgtaacgggaaacggttacccggggggaacccggggaccccgtaaccggttcggaacccgtaccggggtaccgggggg

SEQ ID NO: 93587 - DNA, 559 bp, Homo sapiens
  misc_feature: GYAE6OF01CKPNQ.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcgtggtacagccgtggggggtccctgagactctcctgtgcagcctctggattcaagtttaatgtatttttccatacactgggtccgtcaagcgtccgggggaaggtcgtggagtgggtctctcttattaagtcgagacggtgctactacattctatgcagctctgtgacgggccattcaccatcctcagacgacaacaacaacgtacctccctgtactcgtgaacaatgaactgtactgaagtagtagacgaacaggcgtcttacttattattggtagaacgaaaaggacggaaggacgagggtaacttacgtaaggttcggggtcgttcggtttacgg

SEQ ID NO: 93588 - DNA, 811 bp, Homo sapiens
  misc_feature: GYAE6OF01DS5VO.29.85.H08.1.454.CMB.1.raw
tcagatagagtactcacgaccggtgctcgatttagtatcactcagtcgcggggggggtctcaggaggcagcactctcgggacgtctccaccatggcctgggctctgctcctcctcagcctcctcactcgagggcacaggatcctgggctcagtctgccctgactcagcctcgctcagtgtcgagggtctccgtggacagtcagtcaccatcctctgcactggaaccagcagcgattcgtcggttaggttaactaacgttttcgtccttccgtacggtaaccaaacaacctaccccacggaccggaaccggcccccccgtactaccgtaattaactttaatcgtattacgtactaagtttaaacgccggtacccctacggtaacggggtccctaggtacttccggtctttacctcgtacggtaccttaccgtaacgttccgtacgggacctaaacctacccgttcgtacccctttaccccgtacgtaacccctaacgtttcccgttcggttaccggggtaccccgttacccggtaacgggtcccgttaacggtaacccggtaaggttaccgggtaaccgggtttacgtaacgttttaaacgtttacgttacggtacgttccggttaccttaccgttaacgttttccggacccggttaacgggtacccctaccccgggtaccttaccggttacgttccggtaaccggtttccgggtaccggggtaaccgggaacccgggtaacccggtaacgtaccggttaccggtaaccccggtttaccgtaacgggtaccgtaaccgtccggtaacccggg

SEQ ID NO: 93589 - DNA, 551 bp, Homo sapiens
  misc_feature: GYAE6OF01C8Q9V.29.85.H08.1.454.CMB.1.raw
  modified_base (224)..(224): a, c, t, g, unknown or other
  misc_feature (224)..(224): n is a, c, g, or t
  modified_base (296)..(296): a, c, t, g, unknown or other
  misc_feature (296)..(296): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgcggtgttataactttgtctcctgtaccaacaacaccaggcgacggcccccgactcataattangatgtcattaagcgcctcgaggggtccctgatcgtcttctctggctcctaagtcctggacctaacactcgccctccctgaccactcctcgtcgggctccgaggctagacgtagtggacggtgtactttaattactcgtcgtgccttcgtagtttggtacgcctacccgctacgtgtcgacgttcgttcgggcgggtaacggaccgaacggtccgtacggtacccgttaccgtaggtcagtccctagacggtcccg

SEQ ID NO: 93590 - DNA, 549 bp, Homo sapiens
  misc_feature: GYAE6OF01ASIBF.29.85.H08.1.454.CMB.1.raw
  modified_base (438)..(438): a, c, t, g, unknown or other
  misc_feature (438)..(438): n is a, c, g, or t
tcagatagagtactcacgaccggtgctcgatttagtatcactcagtcgcggggggggtctcaggaggcagcgctctggggacgtctccaccatggcctgggctctgctcctcctcacctcctcactcagggcacaggctcttgggcccagtctgccctgactcagcctcgctcagtgtccgggtctcctggacagtcagtcaccatctctgcactggaaccagcagcgatgtcggtggttataactttgtctctggtaccaacaacacccaggcgacggccccccgactcataattatgatgtcattaagccgccctgacgggtccctgatcgcttctctggctaccaagtctggcaacactcgccctccctgacccatcctcgtcgggcctccgaggtctgacgatcggtacggtgtattattactgctgtctactntttcgcgaggccacccgctacgtgtcgtattccggtcggcgggaacgggaccaaggcgtcggacccggttccgtaacggtccaggtccctacggaacggtccgtaccccgg

SEQ ID NO: 93591 - DNA, 644 bp, Homo sapiens
  misc_feature: GYAE6OF01BMNXN.29.85.H08.1.454.CMB.1.raw
  modified_base (236)..(236): a, c, t, g, unknown or other
  misc_feature (236)..(236): n is a, c, g, or t
tcagatagagtactcacgaccggtgctcgatttagtatcactcagtcgcggggggggtctcaggaggcagcgctctggggacgtctccaccatggcctgggctctgctcctcctcacctcctcactcagggcacaggatcctgggctcagtctgccctgactcagcctccctccgtgtccggtctcctggacagtcagtcaccgtctcctgcagtggaaccagcagtgacgttggngcttataaccgtgtctcctggtaccagcacgccccaggcacacgccccaaatcatgtattttgactcagtaatccggccctgacgggtcctgactcgcttcgtcgtcggtaccaagtcgtcggcacgcgaaccggtcccttccctgtacttactccgttcgtcggtcctcgaacgtacgtaggacgggaacgaggtactagtaattagttagttgactagtctactaacgtaacgtaacgaagggaacctaaactacgttagttacgtaccgttaacggaacgttacgggaaacctaaacggttaccgtaacccggtaccttacgggtacccgtaaccggaccccgtaaacccgggtaccccctaaaaccccgtcgtaccgttaccctacccgttcccgttacccccg

SEQ ID NO: 93592 - DNA, 559 bp, Homo sapiens
  misc_feature: GYAE6OF01CIQWT.29.85.H08.1.454.CMB.1.raw
  modified_base (299)..(299): a, c, t, g, unknown or other
  misc_feature (299)..(299): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttangatgtcattaagcggccctcgaggggtccctgactcgcttctctggctcaagtctggcaacactcgcctccctgaccatctctgggcctcgaggctgacgatgacggtgattattactgctgctctatttcgcgtacggccaacccgtctaaccgtggttacgtacttccggtttcggggacggtaacggggaaccctaaggccgttacggtaaccccggttcccgttaagggttccaacggtccgtaccggtaaacggg

SEQ ID NO: 93593 - DNA, 151 bp, Homo sapiens; identical to SEQ ID NO: 93409
  misc_feature: GYAE6OF01BTETF.29.85.H08.1.454.CMB.1.raw
  modified_base (150)..(151): a, c, t, g, unknown or other
  misc_feature (150)..(151): n is a, c, g, or t

SEQ ID NO: 93594 - DNA, 159 bp, Homo sapiens
  misc_feature: GYAE6OF01D8STJ.29.85.H08.1.454.CMB.1.raw
  modified_base (149)..(159): a, c, t, g, unknown or other
  misc_feature (149)..(159): n is a, c, g, or t
tcagatagagtactcacgaccggtgctcgatttagtatcactcagtcgcgggacacgactggagattaaacgaactgtggctgcaccatctgtcttcatcttcccgcatctgaatagcgtactctgagcgggctggcaaggcgcatagnnnnnnnnnnn

SEQ ID NO: 93595 - DNA, 588 bp, Homo sapiens
  misc_feature: GYAE6OF01ARDYA.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgcttattttaaaaggtgtccagtgtgaagtgcagctggtggagtcgtgggggagtcgtggtacagccgtggggggtccctgagactctcctgtgcagcctctggattcaagtttatgtatttttccatacactgggtccgtcaagcgtccggggaagggtctgggagtgggtctcgtctttataatcgagtacggtgctactactattctatgcagactcgtgtgaagggcctattccaccatcctccagacgaacaacaacaacgtacctccctgtactctgacaatcgaactacgtctaggaacgtaagtgaacgcgacggtccggtctttacttaatttagtttagtacgtaacaaaaggaggaaacgggtacaagggtacttaacgtaaagggttcgggtacgttccgggtttaacgg

SEQ ID NO: 93596 - DNA, 603 bp, Homo sapiens
  misc_feature: GYAE6OF01CHLVY.29.85.H08.1.454.CMB.1.raw
  modified_base (224)..(224): a, c, t, g, unknown or other
  misc_feature (224)..(224): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttatactttgtctctgtaccaacaacaccaggcgacggcccccatcataattatgatgtacattaacgccggcctcgagggtccctgactcgcttctcgtcgctccaagtctggaccaacactcgccctccctgacctatcctcgtcgggcctccgaggtctaggacgagtcggtacggtagtactttacttacgtgtctgtcttacgtatttcgcgtacggcccacccgtctaacgttggtacgtacgttccggttaccggggaccgggaaccggggtaaccctaagggtcccgttacccgggtaaccccggttacccggttacgggttaccgtaacgggtcccgttaccggtaaacccgggg

SEQ ID NO: 93597 - DNA, 535 bp, Homo sapiens
  misc_feature: GYAE6OF01DZYB9.29.85.H08.1.454.CMB.1.raw
  modified_base (226)..(226): a, c, t, g, unknown or other
  misc_feature (226)..(226): n is a, c, g, or t
  modified_base (354)..(354): a, c, t, g, unknown or other
  misc_feature (354)..(354): n is a, c, g, or t
  modified_base (385)..(385): a, c, t, g, unknown or other
  misc_feature (385)..(385): n is a, c, g, or t
tcagatagagtactcacgaccggtgctcgatttagtatcactcagtcgcgggggggggtctcagggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttatacttgtctctgtaccaacacaccagcgacgcccccgatcataattatgatgtctagttaacgccggtccctgacgggtccctgactcgcttctctgctcagtctgcacnctcgcctcctgacctatctcgtggcctccgnggtctgacgatggtacgtgtattagttactgctcgtctactagtttgaccgacggtcccacccgtctacgtgtcgtacttcggtcgggaccgggtacgggacctacggcctacggacccgtcgtacggtccgacgtccgtacgtaaccgg

SEQ ID NO: 93598 - DNA, 585 bp, Homo sapiens
  misc_feature: GYAE6OF01BMU6R.29.85.H08.1.454.CMB.1.raw
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (281)..(281): a, c, t, g, unknown or other
  misc_feature (281)..(281): n is a, c, g, or t
  modified_base (312)..(312): a, c, t, g, unknown or other
  misc_feature (312)..(312): n is a, c, g, or t
  modified_base (317)..(317): a, c, t, g, unknown or other
  misc_feature (317)..(317): n is a, c, g, or t
  modified_base (569)..(569): a, c, t, g, unknown or other
  misc_feature (569)..(569): n is a, c, g, or t
tcagatagagtactcacgaccggtgctcgatttagtatcactcagtcggcggggggggtctcaggaggcagcactctcgggacgtctccaccatggcctggctctgctcctcctcagcctcctcactcagggcacaggatcctgggctcagtctgccctgactcagcctcgctcagtcgtccggtctctggacagtcagtcacatctcngcactggaaccngcagcgatgtcgtgttatacttntctctgtacaacacaccagcgacgccccgatcatatntgatgtcatacgcgcctgagggtcctgatcncttcncgtgctacacgtcgtgacaactctcgtccctcctcgactcgtacgtcgtggtacctccgacggtctagaccgtatacggtacggttataacgtttacttacgtggtacttcgtccttaatacgttttcggaccgtaacccggtcctaaccccggtactaccgttcggtacgttacccgttacggtttaccggggacggtaacgggtaacccgtaaggttccccgaacgttaccccggtacgtacggtaccgntcccgtggtaaacccg

SEQ ID NO: 93599 - DNA, 602 bp, Homo sapiens
  misc_feature: GYAE6OF01DQZ8W.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcgtggtacagccgtggggggtccctgagactctcctgtgcagcctctggattcaagtttaatgtattttccatacactgggtccgtcaagctccggaggaaggtctggagtgggtctctcttattatcgagacggtgctactactatttctatgcagtactcgtggtaggaagggccgattccaacctattcctaccaagaacgaacaaaccaactaacgtaccttcccgtagtactcgtagactaaatcgaactagtctagagaagtcgaacgacagtccggtcttacgtaatttacgttaggttagaacgtaaaaaggaacggtaaacggacgtaaaggggtaacttaccgtttaaaggggtggggttccggttaacggg

SEQ ID NO: 93600 - DNA, 585 bp, Homo sapiens
  misc_feature: GYAE6OF01CPFMK.29.85.H08.1.454.CMB.1.raw
  modified_base (292)..(292): a, c, t, g, unknown or other
  misc_feature (292)..(292): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatctcctgcactggaaccagcagcgatgtcggtgttataacttgtctctgtaccaacacaccaggcgacgccccgactcatattangatgtcataagcgcctcgacgggtcctgactcgcttctctcggctcagtctgacaacactcgcctcctgacctatctcgtcgggcctccgaggtcctaggaccgtagtacggtacgggttagtactttaagttaccgtgtacgttcgtccttacttagtttcggtaccgtacggaccccacccgcgtacgtcggttcgtacgttccggtttaccgggcgggtaagggtacccgtaaaggccgttaccggttaccggttcccgtaagggtccaacggtccgtacgtaacccggg

SEQ ID NO: 93601 - DNA, 615 bp, Homo sapiens
  misc_feature: GYAE6OF01A2KTT.29.85.H08.1.454.CMB.1.raw
tcagatagagtactcacgaccggtgctcgatttagtatcactcagtcgcggggggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcgccatctcctgcactggaaccagcagtgatgttgagaattatgactgtccttccgttagtaaccaacaaccaccagacacacgtaccaacaaacacatgaataataacaatcgtacaataccgtccggtaccctacggacgggtccctgtacgttccgtttctcgtcggcctaccgtaagttcgtagacctaagtcggccgtacctccagtcgactactcgtcgtcggtacctccgacggctaggacgacggacggtcgtagtatttagttagtcgtcgtcgtactcgaattagtaagtagacgtagttcgtacgtaacggtttaggggttcggtacggggtacgggaacgggaccgtaaggtccgtacggtacccggttcggtacgggaccaccgacccggtacggtccccgg

SEQ ID NO: 93602 - DNA, 153 bp, Homo sapiens; identical to SEQ ID NO: 93437
  misc_feature: GYAE6OF01BNJWI.29.85.H08.1.454.CMB.1.raw
  modified_base (150)..(153): a, c, t, g, unknown or other
  misc_feature (150)..(153): n is a, c, g, or t

SEQ ID NO: 93603 - DNA, 541 bp, Homo sapiens
  misc_feature: GYAE6OF01DOC9J.29.85.H08.1.454.CMB.1.raw
  modified_base (224)..(224): a, c, t, g, unknown or other
  misc_feature (224)..(224): n is a, c, g, or t
  modified_base (300)..(300): a, c, t, g, unknown or other
  misc_feature (300)..(300): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttataactttgtctcctggtaccaacaacacccaggcgacggcccccgactcataatttangatgtcattaacgcggccctcgacggggtccctgatcgcttctcgtggctccaagtctggcaacactcgccctccctgacctactcctcgtcgggcctcccgaggctgacgatcggacggtgatttattactgctgcttctatttgccgaggccaccgctacgtgtacgacgttccgttcgggcggaacgggacccaagtccgtacggacccgttccgtaacggtcacgtcgtcgaaccgg

SEQ ID NO: 93604 - DNA, 586 bp, Homo sapiens
  misc_feature: GYAE6OF01BW7C0.29.85.H08.1.454.CMB.1.raw
  modified_base (266)..(266): a, c, t, g, unknown or other
  misc_feature (266)..(266): n is a, c, g, or t
  modified_base (509)..(509): a, c, t, g, unknown or other
  misc_feature (509)..(509): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcgtggtacagccgtgggggtccctgagactctcctgtgcagccctntggattacaagtttaatgtatttttccattacactgggtcctcgaagcgtaccgggggaaggtctgggagtgggtctcgttcttataatcgagacggtgactactacatttcatgcaagacttctgtagaaggccgattccacagtctaccagacgaacaaacaactaagtacctaccctagtaactcttagactaaatcgaacacgtctaggaagtaagtacggaacgaacgtagaccggtntttaccgaattttacgtgttagaactaaaaaggagaaacggcaaggtatacgttaaaggtcgggtacgtggtttacg

SEQ ID NO: 93605 - DNA, 555 bp, Homo sapiens
  misc_feature: GYAE6OF01DKZXF.29.85.H08.1.454.CMB.1.raw
  modified_base (254)..(254): a, c, t, g, unknown or other
  misc_feature (254)..(254): n is a, c, g, or t
  modified_base (328)..(328): a, c, t, g, unknown or other
  misc_feature (328)..(328): n is a, c, g, or t
  modified_base (541)..(541): a, c, t, g, unknown or other
  misc_feature (541)..(541): n is a, c, g, or t
  modified_base (543)..(555): a, c, t, g, unknown or other
  misc_feature (543)..(555): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgacggccccccgatcataatttatgatgtcattaagcggccctcgaggggtccctgatcgcttctctggctcagtctgcaacnctcgcctcctgaccatctcgtcgggcctccgaggctggacgtagtggacggtgtaatttattacgtgctgtctntagtttcgacgacggccacccgtcacgttgtcgtacgtccgttcggggacggtacgggaaccaacggtcgtaccgtacccgtccgtacggtcacgctacgacggtccgtccgcccccgttcggtacctacctccgttccgttacccctacccttccctactaccgttctcgtactcgtcgacggtccggcgtacggcgaacggcgcagtacgngnnnnnnnnnnnnn

SEQ ID NO: 93606 - DNA, 535 bp, Homo sapiens
  misc_feature: GYAE6OF01C8J2Y.29.85.H08.1.454.CMB.1.raw
  modified_base (363)..(363): a, c, t, g, unknown or other
  misc_feature (363)..(363): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgctcctggtaccaaacaacaccaggcgacggcccccgactcaataatttatgatgtcattaagcggacctcgacggggtccctgatcgcttctctcgctcaagtctggcaacnctgccctcctgaccatcctcgtggcctccgagctgaccgatggacgtgatttattacgtgctgtctctatttgacgacggcccacccgtcacttggtcgacgttcgtcgggccgggaagggacctaaggccgtacggtaccccgttcgttacggtcgacgcgtcgtaaccgg

SEQ ID NO: 93607 - DNA, 481 bp, Homo sapiens
  misc_feature: GYAE6OF01CFSWA.29.85.H08.1.454.CMB.1.raw
  modified_base (294)..(294): a, c, t, g, unknown or other
  misc_feature (294)..(294): n is a, c, g, or t
  modified_base (336)..(336): a, c, t, g, unknown or other
  misc_feature (336)..(336): n is a, c, g, or t
  modified_base (469)..(481): a, c, t, g, unknown or other
  misc_feature (469)..(481): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgccctccctgaccatctctgggctccaggctgacgntgacggtgatttattactgctgctcatttgcaggccacccgnactgtgatcgttcgggcggagggaccaagcctgacccgtcgtaggtcagctcgaacggctcgcccctcggtccactctcgttccccaccctcctctacgtactctatctgacgcgggctggcaaggcgcatgnnnnnnnnnnnnn

SEQ ID NO: 93608 - DNA, 528 bp, Homo sapiens
  misc_feature: GYAE6OF01AYKQU.29.85.H08.1.454.CMB.1.raw
  modified_base (455)..(455): a, c, t, g, unknown or other
  misc_feature (455)..(455): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaacccagcagcgatgtcggtggttataactttgtctcctggtaccaacaacacccaggcgacggccccccgatcataatttatgatgtcaattaagcggccctacgaggggtcccctgactcgcttctctggctccaagtctggcaacactgcctccctgacccatcctctgggcctccaggctgacgatgacggtgattattactgctgctctatttgcaggccacccggcactgngtactcgttcggcggagggacccaaaggccgtacgaccccggttctacgggtacacgtccgtcgtaaaccggg

SEQ ID NO: 93609 - DNA, 564 bp, Homo sapiens
  misc_feature: GYAE6OF01CU1V1.29.85.H08.1.454.CMB.1.raw
  modified_base (223)..(223): a, c, t, g, unknown or other
  misc_feature (223)..(223): n is a, c, g, or t
  modified_base (291)..(291): a, c, t, g, unknown or other
  misc_feature (291)..(291): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctctgcactggaaccngcagcgatgtcgtggttataacttgtctctgtaccaacacaccaggcgacgcccccgatcataattangatgtcattaagccgcctcgacgggtccctgactcgcttctctcggctcaagtctggcaacactcgccctcctgacctatcctcgtcgggcctaccgaggtctaggacgtagtggtaccggttgtactttagttactgtcttgccttctagtttcgctacgggcccacccgctacgttgtacgacgttccgttccgggacgggtacgggaacccgtaaggtccgtacggtaccccgttccgtaacggttccgacggtccgtacggtaaccggg

SEQ ID NO: 93610 - DNA, 473 bp, Homo sapiens
  misc_feature: GYAE6OF01C30WD.29.85.H08.1.454.CMB.1.raw
  modified_base (333)..(333): a, c, t, g, unknown or other
  misc_feature (333)..(333): n is a, c, g, or t
  modified_base (459)..(459): a, c, t, g, unknown or other
  misc_feature (459)..(459): n is a, c, g, or t
  modified_base (463)..(473): a, c, t, g, unknown or other
  misc_feature (463)..(473): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttatgatgtcattaagcggccctcaggggtccctgatcgcttctctggctccaagtctggcaacactgcctccctgaccatctctgggctccaggctgacgatgacggtgatttattactgctgctcatttgcaggcacccgnactgtgatcgttcggcggagggaccaagctgaccgtctaggtcagctcgaaggctcgccccctcggtcacttcctcgttccccgcccttcctcacgttactctatctgagcgggctggcaaggcgnatgnnnnnnnnnnn

SEQ ID NO: 93611 - DNA, 468 bp, Homo sapiens
  misc_feature: GYAE6OF01A0X7H.29.85.H08.1.454.CMB.1.raw
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
  modified_base (452)..(452): a, c, t, g, unknown or other
  misc_feature (452)..(452): n is a, c, g, or t
  modified_base (455)..(468): a, c, t, g, unknown or other
  misc_feature (455)..(468): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatggacggtgattattactgctgctcatttgcaggcacccgnactgngatcttcgggcgaggaccagcctgaccgtcctaggcagctcaaggctcgcccctcggtcactctcgttcccaccctcctcacgtactctatctgacgcggctgctaaggcacnagnnnnnnnnnnnnnn

SEQ ID NO: 93612 - DNA, 418 bp, Homo sapiens
  misc_feature: GYAE6OF01A25KJ.29.85.H08.1.454.CMB.1.raw
  modified_base (411)..(418): a, c, t, g, unknown or other
  misc_feature (411)..(418): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattattactgctgctcatttgcaggcacccgcactgtgatcttcggcggagggaccaagctgaccgtcctaggtcagctcaaggctcgccccctggtcactctcgttcccgccctcctcagtactctatctgagcgggctggcaaggcgcatagnnnnnnnn

SEQ ID NO: 93613 - DNA, 507 bp, Homo sapiens
  misc_feature: GYAE6OF01EZ45F.29.85.H08.1.454.CMB.1.raw
  modified_base (407)..(407): a, c, t, g, unknown or other
  misc_feature (407)..(407): n is a, c, g, or t
  modified_base (424)..(424): a, c, t, g, unknown or other
  misc_feature (424)..(424): n is a, c, g, or t
  modified_base (441)..(441): a, c, t, g, unknown or other
  misc_feature (441)..(441): n is a, c, g, or t
tcagatagagtactcacgaccggtgctcgatttagtatcactcagtcgcggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgttataactttgtctctggtaccaacaacaccaggcgacggcccccgatcataatttatgatgtcattaagccggcctcgacggggtccctgatcgcttctctggctcaagtctggacaacactgccctcctgaccattctctgggcctccgaggctgacgatggacggtntattattactgctgctnatttgcaggccacccgnactgtcgtatcgttcgggcggtagggaccaaggcctagacccgtcgtacggtcagtcctcgaacgg

SEQ ID NO: 93614 - DNA, 511 bp, Homo sapiens
  misc_feature: GYAE6OF01CX970.29.85.H08.1.454.CMB.1.raw
  modified_base (196)..(196): a, c, t, g, unknown or other
  misc_feature (196)..(196): n is a, c, g, or t
  modified_base (216)..(216): a, c, t, g, unknown or other
  misc_feature (216)..(216): n is a, c, g, or t
  modified_base (498)..(511): a, c, t, g, unknown or other
  misc_feature (498)..(511): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcattaatttangatgtcattaagcggccctnaggggtccctgatcgcttctctggctccagtctgcacactgcctcctgaccatctcgtggctccaggctgacgatgacggtgatttatactgctgctctattgcacggccacccgcactgtgtagtccgtttcgggcggagggaccaagccgtacgtaccgtccgtaggtccagtccgtacgaacggtcctaccggtcccccgtcggtcctaccgttccttcgtcccgccctccctcacgttacctctatcgtgcggcgggctcgggcacggcgacgatagnnnnnnnnnnnnnn

SEQ ID NO: 93615 - DNA, 747 bp, Homo sapiens
  misc_feature: GYAE6OF01CI1A3.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcttgggttttccttgttgcttattttaaaaggtgtccagtgtgaagtgcagctggtggagtcgtgggggagtcggtggtacagccgtggggggtccctgagactctcctgtgcagcctctggtatttacgtaaagtttaatgtacttttttccaattacgtaccgttcggggttcccgtacgaaggtcccggttacccggggggaagggttccgtaggggtacggttggggttccttaccgttacgttttaatttaaacgtcggaaggtaccgggttgtaccttaactaactactttcctaagttcgactaagtaccttcgttaggtacgggaaacggggtcccgtaactttcccgaaccctacttcccgtaccgaaaggaacgaaaccaaaacctaaaaccgtaaacgtttacccctaccccgttagttaaccttccgtacgaacctaaagttacgaaactaacggttacctagggaacgtaaggtacgaaccgtaacgacggtccggtactttacgtaatttagttcggtagaacaaaaggaggaacggcgaaggtaacgttacgtaaagggttcggggttccgtaggtttacgg

SEQ ID NO: 93616 - DNA, 670 bp, Homo sapiens
  misc_feature: GYAE6OF01ADYEM.29.85.H08.1.454.CMB.1.raw
  modified_base (225)..(225): a, c, t, g, unknown or other
  misc_feature (225)..(225): n is a, c, g, or t
  modified_base (292)..(292): a, c, t, g, unknown or other
  misc_feature (292)..(292): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatccgtgggctcagtctgccctgactcagcctcgctcagtcgtccggtctcctggacagtcagtcaccatctctgctagtcggaacngcagcgatggtcggtgttatacttgctctgtaccaacaccaccgagcgacgcccccgatcataattngtatgtacagttaacgccggtacctcgacgggtccctagtacgtcgtcttaccgtcgtcggtcctaccgtaacggtccgttacggacctaaaccgtaccttccggtaccccgttaccctacggtaaccccttacgttacccgttaccggttccgggtccccttacccggtaacgggttccggttaacggtaacccggtaaggttcgggtaacggttacgttaacgtttacttacggtcgtccgttacggtccttacgttacgtttccggaccgttaccggaccctaccgtacgtacgtcgtcgttaccgtcgggacgggtacggtaccggtacgtcgtaccgtccgtaccgtacgtcgacgtacgtcgtacggtcccg

SEQ ID NO: 93617 - DNA, 150 bp, Homo sapiens; identical to SEQ ID NO: 93401
  misc_feature: GYAE6OF01D9E1O.29.85.H08.1.454.CMB.1.raw
  modified_base (150)..(150): a, c, t, g, unknown or other
  misc_feature (150)..(150): n is a, c, g, or t

SEQ ID NO: 93618 - DNA, 150 bp, Homo sapiens
  misc_feature: GYAE6OF01BFP8O.29.85.H08.1.454.CMB.1.raw
  modified_base (149)..(150): a, c, t, g, unknown or other
  misc_feature (149)..(150): n is a, c, g, or t
tcagatagagtactcacgaccggtgctcgatttagtatcactcagtcgcgggacacgactggagattaaacgaactgtggctgcaccatctgtcttcatcttcccgcatctgaatagcgtactctgagcgggctggcaaggcgcatagnn

SEQ ID NO: 93619 - DNA, 549 bp, Homo sapiens
  misc_feature: GYAE6OF01DU69F.29.85.H08.1.454.CMB.1.raw
  modified_base (293)..(293): a, c, t, g, unknown or other
  misc_feature (293)..(293): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctctgcactggaaccagcagcgatgtcggtgttataactttgtctcctgtaccaacaacaccagcgacgcccccgatcattaattntgatgtactattaacgccggccctcgacggggttccctgactcgtcttctcgtcggctccaagtctgacaacactcgccctccctgaccctattctccgtggcctccgaggctagacgtagtggtacggtagtattattacgtgtctgtcttactgtttcgcacggcccaccgctacgtcgtagtacgttccgttcgggcgggaacgggaaccaggtccgtagtacccgtcgtacggtacacgtctacgtacccgg

SEQ ID NO: 93620 - DNA, 436 bp, Homo sapiens
  misc_feature: GYAE6OF01A1TNW.29.85.H08.1.454.CMB.1.raw
  modified_base (287)..(287): a, c, t, g, unknown or other
  misc_feature (287)..(287): n is a, c, g, or t
  modified_base (407)..(407): a, c, t, g, unknown or other
  misc_feature (407)..(407): n is a, c, g, or t
  modified_base (416)..(416): a, c, t, g, unknown or other
  misc_feature (416)..(416): n is a, c, g, or t
  modified_base (421)..(436): a, c, t, g, unknown or other
  misc_feature (421)..(436): n is a, c, g, or t
tcagatagagtactcacgaccggtgctcgatttagtatcactcagtcgagtcaccatctcctgcactggaaccagcagcgatgtcggtggttataactttgtctcctggtaccaacacacccaggcgaggccccccgatcataatttatgatgtcattaagcggccctcaggggtccctgatcgcttctctggctccaagtctggcaacactgccctccctgaccatctctgggctccaggctgacgatggacgtgattatactgctgctcatttgcaggcacccgnactgtgatccttcgggcggaggaccaaggctgaccgtcctaggtcagctcgaaggcctcgcccctacggtccaccttctccgtcccgccctcctctacgtacctctactctgagcggcgnggcaggctnatagnnnnnnnnnnnnnnnn

SEQ ID NO: 93621 - DNA, 546 bp, Homo sapiens
  misc_feature: GYAE6OF01AH0HB.29.85.H08.1.454.CMB.1.raw
  modified_base (433)..(433): a, c, t, g, unknown or other
  misc_feature (433)..(433): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacaccaggcgacggccccccgatcataatttactgatgtactattaacgccgccctcgaggggtccctgatcgcttctctcggctccgaagtctggacacactcgcctccctgaccatctcgtcggcctccaggcctggactgacgtacgtgtatttacgtacgtcncgtcgtctactacgttcgcgacgtcccacctcgtactgtagtccgtcgtacgggcggtaccgacgtacgtccgtacggtaccgttacggtacgtaccacgtcctggaacccgg

SEQ ID NO: 93622 - DNA, 163 bp, Homo sapiens
  misc_feature: GYAE6OF01D6B0U.29.85.H08.1.454.CMB.1.raw
  modified_base (150)..(163): a, c, t, g, unknown or other
  misc_feature (150)..(163): n is a, c, g, or t
tcagatagagtactcacgaccggtgctcgatttagtatcactcagtcgcgggacacgactggagattaaacgactgtggctgcaccatctgtcttcatcttcccgccatctgaatacgcgtactctgagcgggctggcaaggcgcatagnnnnnnnnnnnnnn

SEQ ID NO: 93623 - DNA, 636 bp, Homo sapiens
  misc_feature: GYAE6OF01C5KHX.29.85.H08.1.454.CMB.1.raw
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
  modified_base (297)..(297): a, c, t, g, unknown or other
  misc_feature (297)..(297): n is a, c, g, or t
  modified_base (622)..(622): a, c, t, g, unknown or other
  misc_feature (622)..(622): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctggctcagtctgccctgactcagcctcgctcagtcgtccggtctccgtggacagtcagtcaccntctctgcacgtggaaccngcagcgatggtcggtgttataactttgtctcctgtaccaacacaccgaggcgacgcccccgatcaatacttangatcgtacattaacgccgtcctcgacggggtccctgtactccgtactttccgtcgtcggtacctaccgaacggttccgtacggacctaaacctctcggtaccccctcccgtacgaccctacgttccttccgtcggtccctaccgtacggtcgttacggacgtacgtacggtaccggtagttaactttaacttacgtcgtaccgtcgtccttacgttacgtttcgacgtacggcccgtaacccgtctaacgttcggtacgtacgttccggtacgggacggtacggaacctaacggcgttacggacccgttacggtacggtacgacnccgtacgtacccgg

SEQ ID NO: 93624 - DNA, 617 bp, Homo sapiens
  misc_feature: GYAE6OF01BO7V2.29.85.H08.1.454.CMB.1.raw
  modified_base (221)..(221): a, c, t, g, unknown or other
  misc_feature (221)..(221): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatccgtggctcagtctgccctgactcagcctcgctcagtcgtccggtctccgtggacagtcagtcacatctctgcatcgaaccngcagcgatggtcgtgttatacttgtctccgtgtaccacacaccgaggcgacgccccgatcattaattatgtatgtcaagttacgccgtcctcgtacggtcctagctcgtcttcgtcgtacgtcctacgtaagtcgtacggacctaacgtactcgtccctccgtacgtacctacgttcctcggtcggacctaccgacgggtctacggtacgtacgtacggtacggttagtaacgtttactacgtacgtaccgtcgtccgtacttacgtttcggaccgttacggtaccctaccgtacgtacggttcggtacgttacgtcccgggttacggaacggtaccgaaccgtcggtaccgtaccggtaccgtccgttacggtacgaccgtcgttacggaacccg

SEQ ID NO: 93625 - DNA, 151 bp, Homo sapiens; identical to SEQ ID NO: 93409
  misc_feature: GYAE6OF01D2MKO.29.85.H08.1.454.CMB.1.raw
  modified_base (150)..(151): a, c, t, g, unknown or other
  misc_feature (150)..(151): n is a, c, g, or t

SEQ ID NO: 93626 - DNA, 549 bp, Homo sapiens
  misc_feature: GYAE6OF01CRK5I.29.85.H08.1.454.CMB.1.raw
  modified_base (342)..(342): a, c, t, g, unknown or other
  misc_feature (342)..(342): n is a, c, g, or t
  modified_base (415)..(415): a, c, t, g, unknown or other
  misc_feature (415)..(415): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacaccaggcgacggcccccgatcataattatgtatttcattaagccggtccctcgagggtccctgatccgcttcncgtgctccaagtctggcaacactcgcctccctgacccactctcgtgggcctccagtctgacgatcgacggttntacgttattacgtgtctgcttcgtatttcgacaggtcccacccgctacgtcgtgtacttccgttcgggaccgggtaacggaccaaggtccgtacggacccgttcgtacgggtcacggtcctcgtaacggtcccg

SEQ ID NO: 93627 - DNA, 560 bp, Homo sapiens
  misc_feature: GYAE6OF01CZ9F1.29.85.H08.1.454.CMB.1.raw
  modified_base (224)..(224): a, c, t, g, unknown or other
  misc_feature (224)..(224): n is a, c, g, or t
  modified_base (327)..(327): a, c, t, g, unknown or other
  misc_feature (327)..(327): n is a, c, g, or t
  modified_base (415)..(415): a, c, t, g, unknown or other
  misc_feature (415)..(415): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcatgtcgtgtatacttgtctctgtacaacaacaccaggcgacggccccccgatacacttaattatgatgtactaattaagccgcctcgacggggtcccngtactcgcttctcgtggcctacgaagtctggacaaactactcgccctcctgaccactctctggctcgagctagacgagtcgtacggtntattatacgtgctgctactagtttcgacgacggtccacccggctaaccgttggtagacttccggttacggggaccgggtaacgggtaacctaacggccgtacggaccccgttaccgacggttaccacggccttaacggaaccggg

SEQ ID NO: 93628 - DNA, 585 bp, Homo sapiens
  misc_feature: GYAE6OF01BTHBB.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctgggtggagtcgtgggggagtcgtggtacaggccgtggggggtccctgagactctcctgtgcagcctcgtggattcaagtttaatgtatttttccatacactgggtccgtcaagcgtccggggaagggtctggagtgggtctctcttattatcgagacggtgctactactattctatcgcagtactctggtaggaacgggccgtattccacctatctccgagacaacaacaaacaagtacctccctagtactctgactaatacgaactagtactaggagtaagtgaacgacgaggccggtcttacttatttagttaggtacgaacgaaaaggaggaaacggacgaaggtacttacggtaaaggttcggggttcgtcggtttacgg

SEQ ID NO: 93629 - DNA, 293 bp, Homo sapiens
  misc_feature: GYAE6OF01BD3KY.29.85.H08.1.454.CMB.1.raw
  modified_base (288)..(293): a, c, t, g, unknown or other
  misc_feature (288)..(293): n is a, c, g, or t
tcagatagagtactcacgaccggtgctcgatttagtatcactcagtcgcgggtccctgatcgcttctctggctccaagtctggcaacactgcctccctgaccatctctgggctccaggctgacgatgacggtgattattactgctgctcatttgcaggcacccgcactgtgatcttcggcggagggaccaagctgaccgtcctaggtcagctcaaggctcgccccctcggtcactctcgttcccaccctcctcagtactctatctgagcggctggcaaggcgcatagnnnnnn

SEQ ID NO: 93630 - DNA, 505 bp, Homo sapiens
  misc_feature: GYAE6OF01AY2FT.29.85.H08.1.454.CMB.1.raw
  modified_base (410)..(410): a, c, t, g, unknown or other
  misc_feature (410)..(410): n is a, c, g, or t
  modified_base (449)..(449): a, c, t, g, unknown or other
  misc_feature (449)..(449): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatggtcggtggttataactttgtctctggtaccaacaacaccaggcgacggcccccgactcataattatgatgtcattaagcggccctcgaggggtccctgactcgcttctctggctccaagtctggcaacactcgccctcctgaccatcctcgtgggcctccaggctgacgatgacggtnattatactgctgctctattgcaggccacccgcacgtgtntagtcgttcgggcggacgggaccaagcctgaccgtccgtaggcacgtctcgaacgg

SEQ ID NO: 93631 - DNA, 567 bp, Homo sapiens
  misc_feature: GYAE6OF01BVYHR.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtctgggggagtcgtggtacagccgtggggggtccctgagactctcctgtgcagcctctggattcaagtttaatgtatttttccattacactgggtccgtcaaggcgtccggggaaggtcgtgggagtgggtctctcttataatcgagcggtgctactactattctatgcagactctggtgaacgggccgattcacctatccaccagacgaacaaacaacaagtacctcccgtagtactcgtagactaaatgaactagtcgtagaggtaagtcgaacgacaggccgtcttacttattagttgtacgacgaaaaggaggaaggcgaagggtactacgttaaggtgggtccgtggtttacgg

SEQ ID NO: 93632 - DNA, 676 bp, Homo sapiens
  misc_feature: GYAE6OF01BYFJ3.29.85.H08.1.454.CMB.1.raw
  modified_base (634)..(634): a, c, t, g, unknown or other
  misc_feature (634)..(634): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcttgggttttccttgttgcttattttaaaaggtgtccagtgtgaagtgcagctggtggagtcgtgggggagtcgtggtacaggccgtggggggtccctgagactctcctgtgcagtcctcgtggattacaagtttaatgtatttttaccattactacgttcgggtccgtacgaacggtccgtaccgggggaaggttccgtagggtacggttcggggttccttacgttctttaagttaaacgtccggtaaggtaccggttcgtaccttaaccgttaactatttacctaatcggtactaacggtaacttccgttggttaacggaacggggtacctaactttccgaaccctaattccgtacccgaagaacgaaaccaaacaaacctaagtaccctcccttagtactctagacaaagtcaactgtaccgagaacgtaagtacgaacgaacgagtccggtacttactatttacgtgacgaaacgaaagnggaagcaaggtctacggtaagggtcggtcgttcggtttacgg

SEQ ID NO: 93633 - DNA, 471 bp, Homo sapiens
  misc_feature: GYAE6OF01A12QQ.29.85.H08.1.454.CMB.1.raw
  modified_base (334)..(334): a, c, t, g, unknown or other
  misc_feature (334)..(334): n is a, c, g, or t
  modified_base (458)..(471): a, c, t, g, unknown or other
  misc_feature (458)..(471): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgccctccctgaccatctctgggctccaggctgacgatgacggtgattatactgctgctcatttgcaggccacccgnactgtgatcgttcgggcggagggaccaagctgaccgtctaggtcagctcaaggctcgcccctcgtcactctcgtccccgccctcctcacgtctctactctgacgcggctggcaaggcgcatagnnnnnnnnnnnnnn

SEQ ID NO: 93634 - DNA, 680 bp, Homo sapiens
  misc_feature: GYAE6OF01AOAEE.29.85.H08.1.454.CMB.1.raw
  modified_base (287)..(287): a, c, t, g, unknown or other
  misc_feature (287)..(287): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgtatacttgtctctgtaccaacacaccaggcgacgccccatcatattangatgtcatagccgcctcgacgggtcctgactcgtcttcgtctcggcctccaacgttctggacaactacctcgcccttcccgtacgaccctacttccgtccgtacggggtccctcccggtacgggtccgtacggtaacgtacgttacggtaaccgggttagtaacttttaacgttaaccgttcggtccttcggtcctttaccgttacgttttccgggaccgtaccgggtaccccgtaaccccggtcgtaaccgttcggtcggttaccgttcccgggtttaccggggaccggggtaaccggggtaacccggtaacgggtccccgttaccgggttaacccccggttaccggttaacgggtacccgtaaccgggtacccgttacccggtaaaccggg

SEQ ID NO: 93635 - DNA, 551 bp, Homo sapiens
  misc_feature: GYAE6OF01DN82Z.29.85.H08.1.454.CMB.1.raw
  modified_base (538)..(551): a, c, t, g, unknown or other
  misc_feature (538)..(551): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataacttttgtctcctggtaccaacaacacccaggcgaggccccccgatcataatttatgatgtcattaagcggcctcaggggtccctgatcgcttctctggctccaagtctggcaacgactgcctccctgaccatctctgggctccaggctgacgatgacggtgattatactgctgctcatttgctacggccacccgcacgtgtcgacttcgttcgggcggacgggaccaaggctacggaccgtccgtacggtcacgtctacgaacgtcctccggcccccgttcggtcctaccgttccgtcccgtttccccgtccccttccctacgtacgttaaccttcgttaacttccgttacgggacggtccgggtccgttcgggacgaacgggccgtacacgtagcgnnnnnnnnnnnnnn

SEQ ID NO: 93636 - DNA, 153 bp, Homo sapiens; identical to SEQ ID NO: 93437
  misc_feature: GYAE6OF01ER4NH.29.85.H08.1.454.CMB.1.raw
  modified_base (150)..(153): a, c, t, g, unknown or other
  misc_feature (150)..(153): n is a, c, g, or t

SEQ ID NO: 93637 - DNA, 471 bp, Homo sapiens
  misc_feature: GYAE6OF01B258S.29.85.H08.1.454.CMB.1.raw
  modified_base (175)..(175): a, c, t, g, unknown or other
  misc_feature (175)..(175): n is a, c, g, or t
  modified_base (190)..(190): a, c, t, g, unknown or other
  misc_feature (190)..(190): n is a, c, g, or t
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
  modified_base (327)..(327): a, c, t, g, unknown or other
  misc_feature (327)..(327): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
  modified_base (335)..(335): a, c, t, g, unknown or other
  misc_feature (335)..(335): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (342)..(343): a, c, t, g, unknown or other
  misc_feature (342)..(343): n is a, c, g, or t
  modified_base (345)..(345): a, c, t, g, unknown or other
  misc_feature (345)..(345): n is a, c, g, or t
  modified_base (347)..(347): a, c, t, g, unknown or other
  misc_feature (347)..(347): n is a, c, g, or t
  modified_base (350)..(350): a, c, t, g, unknown or other
  misc_feature (350)..(350): n is a, c, g, or t
  modified_base (390)..(390): a, c, t, g, unknown or other
  misc_feature (390)..(390): n is a, c, g, or t
  modified_base (438)..(438): a, c, t, g, unknown or other
  misc_feature (438)..(438): n is a, c, g, or t
  modified_base (440)..(443): a, c, t, g, unknown or other
  misc_feature (440)..(443): n is a, c, g, or t
  modified_base (445)..(471): a, c, t, g, unknown or other
  misc_feature (445)..(471): n is a, c, g, or t
tcagatagagtactcacgaccggtgctcgatttagtatcactcaggtacggcgggtccctgagtcgcttctctggctccaagtctggcaacactgcctccctgaaccatctctggggcctccaggcctgacgatggacggtgattataactgctgctcatttagcaaggcaccgnactgtgatcttcggnggtagggtaccaagctgaccgtctaggtccacgctcaaggtctcgccccgtcggtcacttctcgttccgccctcctcaggtactagtacgtcgttcgcggtcgggcttcggacgaaccggccgacaacgcgcncncncncncncncncncanncncncgngcgcgcgcgcgcgcgcgcgtcgtacgacgtacgtactacnctcgtcgtacgtacgacgacggacggcgacgacgacggacgacgagangnnnncnnnnnnnnnnnnnnnnnnnnnnnnnnn

SEQ ID NO: 93638 - DNA, 617 bp, Homo sapiens
  misc_feature: GYAE6OF01DEN9G.29.85.H08.1.454.CMB.1.raw
  modified_base (246)..(246): a, c, t, g, unknown or other
  misc_feature (246)..(246): n is a, c, g, or t
  modified_base (286)..(286): a, c, t, g, unknown or other
  misc_feature (286)..(286): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcacgtggaccagcagcgatgtcgtgtatacttnctctgtacaacacaccaggcgacgccccgatcattattangatgtactattacgccgcctcgacgggtcctgactcgtcttctcgtcgtctaccgtaagtcgacgtaccaactcgtcgccctcccgtacgacctactcgtaccgtcgggcctacgacggtcgtacgacgtagtacggtacggtagtactttaacgttacgtcgtaccgttgtaccctttacgttacgtttcgaccgtaccgggacccctacccggtactaaccggttgtaccgttaccgttaccgggttcggggaaccggtaacgggaaccctggtacccgttaccggtacccggtaccggtaacgtaccgacgtccgtacggtacccggg

SEQ ID NO: 93639 - DNA, 547 bp, Homo sapiens
  misc_feature: GYAE6OF01EF3Q9.29.85.H08.1.454.CMB.1.raw
  modified_base (224)..(224): a, c, t, g, unknown or other
  misc_feature (224)..(224): n is a, c, g, or t
  modified_base (465)..(465): a, c, t, g, unknown or other
  misc_feature (465)..(465): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtggttataactttgtctcctggtaccaacaacacccaggcgacggcccccgatcataatttatgatgtcattaagcgcctcgagggtccctgatcgcttctctggctccaagtctggacaactactcgtccctccctagaccctatcctcgtcgggtcctccgaggctgacgagtcggacggtgtaatttactacgtgctgcttctagtttcgcgacggcccacccgntacgtgtgtacttcggttcgggcgggaacggaccgtaggcccgtacggtacccgttacgtaggccaaggtcctcgtaaccgg

SEQ ID NO: 93640 - DNA, 502 bp, Homo sapiens
  misc_feature: GYAE6OF01EIQGJ.29.85.H08.1.454.CMB.1.raw
  modified_base (223)..(223): a, c, t, g, unknown or other
  misc_feature (223)..(223): n is a, c, g, or t
  modified_base (289)..(289): a, c, t, g, unknown or other
  misc_feature (289)..(289): n is a, c, g, or t
  modified_base (416)..(416): a, c, t, g, unknown or other
  misc_feature (416)..(416): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcacatctcctgcactggaaccngcagcgatgtcggtgttataacttgtctctgtacaacaacaccagcgacgccccgatcataattangatgtcattaagcggcctcgagggtctctgatcgcttctctggctcaagtctggcaacactcgcctcctgaccatctcgtgggctccgaggctgacgatgacggtgtatttattacgtgtctgcctntagtttgcgtacgccacccgcactgtgtattcgttcgggcgggaggaccaaggcctacggtacccgtcgtaaggtcagtcgtaacg

SEQ ID NO: 93641 - DNA, 580 bp, Homo sapiens
  misc_feature: GYAE6OF01BLJ5P.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcgtggtacagccgtggggggtccctgagactctcctgtgcagcctcgtggattcaagtttaatgtatttttccatacacgttgggtccgtcaagcgtccggggaagggtctgggagtgggtctctcttattaatcgagtacggtgctaactactattctatgcagactcgtggtaggaacgggcctattccacctatcctacagacgaacaacaaaccaagtacctccctagtactcgtgactaaagtagaactagtactaggaagtaagtgaacgacagcggtcttacttattagttgtagtaagaaaaggaggaacggcgaaggtacttacgttaaagggtcgggtcgttggtttacg

SEQ ID NO: 93642 - DNA, 584 bp, Homo sapiens
  misc_feature: GYAE6OF01EXH6S.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtctgggggagtcgtggtacagccgtggggggtccctgagactctcctgtgcagcctctggattcaagtttaatgtatttttccatacactgggtcctcaagcgtccggggaaggtctggagtgggtctctcttattaactcgagacggtgctactactattctatgcagactctgtgaagggccgattcacctatctccagacgacaacaactaagtacctccctgtactctgactaatgaacagtctagaagtaagtcgaacgacaggtccggtctttacgttaatttagtttaggtagtaaccgaaaaagggtacggaaaagggcaacgggtaattacgttaaagggttcggggttaccgtcggttttaacggg

SEQ ID NO: 93643 - DNA, 554 bp, Homo sapiens
  misc_feature: GYAE6OF01C34D2.29.85.H08.1.454.CMB.1.raw
  modified_base (194)..(194): a, c, t, g, unknown or other
  misc_feature (194)..(194): n is a, c, g, or t
  modified_base (215)..(215): a, c, t, g, unknown or other
  misc_feature (215)..(215): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (539)..(539): a, c, t, g, unknown or other
  misc_feature (539)..(539): n is a, c, g, or t
  modified_base (544)..(544): a, c, t, g, unknown or other
  misc_feature (544)..(544): n is a, c, g, or t
  modified_base (550)..(553): a, c, t, g, unknown or other
  misc_feature (550)..(553): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcgtggttataactttgtctcctggtaccaacaacacccaggccgaggccccccgatcataatttangatgtcattaacgcggccctnaggggtccctgatcgcttctctggctccaagtctggcacactgccctcctgaccatctcgtgggctccgaggctggacgagtgacggtgattattactgctgctctatttcgactacgccaccgcacgtgtagactcgttcgggacgggacgggaccaaggctacggtacccgttaccgtacgtcgacgtcgtacgaacggtccgtacgtccccgtcgtacctacttccgttccgtccccgtccctccttcctacgttacctcttaacttcgtcggtacggccgggtcgtcggaccgtaacgggcgtacgagtagcgcngntcncgtcntctcgnnnnc

SEQ ID NO: 93644 - DNA, 578 bp, Homo sapiens
  misc_feature: GYAE6OF01DS0WA.29.85.H08.1.454.CMB.1.raw
  modified_base (229)..(229): a, c, t, g, unknown or other
  misc_feature (229)..(229): n is a, c, g, or t
  modified_base (294)..(295): a, c, t, g, unknown or other
  misc_feature (294)..(295): n is a, c, g, or t
  modified_base (300)..(300): a, c, t, g, unknown or other
  misc_feature (300)..(300): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagttcgtccgggtctccgtggacagtcagtccaccatcctcctgcactggaaccngcagcgatgtcggtgttatacttgtctcgtgtaccaacacaccagcgacgccccactcatattannatgtnatacgcgtcctcgacgggtcctgatcgtcttctctcgctcgagtctgcactctcgtcctccgtcgacctactccgtcgtcggcctcgacgtctacgacgtcgtcggtacggtatacttacttacgtgtctcgcttacgtacgtttcgaccgacggtcccaccggtctaccgttcggtcggtaccgttccggtccgggacgggtaacggggaaccctacggtacccgtacggtaaccccggttcgttaaccggtactaaccggccttacggaacccggg

SEQ ID NO: 93645 - DNA, 151 bp, Homo sapiens; identical to SEQ ID NO: 93409
  misc_feature: GYAE6OF01BVG60.29.85.H08.1.454.CMB.1.raw
  modified_base (150)..(151): a, c, t, g, unknown or other
  misc_feature (150)..(151): n is a, c, g, or t

SEQ ID NO: 93646 - DNA, 568 bp, Homo sapiens
  misc_feature: GYAE6OF01EBM2M.29.85.H08.1.454.CMB.1.raw
  modified_base (224)..(224): a, c, t, g, unknown or other
  misc_feature (224)..(224): n is a, c, g, or t
  modified_base (288)..(288): a, c, t, g, unknown or other
  misc_feature (288)..(288): n is a, c, g, or t
  modified_base (345)..(345): a, c, t, g, unknown or other
  misc_feature (345)..(345): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcgtgttatacttgtctctgtaccaacacaccagcgacgccccgatcataattangatgtcatagcgcctcgacgggtcctgactcgtcttctctcgctcagtctgacaacnctcgcctcctcgacctactctcgtcgggtcctccgacggtctacggacgagtacgggtacggttgtagtttacttacgtcgtaccgtcgtccttactagtttcgcgtaccggacccacccgtcctacgttcgtacgtacgttccggttccgggacgggtaacggaccgtaacggtccgtacggtaccccgttacggtacggtccgacgtccgtcgtaaccggg

SEQ ID NO: 93647 - DNA, 893 bp, Homo sapiens
  misc_feature: GYAE6OF01BSLLF.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaggtgtccagtgtgaagtgcagctggtggagtcgtgggggagtcgtggtacagccgtgggggtccctgacgactctcctgtgcagcctcgtggattcaagtttaatgtatttttaccattacgtacgtcgggtccgtacgaacggtccgtaccgggggtaagggttcgtaggggtacggttcggggttccttcgttacctttaagttaacgtccggtaaggtaccgggttagtaccttaacttaaccgtaattttccctaagttcggaccgtaacggtaccgtttacgttacgggttaacgggtaaaccgggggtaccccgttaacgttttacccgaacccgtaactttacccgttaaccccgaaacgggtaaacccggtaaaacctaaaacccgtaaaaaccgtaaaaccggtttaaccccttacccccgtttacggttaactttacccgttacggtaaaccttaaaacgttacgtaaaaccgttacggttaccgttaagggaaacggttaaacgggttacggaaacccgggtaaccggaacgggtcccgggttaccgttttaccgtttaaacgttttaacggttttacggtaacggtaaaacccggtaaaaaagggtaacgggaaaacgggttaacccgaaacgggtttaaacgttaacccgggttaaaaggggtttcgggggtttaacccgggttccgggtttttaaacccggg

SEQ ID NO: 93648 - DNA, 644 bp, Homo sapiens
  misc_feature: GYAE6OF01AQKAR.29.85.H08.1.454.CMB.1.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
  modified_base (288)..(288): a, c, t, g, unknown or other
  misc_feature (288)..(288): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacngtcagtcaccatctcctgcactggaaccngcagcatggtcggtgttatacttgtctctgtaccaacacaccaggcgacgccccatcataattangatgtacatacgccgcctcgacgggtccctgactcgtcttctcgtcggtcctaccgtaacgtcgtacggacctaaaccgtctccgtcccttcccgtacgaccctacttccgtccgtcgggtcccttaccggacggtcctacggaccgtagtacggtaacgggttgtaacgtttacgtttacgtcgtacttcggtcttaccttacgtttcgaccgtccggtacccaacccgtcgtaacgttggtacgttaccgttaccgggttccgggaccggggtaacgggaacccgtacggtacccgttaccggtacccggtaccggttaccggtaccgacggttcccgtaccggtaaccccggg

SEQ ID NO: 93649 - DNA, 558 bp, Homo sapiens
  misc_feature: GYAE6OF01BOLF1.29.85.H08.1.454.CMB.1.raw
  modified_base (189)..(189): a, c, t, g, unknown or other
  misc_feature (189)..(189): n is a, c, g, or t
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
  modified_base (307)..(307): a, c, t, g, unknown or other
  misc_feature (307)..(307): n is a, c, g, or t
  modified_base (353)..(353): a, c, t, g, unknown or other
  misc_feature (353)..(353): n is a, c, g, or t
  modified_base (545)..(558): a, c, t, g, unknown or other
  misc_feature (545)..(558): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtgtatactttgtctcctggtaccaacacaccaggcgacgccccccgatcataacttangatgtcattagccgcctgacgggtccngatcgcttctcgtgctacagtcngacacactcgcctccagacctatctcgtcgggctccgaggctcgacgtaagtgaaccggttgaatttntactgaccttgtcctagttaacttggaccgtacggaccaacccgtntaccttaggtcgtacgtcgttacgggacgggtacggacctaagcgtcgtacccgtcgtacgtcgacgtcgtacgacggtcctcggtccccctcggttcctaccttccgtcccgtcccctacttcccgtataccttacgtcctaacgttccgaagggtccggccggtcgtacggacggacggcacgagagtcnnnnnnnnnnnnnn

SEQ ID NO: 93650 - DNA, 292 bp, Homo sapiens
  misc_feature: GYAE6OF01EO5HZ.29.85.H08.1.454.CMB.1.raw
  modified_base (287)..(292): a, c, t, g, unknown or other
  misc_feature (287)..(292): n is a, c, g, or t
tcagatagagtactcacgaccggtgctcgatttagtatcactcagtcgcgggtccctgatcgcttctctggctccaagtctggcaacactgcctccctgaccatctctgggctccaggctgacgatgacggtgattattactgctgctcatttgcaggcacccgcactgtgatcttcggcggagggaccaagctgaccgtcctaggtcagctcaaggctgccccctcggtcactctgttcccgccctcctcagtactctatctgagcgggctggcaaggcgcatagnnnnnn

SEQ ID NO: 93651 - DNA, 670 bp, Homo sapiens
  misc_feature: GYAE6OF01B5ZEI.29.85.H08.1.454.CMB.1.raw
  modified_base (188)..(188): a, c, t, g, unknown or other
  misc_feature (188)..(188): n is a, c, g, or t
  modified_base (227)..(227): a, c, t, g, unknown or other
  misc_feature (227)..(227): n is a, c, g, or t
  modified_base (292)..(293): a, c, t, g, unknown or other
  misc_feature (292)..(293): n is a, c, g, or t
  modified_base (299)..(299): a, c, t, g, unknown or other
  misc_feature (299)..(299): n is a, c, g, or t
  modified_base (324)..(324): a, c, t, g, unknown or other
  misc_feature (324)..(324): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatccgtgggctcagtctgccctgactcagcctcgctcagtcgtccggtntcctggacagacagtccaccatctctgcacgtggaaccngcagcgtatgtcggtgttatacttgtctctgtacaacacaccgagcgcgccccgatcatacttannatgtanattaacgcgtcctcgacgggtcccngtactcgtcttactcgtcggtcctaccgaagttccgtacggtaccaaaccgtacgttcgcccccgtttaccgtaccgtaccctacttccgttcccggtcggggtcccttacccgtagggtcctaaggaccgtacggtacggtacggttacgttacgtttaacttacgtcgtactcgtcgttacttacgtttcgaccggtaccggaccgtaacccgtcgtaaccgttgtacgtaccggtttaccggttacccggggaccgggttaaaccgggacccgtaacggtacccggtccggttaaaccccggtcgtaacggtacccggaccgttaccgtaccggtaacccggg

SEQ ID NO: 93652 - DNA, 451 bp, Homo sapiens
  misc_feature: GYAE6OF01B6ZG9.29.85.H08.1.454.CMB.1.raw
  modified_base (210)..(210): a, c, t, g, unknown or other
  misc_feature (210)..(210): n is a, c, g, or t
  modified_base (370)..(370): a, c, t, g, unknown or other
  misc_feature (370)..(370): n is a, c, g, or t
  modified_base (429)..(451): a, c, t, g, unknown or other
  misc_feature (429)..(451): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgatcataatttatgatgtcattaagcggccctcaggggtccctgatcgcttctctggctccaagtctggcaacnctgcctccctgaccatctctgggctccaggctgacgatgacggtgattattactgctgctcatttgcaggcacccgcactgtgatcgttcgggcggagggaccaagctgacccgtctaggtcagctcgaaggcctcgcccctggtcactctcgttccccncctcctctacgtactcttatctgacggcgggtctcgggacaacgggccgactagtacgnnnnnnnnnnnnnnnnnnnnnnn

SEQ ID NO: 93653 - DNA, 482 bp, Homo sapiens
  misc_feature: GYAE6OF01AE0GY.29.85.H08.1.454.CMB.1.raw
  modified_base (459)..(482): a, c, t, g, unknown or other
  misc_feature (459)..(482): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctcccaagtctggcaacactgccctccctgacccatctctgggctccaggctgacgatgacggtgattattactgctgctctatttgcaggccacccgcactgtgatcgttcgggcggacgggaccaagtctcggacccgtccgtaaggtcagctacgaacggcctccgcccccgtggtacccacttccgttccgttcccccaccccttcctactacgttactcttatctgacggcgggtactggcgaacgggcgactagtagcnnnnnnnnnnnnnnnnnnnnnnnn

SEQ ID NO: 93654 - DNA, 627 bp, Homo sapiens
  misc_feature: GYAE6OF01BGVPI.29.85.H08.1.454.CMB.1.raw
  modified_base (205)..(205): a, c, t, g, unknown or other
  misc_feature (205)..(205): n is a, c, g, or t
  modified_base (223)..(223): a, c, t, g, unknown or other
  misc_feature (223)..(223): n is a, c, g, or t
  modified_base (292)..(292): a, c, t, g, unknown or other
  misc_feature (292)..(292): n is a, c, g, or t
  modified_base (358)..(358): a, c, t, g, unknown or other
  misc_feature (358)..(358): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccggtctcctggacagtcagtcacntctcctgcactggaaccngcagcgatggtcgtgttatacttgtctctgtaccaacaacaccaggcgacggcccccgatcataattangatgtcagttaacgccggcctcgacgggtccctgactcgcttctcgtgctcaagtctggaccaacncgtcgaccctccgtacgacctacttccgtcgtacgggtcctacccgacgggtcctacggaccgtacgtacggtaccggttgtaactttacgttacgtacgtccgttcgtaccttcgtaacgttttcggacctaaccgggtccctaaccccggtcgtaaccgttggttacgtaaccgtttccgggttaccggggaccggtaacgggaacccctaagggtcccgtaccggtacccgtacgttaccggacctacggcctaccggtaaccggg

SEQ ID NO: 93655 - DNA, 728 bp, Homo sapiens
  misc_feature: GYAE6OF01AQNVR.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggtttccttgttgctatttaaaggtgtcagtgtgaagtgcagctggtggaggtcgtgggggagtcggtggtacaggccgtggggggtccctgacgactctcctgtgcagcctcgtggattctaagtttaatgtatttttaccatacactgggtcctacgaagccgtccggggaaggtcgtggagtcgggtctctcttattatcggagtcggtgctaactactattctatgactacgtactcttaggtacggtaacgggcccgttacttaccgaccctaacttccgtaacccgaacggtaacgaaaccaaacccgaaaacgtaaacgtacccttacccttacggtaacttaccacggtaacctaaaagtaccgtaaactacgttaccgttaaggaagggtaacgtagggaacccgtaacggacggttacccggttactttaccggtttaaatttacggtttcggttaaacggaaacccggaaaaaagggtcggtaaaacggggtccgaaacggggttacggtttaacccgtttaaaggggggttcccggggtttaggtttaaccccgggtttaggg

SEQ ID NO: 93656 - DNA, 660 bp, Homo sapiens
  misc_feature: GYAE6OF01DSU7H.29.85.H08.1.454.CMB.1.raw
tcagatagagtactcacgaccggtgctcgatttagtatcactcaggtcggcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcacatctcctgcactagaaccagcagcgatgtcggtggttatactttgtctcctgtaccaacaacaccaggccgaccgcccccgactcaattaatttactgtatcgtactagttaacgccgtccctcgtacgggtcctgactcgtcttcgtcgtcggcctacgaacgttcgtacggccaactcgtcgcccttcccgtacgaacctacttccgtcgttcgggacctaccggtacggtccgtaacggaccgtagttcgggtaaccgggttataacgttttacgttacgtcgtccgtacgtacctttacgtacgttttcgaccgtaccggaccctaccccgtcgtaccgttcgtacggtaccgttccgggtacgggaccgggtaaccgggtacccgtaacggtaccggtccgtaacccggttccggtaacggtacccaacggtccgtacggtaaccccggg

SEQ ID NO: 93657 - DNA, 596 bp, Homo sapiens
  misc_feature: GYAE6OF01AQX8Q.29.85.H08.1.454.CMB.1.raw
tcagatagagtactcacgaccggtgctcgatttagtatcactcagtcgcggggggggtctcaggaggcagctactctcgggacgtctccaccagtggcctgggctctgcttcctcctcagcctccgtcactcagggcacaggatccctgggctcagtctgccctgactcagcctcgctcgagtcgtccgggtctcctggacagtcagtcaccatctcctgcactggaaccagcagcgatgtcggtgtatacttgtctctgtaccaacacaccagcgacgcccccgatcataattatgatgtcattaacgcggtccctcgtacgggtccctgactcgcttctctcggctccaagtctggcctaacactcgcctccctgacctatcctcgtgggccttccgaggtctggaccgagtcggtacggtagtaactttattactcgcttacgtcctacttacgtttcgccgaacggtccctaaccccgctaaccgttggtctaacgttcccggttaccgggtcgggaacgggtaacccacggtcccctagggtacccccgttaccggttacggaccctacggcccttaccggtaaacccggg

SEQ ID NO: 93658 - DNA, 550 bp, Homo sapiens
  misc_feature: GYAE6OF01BOTCM.29.85.H08.1.454.CMB.1.raw
  modified_base (235)..(235): a, c, t, g, unknown or other
  misc_feature (235)..(235): n is a, c, g, or t
  modified_base (332)..(332): a, c, t, g, unknown or other
  misc_feature (332)..(332): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (540)..(541): a, c, t, g, unknown or other
  misc_feature (540)..(541): n is a, c, g, or t
  modified_base (543)..(544): a, c, t, g, unknown or other
  misc_feature (543)..(544): n is a, c, g, or t
  modified_base (547)..(550): a, c, t, g, unknown or other
  misc_feature (547)..(550): n is a, c, g, or t
tcagatagagtactcacgaccggtgctcgatttagtatcactcagtctgccctgactcagcctcgctcagtgtccgggtctcctggacagtcagtcacatctcctgcactggaaccagcagcgatgtcggtggttataacgtttgtctcctggtaccaacaacacccaggcgaggccccccgatcataattatgatgtcattaacgcggccctgaggggtccctgatcgctttcnctggctcaagtctggcaacactgcctcctgaccatctctggctccaggctgacgatgacggtgatttatactgctgctctatttgctagccacccgntaccgtgtcattccgttcgggcgggtaacggaccaagtccgttacgacccggttccgtaggtcacgccgtacgaacggcctaccggcccccgtcggtcctaccgttccttaccgttcccctaccctcccttactacgttaccttcttacgtcctacggacggtccggtcgtcgggacgtaacggtccgactacgtagtgcanancgcnncnncannnn

SEQ ID NO: 93659 - DNA, 728 bp, Homo sapiens
  misc_feature: GYAE6OF01AKWSW.29.85.H08.1.454.CMB.1.raw
  modified_base (245)..(245): a, c, t, g, unknown or other
  misc_feature (245)..(245): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaggtgtccagtgtgaagtgcagctggtggagtcgtgggggagtcgtggtacaggccgtggggggtcccngacgactctccgtgtgcacgtcctgtaggtattacgtaagtttatgttacttttccatactacgtcggtaccgtacgaacgtccggtaccggggtaggtcgtgggtaggttcgggttcctcgttacgtttaagttacgtcggtaacggtacggtcgtaccttaactacgtacgtttactagtcgacgtaacgtaccgttcgttggtagggaaccggggtcccgtaaactttcccgaacccgtactttacccgaccgtaaggtaacccgaacctaaaaccaaccgttaaaccgttacccttacccgtaagtacttccgtacggaactaaagtcgaaagtcgtacgttaggaacgtaggtaccgaagaccgtacggtcggtttaccttaacgttatttaaggtttagacggtaaaggtaaaaaggagaacgggtacgaaggtttacgtaacggttaggggttcgggttccggttcggtttaacgg

SEQ ID NO: 93660 - DNA, 818 bp, Homo sapiens
  misc_feature: GYAE6OF01CK800.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagtcgttgggttttccttgttgtcttaattttaaaaggtgtccagtgtgaagtgcagctgggtggagtcgtgggggagtcggtggtacaggccggtggggggtccctggagactctccgtgtgcacgcctcgtggtattacgtaagttttaatgttactttttaccataccgtaccgttcggggtacccgtacgaacggtccggtaccgggggtaaggttcgtagggtaggttcggggttacctctttacttaagtttaaagtccggaaggtaccgggttacgacttaaccttactaatttaccgtaagttcggaccaaggttaccttaccgttaggtagggaaaccgggtcccgtaacttacccaaccctattaccctaccgaaagaaacgaacaaaaccaaactaacgtacccttacccgtagttaactccgttagaacctaaaagtcgaaaactcggttaacctaggtaaaggtaaacggttacggaaacccgtaacgtaccgggtaacccggttacttttaccgtttaaagtttaacgtttagggtaaccgggtaaaacaaaaaacggggtaagggaaaccggggtaccgtaaaagggttaaccgtttaaacgggttaaaggggtttccgggggttacccgggtttaacgggtttttaaacccggg

SEQ ID NO: 93661 - DNA, 551 bp, Homo sapiens
  misc_feature: GYAE6OF01BOT1O.29.85.H08.1.454.CMB.1.raw
  modified_base (534)..(534): a, c, t, g, unknown or other
  misc_feature (534)..(534): n is a, c, g, or t
  modified_base (539)..(551): a, c, t, g, unknown or other
  misc_feature (539)..(551): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgccctccctgacctatcctcgtcgggctccagggtctggaccgatggacggttgtatttattactgcttgctcgtatttcgcacggccacccgcacgtgtgacttcgttcgggacggacgggaccaaggcctcgtaccgtccgtaggtcacgtctacgacggtcctccggtcccccgtcggtaccctacgttcccgttcccggttcccccgtcccttcccgtactaccgttacctcgttactcgtcggtacggcgggtcgtcggacgacggcgacngtagnnnnnnnnnnnnn

SEQ ID NO: 93662 - DNA, 527 bp, Homo sapiens
  misc_feature: GYAE6OF01B1JSL.29.85.H08.1.454.CMB.1.raw
  modified_base (224)..(224): a, c, t, g, unknown or other
  misc_feature (224)..(224): n is a, c, g, or t
  modified_base (372)..(372): a, c, t, g, unknown or other
  misc_feature (372)..(372): n is a, c, g, or t
  modified_base (414)..(414): a, c, t, g, unknown or other
  misc_feature (414)..(414): n is a, c, g, or t
  modified_base (479)..(479): a, c, t, g, unknown or other
  misc_feature (479)..(479): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtggttataactttgtctcctggtaccaacaacaccaggcgacgcccccgactcataatttatgatgtcattaagcgccctcgacgggtccctgactcgcttctcgtgctccagtctggcaacactcgaccttccncgtaccactctctcgggctcccgaggctgacgatcgacggtntattattactgtctgccttctatttgcctacggccacccgcacgttgtcgtacgtcgttccgggnggacgggaccaaggccgtagacccgtcctacggtcacgcgtcgaccgg

SEQ ID NO: 93663 - DNA, 566 bp, Homo sapiens
  misc_feature: GYAE6OF01B0JDR.29.85.H08.1.454.CMB.1.raw
  modified_base (332)..(332): a, c, t, g, unknown or other
  misc_feature (332)..(332): n is a, c, g, or t
  modified_base (553)..(559): a, c, t, g, unknown or other
  misc_feature (553)..(559): n is a, c, g, or t
  modified_base (561)..(566): a, c, t, g, unknown or other
  misc_feature (561)..(566): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtgttataactttgtctcctggtaccaacaacacccaggcgaggccccccatcataatttatgatgtcattaagcggccctgagggtccctgatcgcttctctggctccaagtctggcaacactgcctcctgaccatctctggcctcaggctgacgatgacggtgtattatactgctgtctacatttgccaggccaacccgntaccttggtcgtaagtccgtttacgggaccggaagggtaccaaacggcgttaccggacccggtaccgtaggtccagtcctacggaaacggtctcccggtacccccttcggtacccgtaccgttccgttccgttcccccgtcccttcccgtacaaccgtttacctccttaacgtcctaggtaccggccgggtacgtcggacgaacggccgacagtagcgacnnnnnnncnnnnnn

SEQ ID NO: 93664 - DNA, 689 bp, Homo sapiens
  misc_feature: GYAE6OF01CX54R.29.85.H08.1.454.CMB.1.raw
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (292)..(292): a, c, t, g, unknown or other
  misc_feature (292)..(292): n is a, c, g, or t
tcagatagagtactcacgaccggtgctcgatttagtatcactcagtcgcggggggggtctcaggaggcagcactctcgggacgtctccaccatggcctgggctctgctcctcctcaccctcctcactcagggcacaggatcctggctcagtctgccctgactcacgcctccctccgtgtccggtctccgtggacagtcagtcaccgtctcctgcagtcggaaccagcagtgacgttgngcttataccgtntctctggtacagcacgccccaggcacacgaccccaaatcatntattttcgacgtctagtaacgtcgcctacgacgggtcctgacgtcgtcttcgtcgtcggtacagttcgcggcacgccgtaccggtcctccgtagtactttacgtcgtacgtcggacctacgacgtacgtaggacggtacggacgtacgtaagtaatttagttacgttacggactaggtacctaataacgtaacgttaaccgaaacgggtaaacctaaacttaacgtttaacgttacggtttaaccgttaacggtaaaccggtaaccgggtaaaaccgaaccggttaccgtaacccggttaacggtacggttaaccgaacccggaaccccggtaaacccgaaaccccgtaaacccccgtagttacccggtaaccctaccgttccccgtttaacccccg

SEQ ID NO: 93665 - DNA, 755 bp, Homo sapiens
  misc_feature: GYAE6OF01C8W9L.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctatttaaaaggtgtccagtgtgaagtgcagctggtggagtcgtgggggagtcgtggtacagccgtgggggtcctgagactctcctgtgcagcctcgtggattctaaagtttaatagtactttttccaattacctacgtcggggttaccgtacgtaaacggtccggtaccgggggtaaacgggtccgtaggggtaggttcggggttacctttcgttactttaattaaagtccggaaggtacggtcgtaccttaacttaactactttactagttcgactaacgtaccgttcgtaggtaggtaaacggggcccgtaactttacccaaccctacttaccctaccgaaaggaacgtaaaccaaaaccgtaaaaccgtaaaccgtttacccttaccccgtagttaacctaccgttaacggacctaaacgtaacggaacgtaacgttacctacggaaaggtaacgtacggaaaccgaacgtacgggtacccggttacttttacgttaacgtttaagttacggtacgtaaacgaaaaggtaacggaacgtacgaaggtacgttacggtaaggttacgggtcggttacggttacgg

SEQ ID NO: 93666 - DNA, 670 bp, Homo sapiens
  misc_feature: GYAE6OF01BZ7Q3.29.85.H08.1.454.CMB.1.raw
  modified_base (227)..(227): a, c, t, g, unknown or other
  misc_feature (227)..(227): n is a, c, g, or t
  modified_base (309)..(309): a, c, t, g, unknown or other
  misc_feature (309)..(309): n is a, c, g, or t
tcagatagagtactcacgaccggtgctcgatttagtatcactcagtcggcggggggggtctcaggaggcagcactctcgggacgtctccaccatggcctggctctgctcctcctcagcctcctcactcgagggcacaggatccgtgggctcagtctgccctgactcagcctcgctcagtcgtccggtctccgtggacagtcagtcaccatcctctgcactggaaccngcagcgagtggtcgtgttatacgtttgctctagtaccaacaaccaccgaggccgaccggcccccgtatcctaattaatttangtatgtactagttaacgcgtccctcggacgggtcctgactcgtacttctcgtcggtcctaccgaagttcgtacggacctaaccgtaccgtccgtccccttcccgtacgtaaccctacgtccgttcggtccgggtacctccgtagggtctacggacgttagtcggtacggtattaacgttacgttactgtccttgtcgttacgttacgttcggaccgtaccggtaccacccgtacgtaacggtcgttacgtacgttacccgggtacgggtacccgggaaggtacccgtaaacgtccggttaaccgggtaccccgtttacgggttaccggtaccctacgggtcccgttaccggtaaccccggg

SEQ ID NO: 93667 - DNA, 592 bp, Homo sapiens
  misc_feature: GYAE6OF01CGL2Q.29.85.H08.1.454.CMB.1.raw
tcagatagagtactcacgaccggtgctcgatttagtatcactcagtcggcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgttatacttgtctcgtgtaccaacacaccaggcgacggcccccgatcaatattatgatgtacattaacgccgcctcgacgggtccctgactcgtcttcgtcgtcggtcctacctaagtcgtggaccaacgctcgccctcccgtcgacctatccgtcgtcggtcctccgtaggtcgtacgacgtagtcggtacggttagtaacttacttacgtgtacttcgtcttacgtacgtttcgacgtaccggccctaacccggctaacgttcgtagtacgttccggttccgggacggacgggtaccacgccgttaccgacccggttaccgtacggtaccgacgtccgtccgtaacccggg

SEQ ID NO: 93668 - DNA, 818 bp, Homo sapiens
  misc_feature: GYAE6OF01D5SK3.29.85.H08.1.454.CMB.1.raw
  modified_base (240)..(240): a, c, t, g, unknown or other
  misc_feature (240)..(240): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacgaggactccgtgggctcagtctcgccctgactcacgcctcgctcgagtcggtccggtctccgtggacagtcagtccacctagtcctctgctacgtacggaaccngcgagcgtagttcggttacggttagttacttaacgtttcgttcctaccgttacgtaaccaaccgtaaccgaccgtacgggcccgaacccgggtaccccccgtaataccgtaactttaacgtttacgattacgtcgtaacgtaactttaaccggcccgtacccggttaccggtaaccggggtccttacggtaccgttccgtccgtttccgtccggttacggtacccttaacccggtaacggttccgtaaccggtaccgtaaaaccgtacccggttccggtaccccgtttcccgaacgttacccgtaccgtttacccggttcggtaccggggtcccttacgggtaccggtacgtacgggtaaaccggttacggtaaccgggttacggttaaccgtttacgttttaactaccggttacgttccgtaacgttccgtttagttaccggtttacggaccgggtaaccgcccgtaaccggtctaaccgggttgtacgttaccggtccggttaccgggccgggtaaggtcccgacggttccggtacgtacccgtacggtacgtccgtaacgccgtaccggtaccgg

SEQ ID NO: 93669 - DNA, 152 bp, Homo sapiens
  misc_feature: GYAE6OF01BP6CK.29.85.H08.1.454.CMB.1.raw
  modified_base (151)..(152): a, c, t, g, unknown or other
  misc_feature (151)..(152): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgagcgggctggcaaggcgtcatagnn

SEQ ID NO: 93670 - DNA, 814 bp, Homo sapiens
  misc_feature: GYAE6OF01A9BR8.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagtcttgggttttccttgttgtcttaattttaaaaggtgtccagtgtgaagtgcagcgtgggtggaggtcgtgggggtagtcggtggtacgacggtccggtcggggggtccctggacgactcctcctgtgcacgcctcgtggtattcgtaaagtttatagttactttttaccattaccgtacgtcgggtccgtacgaacggtccggtaccggggtaagggtcgtagggaggttcgggtccttacgttactttaagttaaacgttcggtaacggtaccgggttcgtaccgttaaccttaactactttactacgtacgaccgtaagtaccgttacggtacggtaacggaacggggtacccgtaacttcccgaaccctaccgttcctaaccgaaggaactaaacccgaaaactaaacctaaccggttaccccttacccgtagttaacctacgtacgtaactaaacgtaccgaaacgtagttaaccgtaggtaacggtaaacggtacgaaccgtaaccggacgggtacccgttactttaaccgtttaagttttaacggttcggtaaacggaagtaaaaacgggtaagggtaaacggtacgggtaaaagggttaccgttaacgggttaaaggggttccggggtttaacgggttaccgggttttaaaccggg

SEQ ID NO: 93671 - DNA, 629 bp, Homo sapiens
  misc_feature: GYAE6OF01BSF9O.29.85.H08.1.454.CMB.1.raw
  modified_base (224)..(224): a, c, t, g, unknown or other
  misc_feature (224)..(224): n is a, c, g, or t
  modified_base (300)..(300): a, c, t, g, unknown or other
  misc_feature (300)..(300): n is a, c, g, or t
tcagatagagtactcacgaccggtgctcgatttagtatcactcagtcgcggggggggtctcaggaggcagcactctctggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtggttataactttgtctcctggtaccaacaacacccaggccgacggccccccatcataattangatgtcagttaacgcggcctgacgggtccctgactcgcttctctggctcagtctgctaacactcgccctcccgtacgacctacttccgtcgtcggggtccctaccgacggtcctacggaaccgtagtcggtaacggtagtaactttacgttactcggtctcgtcttccgtaagtttcgaccgtaacgggaccctaccccgtctaaccgtggttacgtacgttaccggttacccggggacggggtaaaccgggtaacccgaacggtacccgtaccgggttaaccccggtaccggtttaacgggtccctaacgggtacccttaaacccggg

SEQ ID NO: 93672 - DNA, 150 bp, Homo sapiens; identical to SEQ ID NO: 93401
  misc_feature: GYAE6OF01BNYON.29.85.H08.1.454.CMB.1.raw
  modified_base (150)..(150): a, c, t, g, unknown or other
  misc_feature (150)..(150): n is a, c, g, or t

SEQ ID NO: 93673 - DNA, 814 bp, Homo sapiens
  misc_feature: GYAE6OF01D1H7O.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagtcgttgggttttccttgttgtcttaattttaaaaggtgtccaggtgtagtaagtgcagcgtggtggagtcggtggggagtcggtggtacgaggccgtcgggggtccctggacgactctccgtgtgcacgtcctcgtggtacttacgtaaagttttaatcgtttacttttaccacttacctacggttcgggtccgtacgaacggtccgggtaccgggggtaacgggtcggtgggtagggttcgggttcttcgttacgttttaacgttaaacgtcggaacggtacgggttctacctttaacgttacttacttcgttacgtacgtaccgtagtaccgttcgtaggtacgggaacggtaccgttatacccgtacctacttcctaccgaaagtacgaaactaaaccgtaacgtaacgttaccctaccgttattaccgtacgttaaccgaacttaaacgtacgtaaacgttacggttaacgtacgggtaaaaggtaacgttaacgggaaccgtaacggacgggttacccggtttacctttaagtttaaactttaaggttaacggtaaacggtaaaacggtaaaacggtaacgggaagggtaccggttaaagggtacgtttaaccgggttaaagggttcccggggtttaacgggttcggtttaacccgggg

SEQ ID NO: 93674 - DNA, 529 bp, Homo sapiens
  misc_feature: GYAE6OF01ATHVM.29.85.H08.1.454.CMB.1.raw
  modified_base (311)..(311): a, c, t, g, unknown or other
  misc_feature (311)..(311): n is a, c, g, or t
  modified_base (403)..(403): a, c, t, g, unknown or other
  misc_feature (403)..(403): n is a, c, g, or t
  modified_base (516)..(516): a, c, t, g, unknown or other
  misc_feature (516)..(516): n is a, c, g, or t
  modified_base (518)..(529): a, c, t, g, unknown or other
  misc_feature (518)..(529): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgacggccccccgactcataatttatgatgtcattaagcggccctcgaggggtccctgatcgcttctctggctccagtctggcaacactcgccctccctgaccatctctcgggcctcccgaggcctgacgatcggacggtntatttacttacgtgctgctctattgcacggccacccgcactggtgtactcgttcgggacggtagggaaccagcctcgacccgtcctaggtcncgtcacgacggcctccgtccccgtcggtcctccttccgtcccgttccccgccctccctactcgttacctctactcgtcggtcggcgggtcgtcgacgaaggccgactagacgngnnnnnnnnnnnn

SEQ ID NO: 93675 - DNA, 592 bp, Homo sapiens
  misc_feature: GYAE6OF01B9NTO.29.85.H08.1.454.CMB.1.raw
  modified_base (211)..(211): a, c, t, g, unknown or other
  misc_feature (211)..(211): n is a, c, g, or t
  modified_base (294)..(294): a, c, t, g, unknown or other
  misc_feature (294)..(294): n is a, c, g, or t
  modified_base (474)..(474): a, c, t, g, unknown or other
  misc_feature (474)..(474): n is a, c, g, or t
  modified_base (573)..(573): a, c, t, g, unknown or other
  misc_feature (573)..(573): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctccngcatggaaccagcagcgatgtcggtgttataactttgctctggtaccaacaacaccaggcgacggcccccatcaataatttangatgtactattaagccggcctcgagggtccctggtactcgtcttctcgtggcctccgaagtctacggaccaaacctactcgccccttcccgtacgaccctacttccgtcgttcgggcctccgaggccttaggaacgagtggtacggttagtaactttattaccgtggtctcgtcttaccngtttccgacgacgggccctacccggctacgtaggtgacgttccggtcgggacgggacgggaccaacggtcccgtacgtaccccggttcctaaggtaccncgtaccgtccgtaaccggg

SEQ ID NO: 93676 - DNA, 513 bp, Homo sapiens
  misc_feature: GYAE6OF01DYAFS.29.85.H08.1.454.CMB.1.raw
  modified_base (290)..(290): a, c, t, g, unknown or other
  misc_feature (290)..(290): n is a, c, g, or t
  modified_base (402)..(402): a, c, t, g, unknown or other
  misc_feature (402)..(402): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgttatacttgtctctgtaccaacacaccagcgacgcccccgatcataattangatgtcattaagcgccctcgacggggtccctgactcgtcttcgtctggctccaagtctggcaaacactcgccctcctgacctatctctggcctcaggctgacgatgacggtnatttactactgctgctcatttcgctacggccacccgctactgtagacttcgttcgggacgggagggaccaagccgtacgacccgttcgtacggtacacggtcgtcgaacgg

SEQ ID NO: 93677 - DNA, 152 bp, Homo sapiens; identical to SEQ ID NO: 93475
  misc_feature: GYAE6OF01BVTWQ.29.85.H08.1.454.CMB.1.raw
  modified_base (150)..(152): a, c, t, g, unknown or other
  misc_feature (150)..(152): n is a, c, g, or t

SEQ ID NO: 93678 - DNA, 548 bp, Homo sapiens
  misc_feature: GYAE6OF01CODLO.29.85.H08.1.454.CMB.1.raw
  modified_base (224)..(224): a, c, t, g, unknown or other
  misc_feature (224)..(224): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatggtcggtggttataactttgtctcctggtaccaacacaccaggcgacggcccccgatcataatttatgatgtcattaacgccggccctcgacgggtccctgacgtcgtcttctcgtgcctacaagtctaggcaacactcgccctcctcgacctactccgtacgtcggcctaccgaggtctagacgtatcggtacggtgtacgttacttacgtgtctgtctctagtttcgcgtacggcctaccgctactcggtacgtacgttcgtacgggcggagggaccagccgtcgaccgtcgtacggtacacgtcgtcgtacgg

SEQ ID NO: 93679 - DNA, 560 bp, Homo sapiens
  misc_feature: GYAE6OF01D19BY.29.85.H08.1.454.CMB.1.raw
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
  modified_base (457)..(457): a, c, t, g, unknown or other
  misc_feature (457)..(457): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgtatacttgtctctgtacacacaccngcncgccccatcatattngatntnattaacgcgtccncgacgggtcctgactcgcttctcgtcggctcgaagtctcggacacnctcgccctccgtnacctatcctcgtcggcctcgaggctgacgtagtcggtacggtgtactttagttacgtgtcctggtccttacgtagtttcgacgtacggaccacccgntaccgtggtacgtacttccggttcgggaccggtaacgggaccctaacggccgttaccggaacccggttccgtaacggttaccacggtccgtaccgtaaccggg

SEQ ID NO: 93680 - DNA, 151 bp, Homo sapiens; identical to SEQ ID NO: 93409
  misc_feature: GYAE6OF01DVGVM.29.85.H08.1.454.CMB.1.raw
  modified_base (150)..(151): a, c, t, g, unknown or other
  misc_feature (150)..(151): n is a, c, g, or t

SEQ ID NO: 93681 - DNA, 151 bp, Homo sapiens; identical to SEQ ID NO: 93409
  misc_feature: GYAE6OF01BYMKJ.29.85.H08.1.454.CMB.1.raw
  modified_base (150)..(151): a, c, t, g, unknown or other
  misc_feature (150)..(151): n is a, c, g, or t

SEQ ID NO: 93682 - DNA, 610 bp, Homo sapiens
  misc_feature: GYAE6OF01CKP32.29.85.H08.1.454.CMB.1.raw
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcgagggcacgaggactccgtgggctcagtcctcgccctgactcagcctcgctcgagtcggtccggtctccgtggacagtcagtccacctatcctcctgcacgtacggaccagcagcagtggtcggtagttatacgttgtctcgtacgaccaacaccaccgagccgacgccccatcattatactgtatgtacaagtacgcgccgtcggacggtcctagctcgtcttcgtcgcgtctacgagtcncgacacgtcncgaccctcctacgacctagttcgtacgtcggtcctcggacgtcgtacggacgtacgtacggtaccggttagtacgtttacgtttacgtcgtcgttcgtaccttagttacgtttacggacctacggaccctaacccgcgtaacgtcgtacgtacgttccgggtaacgggcccgggaaggtacccgcggtaccgtaccgtaccgtcggacggtacacgcgttacgacccgg

SEQ ID NO: 93683 - DNA, 539 bp, Homo sapiens
  misc_feature: GYAE6OF01B1WGE.29.85.H08.1.454.CMB.1.raw
  modified_base (258)..(258): a, c, t, g, unknown or other
  misc_feature (258)..(258): n is a, c, g, or t
  modified_base (525)..(525): a, c, t, g, unknown or other
  misc_feature (525)..(525): n is a, c, g, or t
  modified_base (527)..(539): a, c, t, g, unknown or other
  misc_feature (527)..(539): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgacggccccccgactcattaatttatgatgtcattaagcggcctcaggggtccctgatcgcttctctggcctccaagtctggcaacnctcgccctccctgaccatctcgtcgggcctccgaggctggaccgagtcggacggttgtaatttagttacttgccttgccttactagttttcggctacggccaacccgtcaccgtgtgacttcgtcggggacggagggaccaacgtcgtacggacccgttcgtaggtcagctacgacgtcctccgccccgtcgtctacgtccgtccgttccccgccctcctctacgttctctactcgtgacggcggtcgtcggacgacggcgcagcgncnnnnnnnnnnnnn

SEQ ID NO: 93684 - DNA, 656 bp, Homo sapiens
  misc_feature: GYAE6OF01CFTVJ.29.85.H08.1.454.CMB.1.raw
  modified_base (276)..(276): a, c, t, g, unknown or other
  misc_feature (276)..(276): n is a, c, g, or t
  modified_base (629)..(629): a, c, t, g, unknown or other
  misc_feature (629)..(629): n is a, c, g, or t
  modified_base (635)..(635): a, c, t, g, unknown or other
  misc_feature (635)..(635): n is a, c, g, or t
  modified_base (642)..(642): a, c, t, g, unknown or other
  misc_feature (642)..(642): n is a, c, g, or t
  modified_base (647)..(647): a, c, t, g, unknown or other
  misc_feature (647)..(647): n is a, c, g, or t
  modified_base (649)..(650): a, c, t, g, unknown or other
  misc_feature (649)..(650): n is a, c, g, or t
  modified_base (652)..(652): a, c, t, g, unknown or other
  misc_feature (652)..(652): n is a, c, g, or t
  modified_base (654)..(654): a, c, t, g, unknown or other
  misc_feature (654)..(654): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgacggccccccgatcattaatttatgaattgtctaagttaagccggccctgacgggggtccctggatcgcttctctggctacaagtctggacaacactgcctccngaccatctcgtcggctcgaggctgacgtagtcggacggtgtactttatactgtctcgtcttctagtttcgaccgcggccacccggtctaccgttgtacgtacgttccggttacggggacgggtaccgggaaccgtaacgcccgttacggtacccggttccgttacggtaccgacggtacctacggtaacggtcctcccggtacccccgttcggtaccctaccgttccgttcccggttcccccgtcccgttcccgttaccgtaaccggttaccttccgttaacgttacgtacgggtaccgggtaccgggttacggtacgggtaccggtaacgggtccgtaacgtacgtaccggntcgtanctcgcgncgtcncnncngngc

SEQ ID NO: 93685 - DNA, 434 bp, Homo sapiens
  misc_feature: GYAE6OF01BU4RE.29.85.H08.1.454.CMB.1.raw
  modified_base (419)..(434): a, c, t, g, unknown or other
  misc_feature (419)..(434): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattattactgctgctcatttgcaggcacccgcactgtgatcgttcggcggaggaccaagctgaccgtccgtaggtcagctcgaagctcgcccctcggtcactcctcgttccccgcccttcctcacgtactctatctgagcggcgtcggcgaggcgacactagnnnnnnnnnnnnnnnn

SEQ ID NO: 93686 - DNA, 716 bp, Homo sapiens
  misc_feature: GYAE6OF01AUGIO.29.85.H08.1.454.CMB.1.raw
  modified_base (158)..(158): a, c, t, g, unknown or other
  misc_feature (158)..(158): n is a, c, g, or t
  modified_base (245)..(245): a, c, t, g, unknown or other
  misc_feature (245)..(245): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacgaggactccgtgggctcagtcncgccctgactcacgcctcgctcaggtcggtccgggtctccgtaggacagtcacgtccacctatcctcgtcgcctacgtacggaaccngcgacgcgtagtcggttcgggttaggttaactttaacgtttcgtcctccgtacggtaacccaaacaaccgaccgacgggaccggacccggccccccgactaccgtaattaactttactagtatcgtactaagtaacggccggccctacggacggggtccctgtacgtcgtcttcctgtcgtcctaccgtaacgtcgttacggacctaaaccgtaccgttcgtcccctcccgttacgaccctacgttccgttcggtacgggtccctaccggtacggtcgtaacgacgttagacgggtacggttcttaactttacgttaccgtgtaccgtgtaccttacgttacgtttgaccggttacggacccaccggtacgtcgttagtcgtacggttccgttaccggggacgggtaaccggaacgtacgtaccgtaccgtaccgttaccggtaggtacctacggtccgtacgtacccggg

SEQ ID NO: 93687 - DNA, 850 bp, Homo sapiens
  misc_feature: GYAE6OF01C586U.29.85.H08.1.454.CMB.1.raw
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacaggatccgtgggctcagtctcgccctgactcacgcctcgctcagtcggtccggtctcctggacngtcagtcaccatcctccgtgactacgtcggaaccngcagcgatcggtcggttaggttacttacgtttcgccttccgtacggttaaccaaacgaacccaaccgacggacccgaccgggacccccccgtacgtacctaaacgtttaatttacgaggtactggttactaacgtttaacggcccggtacccgtaccggtacggggttccccgtagtaccgttccgtcctttcgtccgtcggtccgttacccgtacgtccgtagggaccctaaacctccgtacccgtcccgttacccgtaccgtaacccgtaaccgttccgttccgggtaccgggtacccgttcccggtaaccggttaccggtacggtaaccggtaccggttacggggtaaccgggtttacgttaacgttttaaccgtttaacgggtttcgtaaccgtttcggtccctttaaccgtttcgttttaaccgggccgtaacccgggttacccgaacccccggttcgtaaccgggttcggtttggtaacccggtttttcgggaacccggggggtaccggtaacccgggtaacccggtaccgggttaccggttaacccggtaccccggttaccgggttaacgtcccggttaacgggtcccgttaacccgggtaccccggg

SEQ ID NO: 93688 - DNA, 579 bp, Homo sapiens
  misc_feature: GYAE6OF01ETZV7.29.85.H08.1.454.CMB.1.raw
  modified_base (295)..(295): a, c, t, g, unknown or other
  misc_feature (295)..(295): n is a, c, g, or t
  modified_base (358)..(358): a, c, t, g, unknown or other
  misc_feature (358)..(358): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatcctcctgccactggaaccagcagcgatgtcggtgttataacttgtctctgtaccaacaacaccagcgacgccccgatcattaatttangatgtctattaagcgtcctcgacgggtcctgatcgcttctctggctcagtctgacaacactcnccctcctcgaccattacctcgtcgggccttccgacggtcctaggaacgacgttggaaccggtgtaactttattacgtgtccttgtcttcgtaagtttcgaccgtacggtcccacccgctacgtggtacgtacgtccggtttcgggaccgggtaagggaacccgtacggccgttacggtaaccccgttacgtacgggtaccacgtccgtaccggtaaccggg

SEQ ID NO: 93689 - DNA, 615 bp, Homo sapiens
  misc_feature: GYAE6OF01B7SEN.29.85.H08.1.454.CMB.1.raw
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcgtgttatactttgtctctgtaccaacacaccaggcgacgcccccgactcattaattatgatgtacattaacgccggtccctcgacgggtccctgactcgtcttctcgtcggctcgaacgtcgtggacaactaccgtcgcccctaccctcgaccctactccgttccgtcgggcccttcccgacggtccgtacggaacgtacgtggtaaccggttgtaactttaagttactgtacctggtccttacttacgtttcggaccgtacggccctaccccgtactacgttcgtacgtacgtccgtttacggggaccggggaacggtaccgaacggtccgtaccggacccgttaccgtacgggtctacggtccgtaccggtaaccggg

SEQ ID NO: 93690 - DNA, 563 bp, Homo sapiens
  misc_feature: GYAE6OF01DRU5Y.29.85.H08.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (297)..(297): a, c, t, g, unknown or other
  misc_feature (297)..(297): n is a, c, g, or t
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
  modified_base (392)..(392): a, c, t, g, unknown or other
  misc_feature (392)..(392): n is a, c, g, or t
  modified_base (408)..(408): a, c, t, g, unknown or other
  misc_feature (408)..(408): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacngtcagtcaccatctcctgcactggaaccngcagcgatgtcggtggttatacttgtctctagtaccaacaacaccaggcgacggcccccatcattaattangatgtcattaacgcgtccctcgacgggtccctgactcgtcttctctgcctacagtctgacaacncgtcncctcctgacctatctcgtcggctcgngctgacgatcgaggtntatttattacgtctacgttgccttactagtttcgaccgacggccctacccgctaaccgttgttacgacgttcccggttacggggccgggtaacgggtaaccctacggccgttacggaccccggttccgtacgtccgacgtccgtacgtaaccggg

SEQ ID NO: 93691 - DNA, 804 bp, Homo sapiens
  misc_feature: GYAE6OF01E02CA.29.85.H08.1.454.CMB.1.raw
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccggtctcctggacagtcagtcacatctcctgcactacggaaccagcagcgtatcggtacggttaggttaattaacttttcgtccttccgtaggtaacccaaacctaaaccaacccgacgggaccggaaccccgggacccccccgtaacttaccgaaacttttaaattttacgtacgtaacttagttacctaaagtttaaacggcccgggtaccccttacggaaccgggggtttcccttaggacgttccggttcctttcgttaccgtcggtcctaaccgtaacgttccgtacggaccctaaaccgtaccgttccgccctttacccctacgtaaccctacgttcccgttcggtcgggtcctacccgaggtccgttagaaccgtgtagggtaaccggttagttaacttttacgttactcgccttcggtccttacgttacgtttcggaaccgtaccgggtaccctaacccgaccgttaacgtgggttacctaaccggtttccgggttaaccggggaccgggtaaaccggggttaaccccaaaggttccccgggttaacggtaacccccccggtttcggttaaacggggacccttaacgggttaccccgtaaacggttaaccccgggg

SEQ ID NO: 93692 - DNA, 583 bp, Homo sapiens
  misc_feature: GYAE6OF01BABFA.29.85.H08.1.454.CMB.1.raw
  modified_base (234)..(234): a, c, t, g, unknown or other
  misc_feature (234)..(234): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcgagggcacgaggtattccctgggctctagttctgccctgactcagcctcgctcagtgtccggtctccgtggacagtcagtcacgatcctcctgcactcggaaccngcagctatggtcgtgttatacttgtctctgtaccaacacaccagcgacgccccancatattangatgtntatacgcgtcctcgacggtcctgatcgtcttctcgtcgctcaagtcgtcggacaacgtcgtcgccctcctacgacctacgtcctacgtcgggactccgaggctacggactagtggacgttgtacttagtacgtcgcgtcgtcctagtacgttcgacgtacggtaccaccgctacggttcgtaggtaacgtccggttaccgggacgggtaacgggtaccgaaacggtccgtaaccgtacccggttaccgacggttacccgacgtccgtaccggtaaaccgg

SEQ ID NO: 93693 - DNA, 617 bp, Homo sapiens
  misc_feature: GYAE6OF01EERNS.29.85.H08.1.454.CMB.1.raw
  modified_base (231)..(231): a, c, t, g, unknown or other
  misc_feature (231)..(231): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacagtcagtcacctatcctcctgcacgtcggaaccngcagcgatggtcgtgttatactttgtctcgtcgtaccaacaccaccgacggcgaccgccccgatcattaattagtgatgtactagtacgccgtccgtcgacgggtcctgacgtccgtcttcgtcgtggtcctactaggtctacggacctactcgtcgaccctccacgacctctccgtcgtcggtcctcgacggtctcggtacgtacgtgggtaacgtgttaactttacgttacgtcgtctcgtctacgttacgttagaccgaccgtcccgtacccgcgtacgttcgtgttaccgtccgggttacggggacgggtaacgggaccgtaacggcccggtacggtacccgttacggttacgggaccgtacggtccgtacggtaacccggg

SEQ ID NO: 93694 - DNA, 807 bp, Homo sapiens
  misc_feature: GYAE6OF01BWUXL.29.85.H08.1.454.CMB.1.raw
  modified_base (235)..(235): a, c, t, g, unknown or other
  misc_feature (235)..(235): n is a, c, g, or t
  modified_base (343)..(343): a, c, t, g, unknown or other
  misc_feature (343)..(343): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacaggactccgtgggctcagtctcgccctgactcagcctcgctcaggtcgtccggtctccgtggacagtcagtccactatctctgccacgtacggaaaccngcaggcgtagttcggtcggttagttaacttaacgtttcgtccttacgtacggtaaaccaaacaaccaccgaggccgaccggacccccgatacgtaacttaatttacgngtaattcgtactaacgttaacggcccggtacccgttacggtacggggttaccctaggtaccgttccggtacctttcgcgttcggtaccttacggtaacgttccgtaacggtaacctaaaccgtaccgttcccgtaccccgttacccgtaacgtaacccgtcctttccggtaccgggttccgggtacccttacccggacgggtcgtaacggtaacggtacgtacgggtaacggttagttaacgtttaacgttcgtaggttccttacggttacctttacgttaccggtttacggaaccggtaccgggtaaccctaccccggtacttaccgggtacggttaccgttaccgggttacccgggtaccgggggaccggtaaacccggggaccctaacgggtcccggttacccggtaacccggttaccggtacggtaaccggtaccgtaacccgttaccggtaaccccggg

SEQ ID NO: 93695 - DNA, 606 bp, Homo sapiens
  misc_feature: GYAE6OF01D2ZDB.29.85.H08.1.454.CMB.1.raw
  modified_base (224)..(224): a, c, t, g, unknown or other
  misc_feature (224)..(224): n is a, c, g, or t
  modified_base (292)..(292): a, c, t, g, unknown or other
  misc_feature (292)..(292): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
tcagatagagtactcacgaccggtgctcgatttagtatcactcagtcgcgggggggtctcaggaggcagcactctcgggacgtctccaccatggcctggctctgctcctcctcagcctcctcactcagggcacaggactcctggctcagtctgccctgactcagcctcgctcagtcgtccggtctccgtggacagtcacgtcaccatctcctgcactggaaccngcagcgatgtcggtgttatacttcgtctctgtaccaacacaccagcgacggccccatcattaattatnatgtctattaagccgcctcgacgggtccngtacncgtctctcgtcgctccagtcncgtacaactcgtcgccctccgtgaccctacttcctcgtcggtacctcgacgtctacggaacgtagtcggaccgtttgtaactttacgttacgtcgttcgtacgtccttacgtcgtttcggaccgttaccggaccctacccgccttacgtccgtacgttacgttcccggtacggggccgggtaaacggaccccgtaacgggtcccgttaccggtacccggttccggtaccggtacgtacccggtcctacggtaacccggg

SEQ ID NO: 93696 - DNA, 896 bp, Homo sapiens
  misc_feature: GYAE6OF01D22YO.29.85.H08.1.454.CMB.1.raw
  modified_base (196)..(196): a, c, t, g, unknown or other
  misc_feature (196)..(196): n is a, c, g, or t
  modified_base (226)..(226): a, c, t, g, unknown or other
  misc_feature (226)..(226): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctcgccctgactcagcctcgctcagtcgtccgggtctctggacngtcagtcaccatcctcctgcacgtgaaccngcagcgtagtcggtcggttaggttaacttaactttcgtcttaccgttacggtaacccaactaaaccgacccgacggtacccgaacccggccccccgtaactacctaacgttaaactttacagtaacttcgtactaacgttaacggcccgtaccccgtacggtaccggggtcctacggtacgtccgttctttcgtccgtcgtcctaccgtaacggtctacggacctaaccgtaaccgtccgtaccccgttaccctaccggtaacccttacttcccgttccgggttccgggtacccgttaccccggtaacgggtccgttaacggtaaaccggtacggtttacggggtaaaccgggtttacgtttaaagtttaacccgtttaacgtttccggtacccgtttacggttacccctttaacgtttacccggttttaccggggacccgttaaaccgggacccccgttaacccccggacgttaccggtttaccgggtttaaccgtacccggttttccccggggttaacccgggggggaacccggggttaaacccggggtaaaaccccgtaccggggttaccccggttaaaccccggggttaacccccggttacccggttttaaaccggggacccctttaaccgggttaccccgtttaaacgggtaaaccccccggggg

SEQ ID NO: 93697 - DNA, 503 bp, Homo sapiens
  misc_feature: GYAE6OF01B1NO9.29.85.H08.1.454.CMB.1.raw
  modified_base (307)..(307): a, c, t, g, unknown or other
  misc_feature (307)..(307): n is a, c, g, or t
  modified_base (460)..(460): a, c, t, g, unknown or other
  misc_feature (460)..(460): n is a, c, g, or t
  modified_base (482)..(482): a, c, t, g, unknown or other
  misc_feature (482)..(482): n is a, c, g, or t
  modified_base (488)..(488): a, c, t, g, unknown or other
  misc_feature (488)..(488): n is a, c, g, or t
  modified_base (492)..(503): a, c, t, g, unknown or other
  misc_feature (492)..(503): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataacttttgtctcctggtaccaacaacacccaggcgaggccccccgactcataatttatgatgtcattaagcggccctcaggggtccctgatcgcttctctggctccaagtctggcaacactgccctccctgaccatctctggggcctccgaggctgacgtatgacggtnatttattactgctgctctatttgcacggccacccgcactgtgactcgttcggcgggtagggaccagctcgaccgtccgtaggtcagctacgaacgctccgccccgtcggtccaccttcgtccgttccccgccctcctcacgttactctatcgngtacgcggtctgacgacggcgnagtcgngtcnnnnnnnnnnnn

SEQ ID NO: 93698 - DNA, 597 bp, Homo sapiens
  misc_feature: GYAE6OF01CQQ7D.29.85.H08.1.454.CMB.1.raw
  modified_base (221)..(221): a, c, t, g, unknown or other
  misc_feature (221)..(221): n is a, c, g, or t
  modified_base (289)..(289): a, c, t, g, unknown or other
  misc_feature (289)..(289): n is a, c, g, or t
tcagatagagtactcacgaccggtgctcgatttagtatcactcagtcgcggggggggtctcaggaggcagcactctcgggacgtctccaccatggcctggctctgctcctcctcagcctcctcactcagggcacaggatcctgggctcagtctgccctgactcagcctgctcagtgtccggtctcctggacagtcagtcaccatctcctgcactggaaccngcagcgatggtcggtgttataactttgtctctgtaccaacaacaccagcgacgccccgatcatattangatgtcattaacgccggccctcgtacgggtccctgactcgcttctcgtcggctccgtaagtctcggcaacactcgccctcctcgaccactcctcgtcggcctccgaaggtctacggacgtagtaggtacgggttagtagtttacttacgtcgtacttcggctttacgtagtttcgaccgtaccggaccctaacccggtctaaccgttgtacgtaccgttccggttacgggccgggtaacggggaaccctaacggcccgttacggaccccggttccgtaacgggtcctaaccgtccgtaacgtaccggg

SEQ ID NO: 93699 - DNA, 521 bp, Homo sapiens
  misc_feature: GYAE6OF01DAQ0Y.29.85.H08.1.454.CMB.1.raw
  modified_base (194)..(194): a, c, t, g, unknown or other
  misc_feature (194)..(194): n is a, c, g, or t
  modified_base (287)..(287): a, c, t, g, unknown or other
  misc_feature (287)..(287): n is a, c, g, or t
  modified_base (498)..(498): a, c, t, g, unknown or other
  misc_feature (498)..(498): n is a, c, g, or t
  modified_base (506)..(506): a, c, t, g, unknown or other
  misc_feature (506)..(506): n is a, c, g, or t
  modified_base (509)..(521): a, c, t, g, unknown or other
  misc_feature (509)..(521): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttangatgtcattaagcggccctcgaggggtccctgatcgcttctctggctcagtctggcacactgcctcctgaccatctctggcctcagctgacgntgacggtgattatactgctgctcatttgactaggccacccgcactgtacgactcgttcgggcgggacgggaccaagcctcggaccgtcgtacggtcacgctacgaacggcctccgcccccgttcggtccctaccgttccgttccctccccgtccccttcccgttactacgtaccttctactcgtcggacgcgggtcttcggcgtacgggcnccgagtgncgnnnnnnnnnnnnn

SEQ ID NO: 93700 - DNA, 662 bp, Homo sapiens
  misc_feature: GYAE6OF01BOU7O.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcgtggtacaggccgtggggggtccctggacgactctcgtgtgcacgtcctcgtggtattactaagtttaatgtactttttaccatactacgtcgggtccgtacgaacgtccgtaccggggtaagggtcgtgggtacggtgggtctcgttcttaattaagtcggagtacggtgactaactacgtattctatcgtacagtactcgtggtaggaacgggtccgtaacttccaacctactcctaccgaagtaacaacaaaccaaactaacgtccctacctagtactctacgactaaactacgtaactagtcgtaggaacgtaaggtacgacgaacgaggtaccggtactttactaagtttagttcggtaacgaacgaaaaggtgaaacggtacgaagggttaccttaacggttaagggttcgggttaccgttggtttaaacccggg

SEQ ID NO: 93701 - DNA, 648 bp, Homo sapiens
  misc_feature: GYAE6OF01CCKMY.29.85.H08.1.454.CMB.1.raw
  modified_base (256)..(256): a, c, t, g, unknown or other
  misc_feature (256)..(256): n is a, c, g, or t
  modified_base (334)..(334): a, c, t, g, unknown or other
  misc_feature (334)..(334): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttatgatgtcattaagcggccctcgaggggtccctgatcgcttctctggctccaagtctggcaacnctgcctcctgaccatctctgggctccgaggctgacgatgacggtgatttatactgctgctctattgcaggccacccgnacgtgtgatcgttcgggacggtagggaccaagtctacggtacccgtccgtaggtcacgtccgtacgtaacggtcctaccgtccccccgttcgggtaccctaccgtttcccgttacccggtttcccccctaccccgttccccgttaccgtaaccggtttaacccttaccgtttaacgtttacccggttacgggtaaccgggtcccggggtaccgttaccgggaaccggtaaccggggaccggtacccgtaacgggttaaccgggaccgtacgtacgtacgtcgacgtacgtacgtcgtacgagacgtcgtcgtcg

SEQ ID NO: 93702 - DNA, 720 bp, Homo sapiens
  misc_feature: GYAE6OF01DV8HD.29.85.H08.1.454.CMB.1.raw
  modified_base (192)..(192): a, c, t, g, unknown or other
  misc_feature (192)..(192): n is a, c, g, or t
  modified_base (261)..(261): a, c, t, g, unknown or other
  misc_feature (261)..(261): n is a, c, g, or t
  modified_base (699)..(699): a, c, t, g, unknown or other
  misc_feature (699)..(699): n is a, c, g, or t
  modified_base (704)..(704): a, c, t, g, unknown or other
  misc_feature (704)..(704): n is a, c, g, or t
  modified_base (706)..(707): a, c, t, g, unknown or other
  misc_feature (706)..(707): n is a, c, g, or t
  modified_base (711)..(711): a, c, t, g, unknown or other
  misc_feature (711)..(711): n is a, c, g, or t
  modified_base (713)..(714): a, c, t, g, unknown or other
  misc_feature (713)..(714): n is a, c, g, or t
  modified_base (716)..(716): a, c, t, g, unknown or other
  misc_feature (716)..(716): n is a, c, g, or t
  modified_base (718)..(718): a, c, t, g, unknown or other
  misc_feature (718)..(718): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctctggtaccaacaacaccaggcgacggccccccgatcataatttngatgtcattaacgccggcctcgacgggtccctgatcgtcttcgtctggcctccgaagtctggaccaacnctcgccctccgtagacctatcctcgtcgggtcctccgacggctggaaccgtagtcggtacggttgtaattttacgttacgtcgtcgtgtccttacgtacgttttcggaccgtaacggcccgtacccgtacgtacgtaggttacgtacgttccggttaccggggaccgggtaaccgggtaaccgtaacggtccggttaccggtacccggttacccgtacgggtaccgaacggttacccgtacgtaaccgggtcccgttaccccggtcccccgttacgggtaccccttaaccgtttccccgttacccccgttacccccttaccccgtttacccgttacccgttaccgttacccttaccgttaccgttcggtaaccgggtaccggggtccgggttaccggtaccgggaacgggtaaccggtccgaacgttacgaggtccgngagcncnngctncnncngngc

SEQ ID NO: 93703 - DNA, 596 bp, Homo sapiens
  misc_feature: GYAE6OF01ASU76.29.85.H08.1.454.CMB.1.raw
  modified_base (505)..(505): a, c, t, g, unknown or other
  misc_feature (505)..(505): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcttgggttttccttgttgctattttaaaaggtgtccagtgtgaagtgcagctggtggagtcgtgggggagtcgtggtacaggccgtggggggtccctgagactctcctgtgcagcctctggattcaagtttaatgtatttttccatacacgtgggtccgtcaagcgtaccggggaaggtctgggagtgggtctctcttattaatcgagacggtgctactactattctatgcagtactgtggtagaagggcctattccactatcctacagagaaccaacaaactaacgtacctcccttagtactacgtagacctaaatgaaactgtactaggagtaaggtgaacgacgaggccgtntttacgtatttagttggtacgaacgtaaaagggagaaacgggtacgaaggtaacgttacgttaagggtcggggttcggttcggtttaacgg

SEQ ID NO: 93704 - DNA, 866 bp, Homo sapiens
  misc_feature: GYAE6OF01A1UL5.29.85.H08.1.454.CMB.1.raw
tcagatagagtactcacgaccggtgctcgatttagtatcactcagtcggcggggggggtctcaggaggcagcactctcgggacgtctccaccatggcctgggctctgctcctcctcacgcctcctcactcagggcacaggatccgtgggctcagtctcgccctgacctcagcctcgctcgaggtcggtccgggtctccgtaggacagtcacgtccacctatcctcctgaccacgtacggaaccagcaggcgtagtcggttacggttaggttaacttacgtttcgtcctccgtacggtaaacccaaaccgaacccgaccccggacgggcccggaccccggtacccccccgtaacttaacctaattaactttactacggtacgttacgttactaacgtttaaccgggcccggtcccgttaccgggtaccggggttccctaggttaccgttcccgttccgtttccgtccggttaccgggtacccttaacccgtaacggttccggttaaccgggaacctaaacccgttaccggttcccgtacccccttaccccggttacgaaccccttcgttcccggttccgggtaccggggtaccccttaccgggacgggttacccgtagggtaaccgggttacggttaccggggtaacggtttagtttaaccttttacgttacccgggtcgtaacccgttcggttacctttaaccggttacgggttacccggaacccggtacccggtaccctacccggtacgttaacggttcggtacgttaccggtccggggttaaccgggacgggtaccgtaacgtccggtacccgtaccgtaccggttacggtaccgacggtaccggtccgtaaccggtccccggg

SEQ ID NO: 93705 - DNA, 574 bp, Homo sapiens
  misc_feature: GYAE6OF01B0XX9.29.85.H08.1.454.CMB.1.raw
  modified_base (254)..(254): a, c, t, g, unknown or other
  misc_feature (254)..(254): n is a, c, g, or t
  modified_base (321)..(321): a, c, t, g, unknown or other
  misc_feature (321)..(321): n is a, c, g, or t
  modified_base (557)..(557): a, c, t, g, unknown or other
  misc_feature (557)..(557): n is a, c, g, or t
  modified_base (560)..(560): a, c, t, g, unknown or other
  misc_feature (560)..(560): n is a, c, g, or t
  modified_base (564)..(566): a, c, t, g, unknown or other
  misc_feature (564)..(566): n is a, c, g, or t
  modified_base (568)..(574): a, c, t, g, unknown or other
  misc_feature (568)..(574): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctcagtctggcaacnctgcctccctgaccatctctgggcctccgaggctggacgatggacggtgattattaccgtgctgctntagtttgcgtacggccacccgcacgtgtcgtactccgttcgggcggacgggaccaaggccgtacggtacccgttccgtacgggtcctacggaccttcgaacggccgtaccggtcccccgttacggttcctaccgttccgtccggtttcccccgtccccttccctcgtaaccgttacttcctacgttccgtaggtacggccgggtcgtacgggaccgtaagggccgtacacgtagcngancgcnnncnnnnnnn

SEQ ID NO: 93706 - DNA, 870 bp, Homo sapiens
  misc_feature: GYAE6OF01EVVTP.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcttgggttttccttgttgtcttaattttaaaaggtgtccagtgtgaagtgcagctggtggagtcgtgggggagtcggtggtacaggccgtgggggtccctggacgtactcgtccgtgtgcgagccctcgtggattcgtaagtttaatgttatttttccattacacgtcgggtaccgcgaacgtccggtaccggggaagggttccgtagggtaggttcgggttccttcgtttactttaacgtttaaacgtccgggtaacggtaccgggttagtaccgttaaccttaacgttactttactacgttcggacgtaagttaacccttcgttagggttaacggaaaccggggacccgttaacgtttcccgaaacccgttaaccgttccccttaaccccggtaaaggtaaaccgtaaaacccgtaaacgtaaaacccgttaaaccggttaaccccttaccccgtttaaaggttacctttacccgtacggtaaaccttaaaacgttacgaaaccgttacggttaaccggtaacgggtaaacggtaaaacgggttcgggaaacccgtaacggtaccgggtaccgggttacccttttacgtttaaacgtttagtttacgggtacgtaaaacggtaaaaacggtaagggtaacgggaaacgttaacgggtaaaccgtttacgggttaaaagggtttccgggggttaacccgggttccggttttaaaccggg

SEQ ID NO: 93707 - DNA, 554 bp, Homo sapiens
  misc_feature: GYAE6OF01CZ6R5.29.85.H08.1.454.CMB.1.raw
  modified_base (151)..(151): a, c, t, g, unknown or other
  misc_feature (151)..(151): n is a, c, g, or t
  modified_base (216)..(216): a, c, t, g, unknown or other
  misc_feature (216)..(216): n is a, c, g, or t
  modified_base (241)..(241): a, c, t, g, unknown or other
  misc_feature (241)..(241): n is a, c, g, or t
  modified_base (315)..(315): a, c, t, g, unknown or other
  misc_feature (315)..(315): n is a, c, g, or t
  modified_base (519)..(519): a, c, t, g, unknown or other
  misc_feature (519)..(519): n is a, c, g, or t
  modified_base (521)..(525): a, c, t, g, unknown or other
  misc_feature (521)..(525): n is a, c, g, or t
  modified_base (527)..(527): a, c, t, g, unknown or other
  misc_feature (527)..(527): n is a, c, g, or t
  modified_base (529)..(554): a, c, t, g, unknown or other
  misc_feature (529)..(554): n is a, c, g, or t
tcagatagagtactcacgaccggtgctcgatttagtatcactcagtcagtcaccatctcctgcactggaaccagcagcgatgtcggtggttataactttgtctcctggtaccaacaacacccagggcgacggccccccgatcataatttangatgtcattaagcggccctcaggggtccctgatcgcttctctggcctccaaagtctggacaaacncgtcgccctcctgaccctatctcgngggcctccaggctgacgatggacggtagattatactgactgctctatttgcgaacggcccacccgcacgtggtnacgttcgttcgggcgggaacgggaacaacgcgtacgacccgtcgtacggtcacgctacgaaggtcctccgacccccgtcggtacctacgtcccgttccgtcccccgtcccctcccgtacgtaacggttaccttaccgtaactcggtaacgggtacggccggggtacgtacggggaccgtaagggccgtaccgtaagtaacgcgngnnnnngngnnnnnnnnnnnnnnnnnnnnnnnnnn

SEQ ID NO: 93708 - DNA, 571 bp, Homo sapiens
  misc_feature: GYAE6OF01DIENU.29.85.H08.1.454.CMB.1.raw
  modified_base (300)..(300): a, c, t, g, unknown or other
  misc_feature (300)..(300): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatggtcggtggttataactttgtctcctggtaccaacacaccaggccgacgcccccgactcaatatttangatgtacattaacgcggtccctcgacgggtccctgatcgcttctcgtcgctaccgagtctgcaacactcgtccctccgtcgacctactcctcgtcggcctccgacggctacggacgtagtacggtacggttgtaatttagttacgtcgtcttcgtacttctactttcgacgacggcctacccgcacgttggtcgtagttccggtcgggacgggtaggacccgtaaggccgtacggtacccgttccgtacggtcacggtctacggtaaccgg

SEQ ID NO: 93709 - DNA, 542 bp, Homo sapiens
  misc_feature: GYAE6OF01DC397.29.85.H08.1.454.CMB.1.raw
  modified_base (289)..(289): a, c, t, g, unknown or other
  misc_feature (289)..(289): n is a, c, g, or t
  modified_base (354)..(354): a, c, t, g, unknown or other
  misc_feature (354)..(354): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatggtcggtgttatacttgtctcctgtaccaacacaccagcgacgccccgatcatattngatgtcattaacgcgtcctcgagggtccctgactcgtcttctcgtcgctcaagtctggactaacnctcgccctcctcgacctactcttcgtcggcctccgaggctaggtacgacgtaggtaccggtataactttacgttactacgtcttgtcttactagtttcgcgacggccctaccgctacgtgtcgtacttcgtacgggcggacggaccaacggtctacgtaccgtccgtaagtcacgtcgtccgtaacgg

SEQ ID NO: 93710 - DNA, 730 bp, Homo sapiens
  misc_feature: GYAE6OF01AZEUJ.29.85.H08.1.454.CMB.1.raw
tcagatagagtactcacgaccggtgctcgatttagtatcactcagtcgtgcccgtgactcacgcctcgctcagtgtccgggtctcctggacagtcagtcaccatctcctgcactggaaccagcgagtcggatgtcggtgttagtaacttttgtctcctggtacctaacaacgtacccaggcgaggcccccccgagtcataactttatgattgtcgaagttaagccggtccctcgaggggttccctgtactcgcttctctggctccagtctggcacactcgcctcctgacctatcgtcgtcggtctccgaggtctcgaccgtagtcgaaccggtgaactttacgttaccgtggaccgttgggtccttaccgttaagtttttcggaccgaacgggtaccctaaccccgggtctaaccggttgggttacgtaacgttttccgggttacggggacgggaacgggtacccaaggtccgttacggtaccccggttaccgtaggggtacctacggtaccttaccggaagttcccgtccggtacccccgttacggtaccctaaccgttccgttacccgttacccccgtcccctttaccgttactaccggtttacctaccgttaacgttccggtacgtaaccgggcggtaccgtcgggaaccgtaacgggtccgtacgtaacgttaaggccttggattacgccttaagtcgacgtacggacgttagggacctggtcacg

SEQ ID NO: 93711 - DNA, 780 bp, Homo sapiens
  misc_feature: GYAE6OF01DB7Q3.29.85.H08.1.454.CMB.1.raw
tcagatagagtactcacgaccggtgctcgatttagtatcactcagtcgcggggggggtctcaggaggcagcactctcgggacgtctccaccatggcctgggctctgctcctcctcagcctcctcactcgagggcacgaggatccgtgggctcgagtctcgccctgactcacgcctcgctcgagtcggtccggtctccgtggacagtcacgtcacctactcctcgtgctacgtacggaacagacgacgcgattcggttacggtaggttaacttaactttcgtccgttacctacggtaaccaacaacccgaccgacggccgaaccgggaccccccgtaacgttacctaagtttaactttacgtacgtaacgttacgttaacgtaacgttaacgcccgggttaccccgtacggtacccggggttcccgtacggtaccgttccgttccgttaccgttcgttcgggtccctttaaccggtaacggttaccgtacgggtacctaaaccgtaccgttacgtaccccgttacccgtacgtaacccttacgtccgttaccggtcggtacccgttaccggaacggttcgtacgggtacgacggttcggtaaccgtaagttacgtttacctaacgttcgtccgttacgtccgtttacttacgtttccgggacctaccgggtacccacccgtacgtacggtgtccggttacgttccgggtacgggccgggtagtaccgaggtcccggttacgtaccggtccggttaacgccgtacgtccgtacgtacccggg

SEQ ID NO: 93712 - DNA, 670 bp, Homo sapiens
  misc_feature: GYAE6OF01C1MU9.29.85.H08.1.454.CMB.1.raw
  modified_base (229)..(229): a, c, t, g, unknown or other
  misc_feature (229)..(229): n is a, c, g, or t
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
tcagatagagtactcacgaccggtgctcgatttagtatcactcagtcgcggggggggtctcaggaggcagcactctcgggacgtctccaccatggcctggctctgctcctcctcagcctcctcactcagggcacaggatccgtgggctcagtctgccctgactcagcctcgctcagtgtccgggtctccgtggacagtcagtcaccatcctctgactacgtaggaaccngacagcgagtggtcggtagttataacgttgtctcctagtaccaacacaccaggcgacggccccgactcaataattanagatntactataacgccgtacctcgacgggtcctgtactcgtacttctacgtcggtcctacgtaagtccgtacggacctaacgaccttcgccccttacccgttacgaaccctactccgttaccggtcgggtaccctacccgtacgggctaccgtacgacggttaaccggacggttagtaactttaccgttacgccgttcttacggtcccttaggttacgtttacggcgtaccggtacccgacccgtacgtaccgttcgtacgtaaccgttcggttaccgggaccgggtaacgggtaaccggtaacggtccgttaccggaacccggttaccggttaacgccgaacggtcccgtcggtaacccggg

SEQ ID NO: 93713 - DNA, 781 bp, Homo sapiens
  misc_feature: GYAE6OF01DW20Y.29.85.H08.1.454.CMB.1.raw
  modified_base (260)..(260): a, c, t, g, unknown or other
  misc_feature (260)..(260): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcttgggttttccttgttgctattttaaaaggtgtccagtgtgaagtgcagcgtggtggagtcgtgggggagtcggtggtacaggccgtgggggtccctgagactctctgngcagcctcgtggattactaagtttaatgttacttttccaatacctacgttcgggtcctacgaacggtccggtaccggggggtaagggttccgtaggggtacggttcggggttccttcgttacgtttaatttaacgtcggtaacggtaccgggttgtacctttaacgtacttagtttaccgtattcggactaacgtacgttcgttaggtaacgggaaacgggtcccgtaactttacccaaccctacgttaccctaccgaaaggtaaaccgaaccaaaaaccaaaccgttaaaccggttacccttaccccgttagtttaacctccgtaacggaaactaaacgttacgaaacgtacgttacgtaaggaacgtaacggtacggaaccgtaacgtaacggtcccggttactttaacgttaacttttaacggttacggtaacgaaaacggtaaaaggaacgggaaacgggtcgaaaggttacgttaacgggttaagggttccggggttacgtcgggttttaaaccgg

SEQ ID NO: 93714 - DNA, 717 bp, Homo sapiens
  misc_feature: GYAE6OF01DVDJJ.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagtcgttgggtttttcctttgttgtcttaagtttttaaaaggtgtcctagtgtgaagtgcagctggtggagtcggtggggagtcgtgtacgaggccgtgggggtccctgacgacctctcctgtcgcagcccttcgtggtattacgtaagttttaatgttactttttccatacctacgtggtcccgtcgaacggtccggtccgggggaaggttcgtggtaggttcgggtcttcttactttaattaacgtcgagacggtgtctactactattcgtatgcagtactctggtacggaacggtccgtattccacctactcctaccgaagtacgaaacaactaaacgaacgttaccctccgttaacgtactacgtagtaaacctaaagtactaaacgtgttacgtaaggaacgtaacggtacggaaccgaagtacccgggtaccgtttactttaactttaacgttttagttacgggtaacgaaaacggtaaaaagggtacgaaacggggtacgaaagggttaacgttacggttaaaggggttttcggggtaacccgtttggtttaaaacccgggg

SEQ ID NO: 93715 - DNA, 845 bp, Homo sapiens
  misc_feature: GYAE6OF01D9W4M.29.85.H08.1.454.CMB.1.raw
tcagatagagtactcacgaccggtgctcgatttagtatcactcagtcggcggggggggtctcaggaggcagcactctcgggacgtctccaccatggcctgggctctgctcctcctcagcctcctcactcgagggcacaggactccgtgggctcagtctcgccctgactcacgcctcgctcgaggtcggtccgggtctccgtgggacaggtcacgtccacctattcctccgtgcctacgtacgggaaacccaggccaggaccgtagtcgggttacggtttagggttaacttaaccgttttcggtccttccgtacgggtaaccctaaacgaacccgaacccgacgggccggaaccccgggtaccccccgaacttaccgtaactttaaacgttttacgtacggtacttcggtactaacgtttaaccggcccgggtacccgttccggtaaccgggggttcccctaggaaccgttccggtcctttccgttaccggttccggtacccgttacccgtaacggtttccggtacgggtaacccaaccggtaccttccgtaccccttccccgtaggtaacccctacgtttcccgtccggtaccgggtacccttacccggacgggttccgtacggtaccgtaggttaccggtaacggttcgttaatttaccgttactcggtcttacggtctacctttcgttacgtaccgccggtactaccccgagttaccgtcgtacggttaccgttccgggttaccggggaaccgggttaacgggaacccgttaccgggtacccggtaccggtaccccgggttacgtaccgggtaccgtacggttcccgtaacgggtaccccggg

SEQ ID NO: 93716 - DNA, 580 bp, Homo sapiens
  misc_feature: GYAE6OF01CECON.29.85.H08.1.454.CMB.1.raw
  modified_base (244)..(244): a, c, t, g, unknown or other
  misc_feature (244)..(244): n is a, c, g, or t
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
tcagatagagtactcacgaccggtgctcgatttagtatcactcagtcgcggggggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcgccatcctcctgcactggaaccagcagtgatgttgagaattangactgtctccttgtaccaacaaccaccagacacacgtccaacaaacacatgatanacaatntcaatacncgccctcgacgggtcctgattcgttctcgtcggctcaagtctggcaagtcgccgcctcatcgaccatcctcgtcggactccgagcgtggaggacgaggtctggtaatttagttagtcgtacttgtacttactaagttaataagttaacgtacgtagttcgtacgtaacggtttaaagggggtcgttacgggacgggtagggaaccgtaaggccgttcggtacccggttccgtacggggtaccacggtaccccggtaaggtcccccgg

SEQ ID NO: 93717 - DNA, 768 bp, Homo sapiens
  misc_feature: GYAE6OF01ETVHE.29.85.H08.1.454.CMB.1.raw
  modified_base (222)..(222): a, c, t, g, unknown or other
  misc_feature (222)..(222): n is a, c, g, or t
tcagatagagtactcacgaccggtgctcgatttagtatcactcagtcgcgggggggtctcaggaggcagcgctctggggacgtctccaccatggcctggctctgctcctcctcacctcctcactcagggcacaggctcgttgggcccagtctgccctgattcagcctccctcgtgtccggtctctggacagtcagtcgccatcctcctgcacgtcggaaccngcagtgattgttagaagtaattagtcgtacttcgttcccttcccgttacggtaacccaaacaaccaccaagacacacgtaccaacaaacacatagtaatactaactaatgtactaataccgtccggtaccctacgggtacgggtccctagtacgtttccgtttactccgttacggtcctaccgtaaacgtcgtacggacctaacgtcggacccgtacccttaccgtagttaccgtaaccctagttcccgtacgttacggtacccctaccggacggttccggtaagggaaccgggtacggtaacggtccgtttaggttaacgttttacggtttacggtcgtctcgttaccttataacgtttaagttaacgttacggtacgttaagggttccgttaaccggtttaaaccggggtttaacggggtccgggtttaaccggggacggggtaaaccgggtaaccgtaaacgggtcccggttacccgggtaacccggttacccgggttacgggtaaccgaaccccgggttaccccggtaacggtccccccggg

SEQ ID NO: 93718 - DNA, 695 bp, Homo sapiens
  misc_feature: GYAE6OF01DZKIP.29.85.H08.1.454.CMB.1.raw
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggactccgtgggctcagtctgccctgactcagcctcgctcagtcgtccggtctcctggacagtcagtcaccatcctcctgcactcggaaccngcagcgatggtcggtgttataactttgtctcctgtaccaacaacaccaggcgacggcccccgatcaattaattangtatgtcattaacgcgccctacgacgggtccctgactcgcttctcgtcggtcctacgaacgttctacggtacaaaccgtaccgttcggacccctttaccccgtaggacccctaacgttcccgttaccgtccggggtacccttcccggtaacggtcccgttaggaaccggtacgtttacgggtaaccgggttacgttaaactttaccgttaccgttggtaccttcgtaccgtttccgttaaggttttcccgggaacccgtacgggacccctaccccggtacgtaccgttcggttacgtaccgttccgggttaccgggaccggggtaaccggaccgtacggcccgttacggaccccggttcttaacgggccaaccggtccgacggtaacccggg

SEQ ID NO: 93719 - DNA, 749 bp, Homo sapiens
  misc_feature: GYAE6OF01CJ3FL.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcttgggttttccttgttgcttattttaaaaggtgtccagtgtgaagtgcagctggtggagtcgtgggggagtcggtggtacaggccggtcggggggtccctggacgtacctcgtccgtgtcgcacgcctcgtggtattacgtaaagttttaatgttactttttccaattaccgtacgtcgggttcccgtacgaaacggtccggtaccggggggtaaggttccgtaggggtacggttcggggttccttccgtttacgtttaaagttaaacgtcggtaacggtaccgggttcgtaccttaaccgttaactaacgtttccgtaagtcggtacctaacgtaccttcgtaggtacggaacgggtcccgtaattcccgaacctacgttccctaccgaagtaacgaaaccaaacaaacgtaacgttacccttccgttagtaactcgtagtaactaaagtacgaactacgtactaggaagtaggtacgaaccgaacgtacggtccgttactttacgtaatttagttagtaacgaaacgaaaaagggtcggaaacggtacaaagggtaacttacggttaagggttcggggtccgttaggtttaccggg

SEQ ID NO: 93720 - DNA, 496 bp, Homo sapiens
  misc_feature: GYAE6OF01AZ5WV.29.85.H08.1.454.CMB.1.raw
  modified_base (481)..(482): a, c, t, g, unknown or other
  misc_feature (481)..(482): n is a, c, g, or t
  modified_base (484)..(496): a, c, t, g, unknown or other
  misc_feature (484)..(496): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggcccccccgatcataatttatgatgtcattaagcggccctcaggggtccctgatcgcttctctggctccaagtctggcaacactgcctccctgaccatctcgtgggctccaggctgacgatgacggtgattattactgctgctcatttgcaggccacccgcactgtgatcgttcgggcgggtaggaccaaggcctcgacccgtccgtaggtcacgctcgaaggctcgcccctcgtcacttccgtcgttcccaccctcctacacgtactctactcgtggacggtcggtctcggacacggcgcagtagnngnnnnnnnnnnnnn

SEQ ID NO: 93721 - DNA, 534 bp, Homo sapiens
  misc_feature: GYAE6OF01CORFV.29.85.H08.1.454.CMB.1.raw
  modified_base (197)..(197): a, c, t, g, unknown or other
  misc_feature (197)..(197): n is a, c, g, or t
  modified_base (369)..(369): a, c, t, g, unknown or other
  misc_feature (369)..(369): n is a, c, g, or t
  modified_base (412)..(412): a, c, t, g, unknown or other
  misc_feature (412)..(412): n is a, c, g, or t
  modified_base (442)..(442): a, c, t, g, unknown or other
  misc_feature (442)..(442): n is a, c, g, or t
  modified_base (522)..(522): a, c, t, g, unknown or other
  misc_feature (522)..(522): n is a, c, g, or t
  modified_base (524)..(534): a, c, t, g, unknown or other
  misc_feature (524)..(534): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtgttataactttgtctcctggtaaccaacaacacccaggccgacggcccccccatcaataatttangatgtcattaagcggccctcgaggggtccctgatcgcttctctggcctaccgaagtctaggacaacactcgccctcctagaccatctcgtcgggcctcgaggtcctagacagtgacgtagtattatacgtgtctcgtctcgtagttcgacgtacggccaacccgctactgtnacgttcgtcgggacgacggaaccagtctcggacctcgtagtcncgctacgacgcgtcccgtcccgtcgtaccnccttccgtcccgtcccctacctccctactaaccgttcttactagtcgtacgacggtccggacgtggaacgaggcacagancnnnnnnnnnnn

SEQ ID NO: 93722 - DNA, 522 bp, Homo sapiens
  misc_feature: GYAE6OF01CGRJC.29.85.H08.1.454.CMB.1.raw
  modified_base (341)..(341): a, c, t, g, unknown or other
  misc_feature (341)..(341): n is a, c, g, or t
  modified_base (442)..(442): a, c, t, g, unknown or other
  misc_feature (442)..(442): n is a, c, g, or t
  modified_base (508)..(522): a, c, t, g, unknown or other
  misc_feature (508)..(522): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttatgatgtcattaagcggccctcaggggtccctgatcgcttctctggctccaagtctggcaacactgccctcctgaccatctctgggctccaggctgacgatggacggtgatttatactgctgctctattgcacggccacccgcactgtntactcgttcgggcggtacgggaccagcctggacccgtccgtaggtcacgtctacgaacggccgtccgcccccgtcggtcctaccgttccttccgttccccncccctcctacctacgttactcttactcgtcggacggtccgggtcgtcggacgacggcgacgatagnnnnnnnnnnnnnnn

SEQ ID NO: 93723 - DNA, 574 bp, Homo sapiens
  misc_feature: GYAE6OF01ELJAX.29.85.H08.1.454.CMB.1.raw
  modified_base (299)..(299): a, c, t, g, unknown or other
  misc_feature (299)..(299): n is a, c, g, or t
  modified_base (384)..(384): a, c, t, g, unknown or other
  misc_feature (384)..(384): n is a, c, g, or t
  modified_base (414)..(414): a, c, t, g, unknown or other
  misc_feature (414)..(414): n is a, c, g, or t
tcagatagagtactcacgaccggtgctcgatttagtatcactcagtcgcggggggggtctcaggaggcagcactctcgggacgtctccaccatggcctgggctctgctcctcctcaccctcctcactcagggcacagggtcctgggcccagtctgtcctgactcagcctccctccgcgaccgggtctcctggacagtcagtcacatctcctgcactggaaccagcagtgacgttggtgttatgactatgtctctgtatcaacaacgacccgacaaacgtccccaaactcctgtatttancgacgtcgctaccgccgacctcgacgggtccctgtactcgtcttttctcggccttcgaagtctcggacaaccgacggtccctccncgaccgtctcgtcggctcgacgcgtgacgngtggaggtctagtacttattactcgtccttcctacattacgtcgcgaagacaaactacttagtttacgtacgtttcggacggaacggacgagtcgtacgtacctctacgacgtcagtccgtacgacgccgtccgccccgttaggtcctcgtccgttcccg

SEQ ID NO: 93724 - DNA, 603 bp, Homo sapiens
  misc_feature: GYAE6OF01BK1AN.29.85.H08.1.454.CMB.1.raw
  modified_base (226)..(226): a, c, t, g, unknown or other
  misc_feature (226)..(226): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgccactggaacccngcagcgatgtcggtgttatactttgtctcctgtaccaacacaccgaggcgacgcccccgatcatattngntgtcattagccgccctcgacgggtcctgactcgtcttctcgtcgctcgatctaggacaactactcgccctcccgtacgacctacttccgtcgtcgggtccctccgacggcgtacggacgtagtacggtacggtagttaacgtttaattaccgtcgtaccgttcgtaccttcttagtttcggacgtaccgggaccctaacccgtctaccgttgtacggtactccgggttccggggacggtacgggaacccgtaggtcccggtacgaccccggttcgtacgggtacaccggtccgtcggtaaccccggg

SEQ ID NO: 93725 - DNA, 634 bp, Homo sapiens
  misc_feature: GYAE6OF01CU08R.29.85.H08.1.454.CMB.1.raw
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
  modified_base (521)..(521): a, c, t, g, unknown or other
  misc_feature (521)..(521): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatccgtgggctcagtctgccctgactcacgcctcgctcagtgtccgggtctcctggacagtcagtcaccatcctctgcnctggaaccngcagctatgtcggtgttataacttgtctctcggtaccaacacaccgaggccgacggcccccgatcctaatacttatcgatgtacattaacgccggccctcggacgggtccctagactcgtccttcgtctcggacctctaacgtcttaggactaaacgctcgcctcccgtgaccactctacgtcggcctccgaggtctacgacgtagtacggtaccgggttgtaaacgtttactttaacgtcgtccgttggtacctttcttaacggttttcggccgacgggtaccctaccccggtntaaccggttcgtacgttacgttccgggttaccggggaacgggttacccgggaacgtacggtcccgttacgacccggttacccggtagtaccgaccgtcgttcccggaaaccgg

SEQ ID NO: 93726 - DNA, 587 bp, Homo sapiens
  misc_feature: GYAE6OF01A7UYM.29.85.H08.1.454.CMB.1.raw
  modified_base (227)..(227): a, c, t, g, unknown or other
  misc_feature (227)..(227): n is a, c, g, or t
  modified_base (440)..(440): a, c, t, g, unknown or other
  misc_feature (440)..(440): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatccgtgggctcagtctgccctgactcagcctcgctcagtcgtccgggtctcctggacagtcagtcacatctcctgcacgtggaaccngcagcgatggtcggtggttataacttgtctctgtaccaacacaccacgcgacgcccccgactacattattactgtatgtctaatagcgccctgacgggtcctgactcgtcttctcgtcggctaccgtaagtcgtcggacaaccaccgtcgccctcccgagtaccctattccgtcgtcgggtcctccgaggcctagaccgtagtcggtacggtntaatttactacgtcgtcttacgtcttaccttagtttcgacgtacggtcccgacccgtctacgttgtcgttacgttccggttaccgggacggtacgggacccgaagccgtaccggaaccgttcggtacgtcgacgtcgtcggtaccgg

SEQ ID NO: 93727 - DNA, 684 bp, Homo sapiens
  misc_feature: GYAE6OF01D16AS.29.85.H08.1.454.CMB.1.raw
  modified_base (231)..(231): a, c, t, g, unknown or other
  misc_feature (231)..(231): n is a, c, g, or t
  modified_base (312)..(312): a, c, t, g, unknown or other
  misc_feature (312)..(312): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtcccgggtctccgtggacagtcagtccaccatcctcctgccactcggaacccngccagcgatggtcggttgttattaactttgtctcctggtaccaacaacacccaggccgaccgcccccgatcattaatttangtatgtacattaacgccgtccctcgacggggtccctgactcgtccttctctcggtcctacgtaacggttcctaggacctaacctacgtccgtcccttccctacgtacctactcctccgtcgggtccttacccggacggtctacggtaccggacgttacgggtaccgggttagtaacgtttaacgttacgttacggtccgttcgtcctttactacgttttcggacgtaccggcccgtacccgtacgtacgtggttacggtacgttcccgggttaccgggggaccggggtaacggaaccccggtaacgggtccgttaacccgggtaacccgtttaccggtaccggtaccgaccgtcccggtacgtaaccccggg

SEQ ID NO: 93728 - DNA, 547 bp, Homo sapiens
  misc_feature: GYAE6OF01CXIYO.29.85.H08.1.454.CMB.1.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (299)..(299): a, c, t, g, unknown or other
  misc_feature (299)..(299): n is a, c, g, or t
  modified_base (423)..(423): a, c, t, g, unknown or other
  misc_feature (423)..(423): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacngtcagtcaccatctctgcactggaaccngcagcgatggtcggtggttataactttgtctcctggtaaccaacaacacccaggcgacgcccccgactcatattangatgtcattaagccggcctcgacggggtccctgactcgtcttctcgtggctacaagtctggctaacactcgccctccctgaccctatcctcgtcgggtctcccgagctacgacgatcgacggtntattacgttactgctggccttactgtttcgcgacggccctacccggctacgtgtcgacgttccgttacgggcggtacgggacccaaggcgtcgtacccgtcgtacggtcacgtcgagtacccgg

SEQ ID NO: 93729 - DNA, 725 bp, Homo sapiens
  misc_feature: GYAE6OF01B5YJS.29.85.H08.1.454.CMB.1.raw
  modified_base (645)..(645): a, c, t, g, unknown or other
  misc_feature (645)..(645): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgcttattttaaaaggtgtccagtgtgaagtgcagctggtggagtcgtgggggagtcgtggtacagccgtgggggtccctgagactctcctgtgcagcctctggtattcaagtttaatgtattttccatactactgggtccgtacaaggcgtccgggggaaggtccgtgggtaggtcgggtcttcgtcttagttaatcggagtacggtgacctaactacgtatttctagtcgacacgtactcgtggtaggaacgggccgtacttccgaacctacttacctacccgaaaggaacgtaaaccgaaaacctaaactaaaccggttaacccttaccccgttagttaacttaccgtaacgtaacctaaagttacgaaacgtacggttacgttaaggaagggtaacgtacggaaccgaacggtacgggtaccggttacttttaccttaaagttttacggtttacgaacgggtaaacaaaaaagggngggtaaaacgggaccgtaagggtaacttaccgggttaaaaggggtttcggggttaacccggtttggttttaaacccgggg

SEQ ID NO: 93730 - DNA, 363 bp, Homo sapiens
  misc_feature: GYAE6OF01DPI66.29.85.H08.1.454.CMB.1.raw
  modified_base (266)..(266): a, c, t, g, unknown or other
  misc_feature (266)..(266): n is a, c, g, or t
  modified_base (286)..(286): a, c, t, g, unknown or other
  misc_feature (286)..(286): n is a, c, g, or t
  modified_base (292)..(293): a, c, t, g, unknown or other
  misc_feature (292)..(293): n is a, c, g, or t
  modified_base (296)..(297): a, c, t, g, unknown or other
  misc_feature (296)..(297): n is a, c, g, or t
  modified_base (299)..(363): a, c, t, g, unknown or other
  misc_feature (299)..(363): n is a, c, g, or t
tcagatagagtactcacgaccggtgctcgatttagtatcactcagtcgcggggtccctgatcgcttctctggctccaagtctggcaacactgcctccctgaccatctctgggctccaggctgacgatgacggtgattattactgctgctcatttgcaggcacccgcactgtgatcttcggcggagggaccaagctgaccgtcctaggtcagctcaaggcctcgccccctggtcacttctcgttcccaccctctacatactctatcngagccggctggccaagggcncatagnngcnncnnnnnnnnnnnnnnnnnnnnnnnnnnnnnnnnnnnnnnnnnnnnnnnnnnnnnnnnnnnnnnnnn

SEQ ID NO: 93731 - DNA, 792 bp, Homo sapiens
  misc_feature: GYAE6OF01ECYHY.29.85.H08.1.454.CMB.1.raw
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
  modified_base (297)..(297): a, c, t, g, unknown or other
  misc_feature (297)..(297): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacngtcagtcacatcctctgcactggaaccngcagcgatggtcggtagttatactttgtctcctagtaccaacaaccaccgagcgacggcccccgatcataatttngtatgtacattacgccgccgtcgtacgggtccctgacttcgtcctttcgcgtcggcctaccgtaacgttccgtacgggtaccaaaccgtaccggtactcccccgttacccgttacggtaacccctaacgtttccccgtacgggttaccggggtaccccttacccggtaacgggtacccgttaacgggtaaacccggtaggtttaccgggtaaaccgggtttcgttaaaacgttttacgtttaaccggttcgttcccgtttacggtacctttaccgtttaaacggttttccgaaccccgggttaacgggaccccccgttaaccccggtaccgttaccggtttaccggtaacgggttaaacgtttcccgggttaaccgggggtacccggggggtaaaccgggtaaaccccggtacgggttaccggttaccccgggttaaccccggttaccggttaacggggttaccctacgggtaacccttcgggtaaaaccccggg

SEQ ID NO: 93732 - DNA, 582 bp, Homo sapiens
  misc_feature: GYAE6OF01A91IQ.29.85.H08.1.454.CMB.1.raw
  modified_base (223)..(223): a, c, t, g, unknown or other
  misc_feature (223)..(223): n is a, c, g, or t
  modified_base (286)..(286): a, c, t, g, unknown or other
  misc_feature (286)..(286): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctgctcagtgtccgggtctcctggacagtcagtcaccatctcctgcactggaaccngcagcgatgtcgtgtatacttgtctctgtaccaacacaccagcgacggccccgatcatattangatgtctataacgcgtcctcgacgggtcctgactcgtcttctctcggctcaagtctgacaactcgtcgccctcctagacctactcctcgtcggtcctaccgaggtctacgaccgtagtcggtaaccggtgtaactttacgttactgtactgtccttctagtttcgaccgtacggtcccaacccgtctaacgtgtacgtacgttccggttccgggaccgggtaacggaacccgtacgacccgttaccggacccgttcccggtacgggtaccaacgtcccgttaaccggtaacccggg

SEQ ID NO: 93733 - DNA, 583 bp, Homo sapiens
  misc_feature: GYAE6OF01A060D.29.85.H08.1.454.CMB.1.raw
  modified_base (222)..(222): a, c, t, g, unknown or other
  misc_feature (222)..(222): n is a, c, g, or t
  modified_base (360)..(360): a, c, t, g, unknown or other
  misc_feature (360)..(360): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaccngcagcgatgtcggtgttatacttgtctctgtacaacacaccaggcgacgcccccgatcataattatgatgtactagttaacgcgtcctcgacgggtcctgtactcgtcttctcgtggctccgaagtcgacggacaacnctcgcctccctacgtacctatccgtcgtcgggctccgagtcgtacgacgagtcggtacgtgtattacgttacgtgtccgtgtcttactagtttcggaccgtacggtcctacccgtacgtacgttgtcgtacgttccggtaccgggacgggtacgggaacctacggtacccgtaccggtaccccggtttacgtacggtacccgaggtcccgtaccggtaaccgg

SEQ ID NO: 93734 - DNA, 522 bp, Homo sapiens
  misc_feature: GYAE6OF01A0II1.29.85.H08.1.454.CMB.1.raw
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
  modified_base (341)..(341): a, c, t, g, unknown or other
  misc_feature (341)..(341): n is a, c, g, or t
  modified_base (349)..(349): a, c, t, g, unknown or other
  misc_feature (349)..(349): n is a, c, g, or t
  modified_base (437)..(437): a, c, t, g, unknown or other
  misc_feature (437)..(437): n is a, c, g, or t
  modified_base (505)..(505): a, c, t, g, unknown or other
  misc_feature (505)..(505): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (514)..(519): a, c, t, g, unknown or other
  misc_feature (514)..(519): n is a, c, g, or t
  modified_base (521)..(522): a, c, t, g, unknown or other
  misc_feature (521)..(522): n is a, c, g, or t
tcagatagagtactcacgaccggtgctcgatttagtatcactcagtctgcccctgactcagccctcgctcagtgtccgggtctcctggacagtcagtcaccatctcctgcactggaccagcagcgatgtcggtgttataactttgtctcctggtaccaacaacacccaggcgaggccccccgatcataattatgatgtcattaagcgccctcgaggggtccctgatcgcttctctggctccaagtctggacaacactcgtcctccctgaccatctcgtgggcctccgaggtctgacgagtgacggtntacttatacngtctgctcnttgcacggcacccgnacgtgtanacttcgtcggacggacggacagcgtacgaccgtactaggtccagtcctacgacgtcctccgccccgtcggcctacctctccgtccccnccctacctctacgtaccttctacgtcgtagggtacgccggcgtacggacgaggcccagtacgtagcgnactngnacnnnnnngnn

SEQ ID NO: 93735 - DNA, 740 bp, Homo sapiens
  misc_feature: GYAE6OF01CWY4A.29.85.H08.1.454.CMB.1.raw
  modified_base (704)..(704): a, c, t, g, unknown or other
  misc_feature (704)..(704): n is a, c, g, or t
  modified_base (713)..(713): a, c, t, g, unknown or other
  misc_feature (713)..(713): n is a, c, g, or t
  modified_base (728)..(728): a, c, t, g, unknown or other
  misc_feature (728)..(728): n is a, c, g, or t
  modified_base (732)..(732): a, c, t, g, unknown or other
  misc_feature (732)..(732): n is a, c, g, or t
  modified_base (734)..(734): a, c, t, g, unknown or other
  misc_feature (734)..(734): n is a, c, g, or t
tcagatagagtactcacgaccggtgctcgatttagtatcactcagtctgccctgactcagcctcgctcagtgtccggtctcctggacagtcagtcacatcgtcctgcactggaaccagcacgcgatgtccggtggttataactttgtctccgtggtaccaacaacacccaggccgacggccccccgatcattaattactgatgtcagttacgcggcctgagggtccctagactcgtcttcgtctcggcctacgaagtcctaggactaaccgtactcggcccttcccgtaggtaaccctagttccgtaccgtcggggtccttaccccgaagggtcctacggtacgtacgttcggaacggttacgtaactttataccgtcgtacccttagtcccttaccgttaacgtttcggacccgtacggtaccccaccccggtacgtaccggtttcggtacggtaccgttccggttaccgggacgggtaacggtaacctaaggtcccttacggtaccgttaccgttaacggtccgaagtaccgtaccgtaacggtccgtacccgtacccccggttacgtttccgtaaccgtttcccgttccgttaccccccgtacccgtttaccgaccgttaaccggttacccttaccgttaaccgtccggtaccggtcggtaccggtcgtacggaccgaccgggtaccacgtacggtactcncgttagccngtacgctaccgtacncacncntcgacg

SEQ ID NO: 93736 - DNA, 657 bp, Homo sapiens
  misc_feature: GYAE6OF01E48B9.29.85.H08.1.454.CMB.1.raw
tcagatagagtactcacgaccggtgctcgatttagtatcactcagtcgcggggagctctgggagaggagccccagccctgagattccccaggtgtttccattcggtgatcagcactgaacacagagaacgcaccatggagtttggactgagtcttgggttttccttgttgtacttaattttaaaaggtgtccagtgtgaagtgcagctggtggagtcgtgggggagtcgtggtacaggccgtcgggggtccctgacgactcctcctgtcgcagcctctggtattactaagtttatgttacttttaccatacacgtcgggtccgtacaagccgtaccggggaaggtcgtgggtaggtcgggttcttcttatttaataagtcgtacggtacggtcgtactaacttactatttctagtcgacagtactcgtggtacggaacggtccgtaattccacctactcctacgaagaacgaaaccaaacaactaacgttacctacccgtgttactccgtacgacaactacgaactacgtactaggaacgtaaggtacgaaccgaacgtacggcggttacttactaagttaagttgtacgaaacgaaaggtaggaaacggtaggaaggtacgttaacggtaagggtcgggttcgttcgggtttacgg

SEQ ID NO: 93737 - DNA, 765 bp, Homo sapiens
  misc_feature: GYAE6OF01DIRIG.29.85.H08.1.454.CMB.1.raw
  modified_base (195)..(195): a, c, t, g, unknown or other
  misc_feature (195)..(195): n is a, c, g, or t
  modified_base (759)..(759): a, c, t, g, unknown or other
  misc_feature (759)..(759): n is a, c, g, or t
  modified_base (761)..(761): a, c, t, g, unknown or other
  misc_feature (761)..(761): n is a, c, g, or t
  modified_base (765)..(765): a, c, t, g, unknown or other
  misc_feature (765)..(765): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatggtcggttggttataactttgtctcctggtaccaacaacaccaggcgaccggcccccgatcattaattngatgtcagttacgccgccctcgacggggtccctgactccgtcttcgtcgtcggcctaccgaagtccgtaggacctaacgacctccggtccctacccgtcgaaccctattccgtccgtcgggtcctccgaggtccgttacggacgtgttacggacggttagtaacttttacgttacgtcgtctcgtctcttagttcgacgccgcccgaccgtctacgttgtacgtacgttccggtacgggaccgggaacggaacccgtaacgtccggtaccggtacccggttaccgttaccggtaccgtacggtacctaaccgggtaaccgggtcccgtccccgtaccccgggttacccgttacccgtacccgtttccccggtttaccccgttaccccccgttacccccgttttcccggtaacccgttaacccgtttacccgtttaaccctttaaccggtccccgggttttaacggggacccggggttcccgggtacggggttaaccgggtacccgggaaccgggtacccgggtaactaaccggtagggtccgaactggcgcgcgagacgcacgncngcgn

SEQ ID NO: 93738 - DNA, 746 bp, Homo sapiens
  misc_feature: GYAE6OF01CRLA6.29.85.H08.1.454.CMB.1.raw
  modified_base (240)..(240): a, c, t, g, unknown or other
  misc_feature (240)..(240): n is a, c, g, or t
  modified_base (263)..(263): a, c, t, g, unknown or other
  misc_feature (263)..(263): n is a, c, g, or t
  modified_base (339)..(339): a, c, t, g, unknown or other
  misc_feature (339)..(339): n is a, c, g, or t
  modified_base (509)..(509): a, c, t, g, unknown or other
  misc_feature (509)..(509): n is a, c, g, or t
tcagatagagtactcacgaccggtgctcgatttagtatcactcagtcggcggggggggtctcaggaggcagcgctctggggacgtctccaccatggcctggctctgctcctcctcacctcctcactcgagggcacaggctcgttcgggcccagtcctcgccctgtacttcacgtccctcccgtccggtcgtccgggtctccgtggacagtcagtccgccatcctctgcacgtcggaaccngcagtgattgtagaagtaattgngtacttcgttccttaccgttacggtaaccaaacaacccgaaccacgaacaccgtaactaccaaacaaaccacatanaacttaacaacgtaagtacgtaacaaccttaccgtcccggtcccgtacggtaccgggtcttacggtactttccgttactcgtcgtactaccgtagtcgtacgactacgtccggctcctactacgtacctacgtacttcgttacgtaccgtacccgttacgacggtacggnggaacgggtaccgtaggtaccgttaagttacgtttaggttacggtcgtacgttacgtacttacgtaaagttaacttaaacggtactacggttacgttacgggtaacggttacggggttaacggggttccgggtaacgggggtaccgggtaaacggaacggttcccggtacccggaaccgggttccggttaccgggttaccggtaccgaaacccgggtcccggtaccgggttcccccg

SEQ ID NO: 93739 - DNA, 613 bp, Homo sapiens
  misc_feature: GYAE6OF01ERV20.29.85.H08.1.454.CMB.1.raw
  modified_base (223)..(223): a, c, t, g, unknown or other
  misc_feature (223)..(223): n is a, c, g, or t
  modified_base (340)..(340): a, c, t, g, unknown or other
  misc_feature (340)..(340): n is a, c, g, or t
  modified_base (368)..(368): a, c, t, g, unknown or other
  misc_feature (368)..(368): n is a, c, g, or t
tcagatagagtactcacgaccggtgctcgatttagtatcactcagtcgtggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcacatctcctgcactggaaccngcagcgatgtcggtgttatacttgtctctgtaccaacacaccgcaaacgtcccaaactctagatttatgacgtcgactacgccgtaccctcgagggttccctgactcgtcgttttcncggtcctactaacgtctcggacaaaccncggtccctcccttagacccgttcgtccgttcgggcctccgacggtctagacgtagtacggagtcgtagtaacttacgttacgtcgtcctccgtactactacgtgacctaacggactaaacgtaacttacgttttacgttacgtttacgggaccggtagggaacccgtaagtaccgtacggtaccgttaccgtacgtacgtaccgtacgaccgtacgaacggtcctcccggtccccgtcggtaccg

SEQ ID NO: 93740 - DNA, 621 bp, Homo sapiens
  misc_feature: GYAE6OF01BWDLW.29.85.H08.1.454.CMB.1.raw
  modified_base (224)..(224): a, c, t, g, unknown or other
  misc_feature (224)..(224): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttatacttgtctctgtaccaacaaccaccaggcgaccggcccccgatcaataattatgatgtctattaacgccggccctcgacgggtcctgactcgtcttcgtcgtcggctaccgaagttccgtacggaccaaccgtactccgtcccctcccgtacgaccctacgttccgtcgtcgggtcctcccgacggtctacggacgtagtcggtacggtgtaatttacgtttactcgtcttacgtccttactacggtttcgaccggtaccggacccgaccccgtacgtaccgttggtacgttacgttccgggttaccggggacggggtacgggaccgtaacggcgtaccggtacccgtcgtacggtaccgcgtaccgtacgtaccggg

SEQ ID NO: 93741 - DNA, 549 bp, Homo sapiens
  misc_feature: GYAE6OF01BWCMA.29.85.H08.1.454.CMB.1.raw
  modified_base (221)..(221): a, c, t, g, unknown or other
  misc_feature (221)..(221): n is a, c, g, or t
  modified_base (284)..(284): a, c, t, g, unknown or other
  misc_feature (284)..(284): n is a, c, g, or t
  modified_base (457)..(457): a, c, t, g, unknown or other
  misc_feature (457)..(457): n is a, c, g, or t
tcagatagagtactcacgaccggtgctcgatttagtatcactcagtcgcggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccngcagcgatgtcgtgttatactttgctctgtacaacacaccagcgacgcccccatcataattangatgtcattaagcgtcctgacgggtcctgatcgtcttctctgctaccgaatctggacaaactctcgccctcccgtagacctatcctctcgggacctccgaggctagaccgtatcggacgtgtaatttagtaactggtcttacgcttactagtttcgacgtacggccaacccgnaacgtcgtagtactccgttcggccgggtagggaccaacggccttacggaaccccggttaccctaggttcccaaggtcccgttgaaacccggg

SEQ ID NO: 93742 - DNA, 610 bp, Homo sapiens
  misc_feature: GYAE6OF01APJ1Y.29.85.H08.1.454.CMB.1.raw
  modified_base (294)..(294): a, c, t, g, unknown or other
  misc_feature (294)..(294): n is a, c, g, or t
  modified_base (320)..(320): a, c, t, g, unknown or other
  misc_feature (320)..(320): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcacgtggaaccagcagcgatggtcggtgttatactttgctctgtaccaacaccaccaggcgacgcccccgactcatattangatgtcatacgcgcctcgcgggtccngactcgcttctctggtcctcaagtctggaccaacgtactcgcctccctacgaccctacgtccgtcgtcgggtcctccgaggcctacgacgacgtggtacgtagtactttacttacgtcgtctcgtcttacgtagtttcggaccgtaccgggccctaaccccggtctaacgttcggtacgtaccgttccggttaccgggggaccgggtaacggggaaccctaaacggtccggttaacggtacccccggttaccgttaacggggttccacgggtaccgttaccggaaccggg

SEQ ID NO: 93743 - DNA, 728 bp, Homo sapiens
  misc_feature: GYAE6OF01CUHSK.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagtcgttgggttttccttgttgtcttaagttttaaaaggtgtccagttgtagaagtgcgaggtcgtgggtggagtcggtgggggtagtcggtggttacgacggtccggttcggggggtccctggacgtaccttccgttccgtgtcgctacgtccttcgtggtattactaagtttaatgttacttttaccattacgtacggttcggtcccgtagtaacggtccggtaccggggtaaggttccgtggggtagttcgggttaccttcgttacgttagttaacgtcggaacgtacggttacgtacctaacgttacgtatttctagtcgactaacgttacttcgttaaggttaggaaccgggacctttacgttaccaacccgtacttcctaaccggaaagaacgtaaaccaaacggaaactaaccgttcccttactagttacctcttaacgaactaaagtcgtaactcgttacgtaaggaacgtaacggtcgaaacgtacgtcgtcttactttacgtatttagtagaacgtaaagaaaggaggaagaacgtagtacgtaggttagggtcggtaccgtgttaccgg

SEQ ID NO: 93744 - DNA, 622 bp, Homo sapiens
  misc_feature: GYAE6OF01ER8OY.29.85.H08.1.454.CMB.1.raw
  modified_base (296)..(296): a, c, t, g, unknown or other
  misc_feature (296)..(296): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttatactttgtctctgtaccaacaacaccaggcgacggcccccgatcattaatttangtatgtcattaagcggtccctgacgggtccctgactcgcttctcgtggctacctaagtctggaccaacactcgccctcccgtagaccacttcctcgtcgggtcctcccgaggctagacgtagtcggtaccggtgtaactttattactacgtctacgtcttcgtagtttcggaccgtacgggccctaccccgacgtaaccgttcggtacgttacgttcccgtttaccgggtccgggtaaacggggtaacccctaaaggtcccgttaccgggtaaccccgtttacccggtaaagggttcccgaacgggtccgtaaccggtaacccggg

SEQ ID NO: 93745 - DNA, 635 bp, Homo sapiens
  misc_feature: GYAE6OF01DDLU2.29.85.H08.1.454.CMB.1.raw
  modified_base (187)..(187): a, c, t, g, unknown or other
  misc_feature (187)..(187): n is a, c, g, or t
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
  modified_base (289)..(289): a, c, t, g, unknown or other
  misc_feature (289)..(289): n is a, c, g, or t
  modified_base (622)..(635): a, c, t, g, unknown or other
  misc_feature (622)..(635): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtgttataactttgtctctgtaccaacaacaccagcgacgcccccgatcataattangatgtacattaacgcgcctcgacgggtccngatcgcttcnctggctcaagtctcggacaacactcgtccctaccctgaacctactcgtcgtcgggacctcgnggctagacgatcggtaacgtgtaattttaactacgtcgtcgttcgtaccttacgttaagtttacggccgaaccgggaccccaacccgtcgtaacgttggtacgtaaccgtttccggtaccgggggaccgggtaaacgggaaccaaggtcccgtacggtacccggttaccgtacggtaccgtaacgcgttaccgaacggtccctacccggcccccgttacgtcctaccgttccttcccgttacccctaccctaccgtacctaacttacctcttacgtccgttacgggaccgggtccggtcggttacggaccgtaacgggccgaagtacgagcgnnnnnnnnnnnnnn

SEQ ID NO: 93746 - DNA, 669 bp, Homo sapiens
  misc_feature: GYAE6OF01EYGL5.29.85.H08.1.454.CMB.1.raw
  modified_base (354)..(354): a, c, t, g, unknown or other
  misc_feature (354)..(354): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcgtggtacagccgtggggggtccctgagactctcctgtgcagccctctggtatactaagtttaatgtattttccatactacgttcgggtccgtcgaagtcggtaccggggaaggtcgtggaggtgggtctcttnttattagtcgagtacggtgcgtactactattctatgcagtactcgtgtacggacgggtcctattccaacctactcctaccagaacgtaaccaaaccaaacgtaaacgttacctcccgttagttactctacgactaaacgtgaactagttacctaaggaacgtaaagtcggaaaccgacgacgggtcccgtacgttttaacttacgtttaagtttcgggtaagaaacccgtaaaaaaggacgggaaacgggtaaccggaagggttaattaccgggttaaagggtttccgggggttacgttccgggttttaaaccgg

SEQ ID NO: 93747 - DNA, 510 bp, Homo sapiens
  misc_feature: GYAE6OF01DK7EM.29.85.H08.1.454.CMB.1.raw
  modified_base (222)..(222): a, c, t, g, unknown or other
  misc_feature (222)..(222): n is a, c, g, or t
  modified_base (271)..(271): a, c, t, g, unknown or other
  misc_feature (271)..(271): n is a, c, g, or t
  modified_base (293)..(293): a, c, t, g, unknown or other
  misc_feature (293)..(293): n is a, c, g, or t
  modified_base (420)..(420): a, c, t, g, unknown or other
  misc_feature (420)..(420): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcacatctctgcactggaaccngcagcgatgtcggtgttataactttgctctcgtacaacaacaccaggcncggccccgatcaataatttacngatgtcattaagcgcctcgacgggtcctgatcgcttctctcggtctccaagtctcggcaacactcgcctcctgaccatcctcgtcggacctccgaggctgacgagtcgacggtgtatttattacgtnctgctctatttgcgacgccaccgtcgacttgtcgacttcgtcgggacggagggaccagccgtacgaccgtcgtacgcagctcgtaaccgg

SEQ ID NO: 93748 - DNA, 152 bp, Homo sapiens; identical to SEQ ID NO: 93475
  misc_feature: GYAE6OF01E34NX.29.85.H08.1.454.CMB.1.raw
  modified_base (150)..(152): a, c, t, g, unknown or other
  misc_feature (150)..(152): n is a, c, g, or t

SEQ ID NO: 93749 - DNA, 594 bp, Homo sapiens
  misc_feature: GYAE6OF01CXQ8F.29.85.H08.1.454.CMB.1.raw
  modified_base (226)..(226): a, c, t, g, unknown or other
  misc_feature (226)..(226): n is a, c, g, or t
  modified_base (463)..(463): a, c, t, g, unknown or other
  misc_feature (463)..(463): n is a, c, g, or t
  modified_base (477)..(477): a, c, t, g, unknown or other
  misc_feature (477)..(477): n is a, c, g, or t
  modified_base (511)..(511): a, c, t, g, unknown or other
  misc_feature (511)..(511): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatcctgggctcagtctgccctgactcagcctcgctcagtcggtccggtctcctggacagtcagtcaccatcctctgcactggaaccngcagcgatggtcggtaggttataactttgtctaccgtacgtaaccaaacaaccaccacggaccgaccggcccccgactacctaattaactttagtgaacttgtactaagttaaacgccgtacccgtcgaacggggtccctgactcgtcttctcgtgctaccaagtctaggaccaacacgtcgtccctcctagacctactccgtcgtcggacctcgaggctagacgtatcggaggttnactttaacttacgngtctcgtcttagtacgttgacgacgtcacccgtncgtagtcacgttccgtcgggacggtaggaccgaacgtccgtacggtaccgttccggtaacggtcaacgtcgtacgtaacccgg

SEQ ID NO: 93750 - DNA, 595 bp, Homo sapiens
  misc_feature: GYAE6OF01AG25M.29.85.H08.1.454.CMB.1.raw
  modified_base (327)..(327): a, c, t, g, unknown or other
  misc_feature (327)..(327): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatccgtgggctcagtctgccctgactcagcctcgctcagtcgtccgggtctcctggacagtcagtccaccatctcctgcactaggaaccagcagcgatggtcggtggttatacttgtctctgtaccaacacaccaggcgacgcccccgatcatattatgatgtacagttacgccgcctcgcgggtccngtctcgtctctcgcgctcgatctcgacactcgtcncctccgtcactntcctcgtcggtcctccgcgtctacggacgacgtacggtacgttcgtatttacgtcgtacgtcttcgtccttcgttaccgttttacgaccggtacccgtacccgtcgttaccgtcgtcgtacggtccggttaccgggacgggtaccggaacccgtacggtcccggtaccgtacccgggtttacccgtacgggtcccacggtccgtacggtaccggtaccccg

SEQ ID NO: 93751 - DNA, 621 bp, Homo sapiens
  misc_feature: GYAE6OF01DFN4M.29.85.H08.1.454.CMB.1.raw
  modified_base (243)..(243): a, c, t, g, unknown or other
  misc_feature (243)..(243): n is a, c, g, or t
  modified_base (300)..(300): a, c, t, g, unknown or other
  misc_feature (300)..(300): n is a, c, g, or t
tcagatagagtactcacgaccggtgctcgatttagtatcactcagtcgcggggggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcgccatctcctgcacgtggaaccagcagtgatgttgagtattngactgtcctccttggtaaccaacaacaccagacacagtccaacaaacacatagatanacaatgtacaatactcgccctacgacgggtccctgacttcgtttctcgtcggtctccgtaagtcgtcggactaagtcgaccggtcctaccgataccgacctattccgtcgtacggacctccgacggtcgtaggacggacgtacggtctaggtaatttagttacggtcgtctcgtcctacgtaatagttaacgtaagtactaggttacgtaacgttacggttaaagggggttcggttacggggtacgggaagggtaacccgtaggtccgttaccggacccggttaccgtacggggtaccaccggtcccgtaacggtcccccg

SEQ ID NO: 93752 - DNA, 649 bp, Homo sapiens
  misc_feature: GYAE6OF01A0TBO.29.85.H08.1.454.CMB.1.raw
  modified_base (226)..(226): a, c, t, g, unknown or other
  misc_feature (226)..(226): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatctcctgcactggaaccngcagcgatggtcggtgttataacttgtctccgtgtaccaacaacaccaggccgacggccccccgactcattaattactgatgtactattaacgccggtcctcgacgggtccctgacgtccgaccttctacgtcgcctaccgtaacgtctcgggtaccaacgtactccgccctcccgtacgacctactcctacgtcggccttaccgaggcctgacgagtcggaacgtcgtatttacgttactgtaccgttcgtactcttacgttcggtacccgacggtacccgttaccccgacttaccgttaggtacgttaccgttccggttaccggggtacccgggaacgggtaaccggtaaccggtacccgtacggttacccccgggttcgtaacggggttaccctaacggcccggttacgaaaccccgggg

SEQ ID NO: 93753 - DNA, 626 bp, Homo sapiens
  misc_feature: GYAE6OF01A3WFG.29.85.H08.1.454.CMB.1.raw
  modified_base (194)..(194): a, c, t, g, unknown or other
  misc_feature (194)..(194): n is a, c, g, or t
  modified_base (214)..(214): a, c, t, g, unknown or other
  misc_feature (214)..(214): n is a, c, g, or t
  modified_base (607)..(607): a, c, t, g, unknown or other
  misc_feature (607)..(607): n is a, c, g, or t
  modified_base (611)..(611): a, c, t, g, unknown or other
  misc_feature (611)..(611): n is a, c, g, or t
  modified_base (613)..(614): a, c, t, g, unknown or other
  misc_feature (613)..(614): n is a, c, g, or t
  modified_base (616)..(616): a, c, t, g, unknown or other
  misc_feature (616)..(616): n is a, c, g, or t
  modified_base (618)..(626): a, c, t, g, unknown or other
  misc_feature (618)..(626): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacaccaggcgacggccccccgactcataattangatgtcattaagcggccctnacggggtccctgatcgcttctctggctccaagtctggcaacactcgccctcctgaccatctcgtcgggtcctccgaggctggacgtatcggacggtgtattacttacgtgtctgtccttacgtatttcggccgtaacggcccgtaaccccgcgtaacgttcgtacgtacgttccggttcggggaccgggacgggtaaccgaacggtccgtaccggtacccgttccgtaacggtctaacggtccgtaccggtaacggtcccgtcccggtacccccgttccggtcccttaaccgttcccgttcccgttccccctacccgttccctacgtaccgtaaccttcgtacgttccgtaagggtccggtcggtcgtagggaccgtaacggctaaccgtagngacncnngncnnnnnnnnn

SEQ ID NO: 93754 - DNA, 152 bp, Homo sapiens; identical to SEQ ID NO: 93475
  misc_feature: GYAE6OF01DU79D.29.85.H08.1.454.CMB.1.raw
  modified_base (150)..(152): a, c, t, g, unknown or other
  misc_feature (150)..(152): n is a, c, g, or t

SEQ ID NO: 93755 - DNA, 562 bp, Homo sapiens
  misc_feature: GYAE6OF01BS4D9.29.85.H08.1.454.CMB.1.raw
  modified_base (223)..(223): a, c, t, g, unknown or other
  misc_feature (223)..(223): n is a, c, g, or t
  modified_base (291)..(291): a, c, t, g, unknown or other
  misc_feature (291)..(291): n is a, c, g, or t
  modified_base (321)..(321): a, c, t, g, unknown or other
  misc_feature (321)..(321): n is a, c, g, or t
  modified_base (328)..(328): a, c, t, g, unknown or other
  misc_feature (328)..(328): n is a, c, g, or t
  modified_base (407)..(407): a, c, t, g, unknown or other
  misc_feature (407)..(407): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcacatctcctgcactggaaccngcagcgtatgtcggtgttatacttgtctcctgtacaacacaccagcgacgccccgatacataattacngtatgtacattaagcgcctagacgggtccngacgtcncttcgtctcggtctacgtaacgttcgacggacaacgtactcgcctacctcgaccctatctcgtcggctcgagctagacntaggtacgtgtacttactagtcgctgtaccttagtactttgaccgttacggaccctacccgtctacgtcgtacgtacgttcgttccgggacgggtaacggactaacggtcgtaccgtacggtaccttacgggacctacggtcctcggtaacccgg

SEQ ID NO: 93756 - DNA, 799 bp, Homo sapiens
  misc_feature: GYAE6OF01EVLTO.29.85.H08.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
tcagatagagtactcacgaccggtgctcgatttagtatcactcagtcggcgggggggggtctcaggaggcagcactctcgggacgtctccaccatggcctgggctctgctcctcctcagcctcctcactcagggcacaggatccgtgggctcagtctgccctgactcacgcctcgctcgagtgtcccgggtctccgtggacngtcagtccacntctcngcacgtgaaccngctaggtcgtacgttggtactacttacgtaacgtcgttctaccgtacggtaccacggccaaccgcccccgaagcctaaccaccgtaaccccaaactcgaagttacgttacttttacggaccgttacgtaagttaaacgttccggtacccttacgggaccgggttccctaggtacttccgtacttccgttcgtacggggtacctaacgtcgtacgggaccacgacccgtaccggtcccttaccgttacgttacttaccgttaccgttcgggtacgggtaccctacgtaacggtacgtacgggaacggttaacggacggtacctaaaggttaaactttacgtttaacgttacgagtacgttaacctactaaagttaacggttaaaccggaaaacggtaaccgtaaaccttacggttttaacggaacggtttacccgttaaccggggtaaaacgtaacccgggggtaaacctaaaaccgggttcccgttaacccggttaaccggttaccggaaacccgtaacccgggtaaccccgaaaacccgggttacccccaaaccgttaccgttacccg

SEQ ID NO: 93757 - DNA, 663 bp, Homo sapiens
  misc_feature: GYAE6OF01D77M5.29.85.H08.1.454.CMB.1.raw
  modified_base (643)..(643): a, c, t, g, unknown or other
  misc_feature (643)..(643): n is a, c, g, or t
  modified_base (650)..(650): a, c, t, g, unknown or other
  misc_feature (650)..(650): n is a, c, g, or t
  modified_base (656)..(656): a, c, t, g, unknown or other
  misc_feature (656)..(656): n is a, c, g, or t
  modified_base (658)..(659): a, c, t, g, unknown or other
  misc_feature (658)..(659): n is a, c, g, or t
  modified_base (663)..(663): a, c, t, g, unknown or other
  misc_feature (663)..(663): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgacggccccccgatcataatttatgatgtcattaacgcggccctcgaggggtccctgatcgcttctctggctcagtctggcacactcgcctcctgaccatctctgggctccgaggctagacgagtggacggtagtatttacttactgtacctgtcttctagtttcgacgtacggcccacccggtctaccgttgtcgtacgttcggttaccggggtacggggaacggggaaccctaaacggtccgttacggtacccggttaccgtaacgggttccacggtccgtacggtaaccgggtcctcccggtcccccgttccgggttaccctacccgttcccgttacccggtttccccccgtccccgtttacccgtccgtaaccgttaccttccgttaacctcgtacgggtaccgggtccgggttccgtacggggacccggtaaacggggtcccgtaccgtaaggtacgtcgtacgtcncgcgctncgtcananngtgn

SEQ ID NO: 93758 - DNA, 152 bp, Homo sapiens; identical to SEQ ID NO: 93475
  misc_feature: GYAE6OF01CMQLJ.29.85.H08.1.454.CMB.1.raw
  modified_base (150)..(152): a, c, t, g, unknown or other
  misc_feature (150)..(152): n is a, c, g, or t

SEQ ID NO: 93759 - DNA, 160 bp, Homo sapiens; identical to SEQ ID NO: 93529
  misc_feature: GYAE6OF01BCSEB.29.85.H08.1.454.CMB.1.raw
  modified_base (150)..(160): a, c, t, g, unknown or other
  misc_feature (150)..(160): n is a, c, g, or t

SEQ ID NO: 93760 - DNA, 435 bp, Homo sapiens
  misc_feature: GYAE6OF01C5Q2G.29.85.H08.1.454.CMB.1.raw
  modified_base (291)..(291): a, c, t, g, unknown or other
  misc_feature (291)..(291): n is a, c, g, or t
  modified_base (399)..(399): a, c, t, g, unknown or other
  misc_feature (399)..(399): n is a, c, g, or t
  modified_base (421)..(421): a, c, t, g, unknown or other
  misc_feature (421)..(421): n is a, c, g, or t
  modified_base (427)..(435): a, c, t, g, unknown or other
  misc_feature (427)..(435): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgatcataatttatgatgtcattaagcggccctcaggggtccctgatcgcttctctggctccaagtctggcaacactgccctccctgacccatcctctgggctccaggctggacgatgacggtgattattactgctgctcatttgcaggcacccgnactgtgatcgttcggcggagggaccaagctgaccgtctaggtcagctcaaggctcgccccctggtccacttctcgttccccaccctccctcacgttacctctacttcngacgcgggtctggcaagggccnatagcnnnnnnnnn

SEQ ID NO: 93761 - DNA, 607 bp, Homo sapiens
  misc_feature: GYAE6OF01DYKLO.29.85.H08.1.454.CMB.1.raw
  modified_base (192)..(192): a, c, t, g, unknown or other
  misc_feature (192)..(192): n is a, c, g, or t
  modified_base (591)..(591): a, c, t, g, unknown or other
  misc_feature (591)..(591): n is a, c, g, or t
  modified_base (593)..(595): a, c, t, g, unknown or other
  misc_feature (593)..(595): n is a, c, g, or t
  modified_base (597)..(598): a, c, t, g, unknown or other
  misc_feature (597)..(598): n is a, c, g, or t
  modified_base (600)..(605): a, c, t, g, unknown or other
  misc_feature (600)..(605): n is a, c, g, or t
  modified_base (607)..(607): a, c, t, g, unknown or other
  misc_feature (607)..(607): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggcccccgatcataattangatgtcattaagcggcctgaggggtccctgatcgcttctctggctcaagtctggacaacactcgccctccctgaccatctcgtcgggcctccgaggctagacgagtcgacggttgattacttactacgtcgtcgtcttacgtattttcgaccgacggtccaccccggtctaacgttgtacgtacgttccggttcggggacgggtaacgggacccaacggtaccgtacgtacccgggttaccgtacggtaccgaacgtcgtaccgaaacggtccgtacccggtccccctccggtacctaccttcccgttccgttcccctaacccttccgtactacgttacctcttactcggttacgacgggtccgggactaccggaccgaacggccgtacaacgtagcgngnnncnncnnnnnngn

SEQ ID NO: 93762 - DNA, 561 bp, Homo sapiens
  misc_feature: GYAE6OF01DZ0VE.29.85.H08.1.454.CMB.1.raw
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (417)..(417): a, c, t, g, unknown or other
  misc_feature (417)..(417): n is a, c, g, or t
  modified_base (549)..(550): a, c, t, g, unknown or other
  misc_feature (549)..(550): n is a, c, g, or t
  modified_base (552)..(561): a, c, t, g, unknown or other
  misc_feature (552)..(561): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtgttataactttgtctcctggtaccaacaacacccaggcgacggccccccgatcattaatttatgatgtcaattaagcggccctcgaggggtccctgatcgcttcnctgctccaagtcgtgacaacnctcgccctcctcgacctatcctcgtcgggcctccgaggctggacgtagtggacggtgtaatttatactgtctgtctctagtttcgcgacggccacccgtcacgtgtagacgttcggtcgggcgggacgggaccagccgtacgtacccgtcgtacggtcncgactacgacgccgtccgtccccgtcggtctaccgttccttcccgttacccctacccttccctactacgtaccttacgttactcgtacggacggtccgggtcgtcggacgaacggccgtagtacgtagctgnncnnnnnnnnnn

SEQ ID NO: 93763 - DNA, 784 bp, Homo sapiens
  misc_feature: GYAE6OF01DTP96.29.85.H08.1.454.CMB.1.raw
  modified_base (452)..(452): a, c, t, g, unknown or other
  misc_feature (452)..(452): n is a, c, g, or t
tcagatagagtactcacgaccggtgctcgatttagtatcactcagtcgcggggggggtctcaggaggcagcactctcgggacgtctccaccatggcctgggctctgctcctcctcacgcctcctcactcgagggcacgaggatccgtgggctcacgtctcgccctagactccagcctcgctcagttcggtccgggtcctccgtaggactagtcacgtcacctactcctctcgacacgtacgaaccagcagcgtatcggtcggtaggtttataacgttttgtccttaccgtacggtaaccaacctaaccaccccgtaggccgaccccgggaccccctaactacgaactttaacgtttagtggtaacttacgtacgtacgttaaacggccggtcccgtacggtaccgggtcctagactcgtcttcgtctcggctacgtacgtcgtacgacaacnctcgacctcctacgtactacgttccgtcgtcgggtaccctacgcgggtactaacggaccgttacggtacggtacgggttaattacgtttaactttcgcggttcccgtttagcctttactttaacgggttccgtaaccggtacccggttaaccccgtaacccggtccttaacggttccgggttaaccgtttaccgggtttccggggtaaaccccggggggtcggaaaccggggtaaccctaaacgggtcccgttaacccgggttaccccggtttaacgggttaacccggtaccggtaacccggtttacccggtaaaccggttaacccccgggg

SEQ ID NO: 93764 - DNA, 653 bp, Homo sapiens
  misc_feature: GYAE6OF01A068F.29.85.H08.1.454.CMB.1.raw
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
  modified_base (303)..(303): a, c, t, g, unknown or other
  misc_feature (303)..(303): n is a, c, g, or t
  modified_base (638)..(638): a, c, t, g, unknown or other
  misc_feature (638)..(638): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacagtcagtcaccatcncctgcactggaaccngcagcgatgtcggtgttatactttgtctcgtagtaccaacaaccaccgaggcgaccggcccccgatcaattaattangatgtactaattacgccggtccctcggacgggtcctgtactcgtcttcgtcgtcggtcctaccgtaagttccgtacggacaaacctaccgtccgtccccttacccgtacgtaacccctagttacccgttgtaccgggtcccttacccgtacggaccgttagaaccgtagtcggtaacggttagttaactttaactacgtgtcctgccttactacgtttcggaccaccgggtaccctaccccggtataccggtggttacgtaccgtttcccggtaccgggacgggtaacggaaccgtacgggccttaccggtacccgtcggtaacggtctaacggngttacccgaaccggg

SEQ ID NO: 93765 - DNA, 865 bp, Homo sapiens
  misc_feature: GYAE6OF01DVYIW.29.85.H08.1.454.CMB.1.raw
  modified_base (282)..(282): a, c, t, g, unknown or other
  misc_feature (282)..(282): n is a, c, g, or t
tcagatagagtactcacgaccggtgctcgatttagtatcactcagtcggcggggggggtctcaggaggcagcactctcgggacgtctccaccatggcctgggctctgcctcctcctcagccctcctcactcgagggcacgaggactcccgtgggcctacgtagttccgtcggaccccttggaacctccgacggtccctcgacctcgaggttccggtcccgggttcctccgtagggacctaggttccacgtccaacctattcctcctgccacgtacggaaccngcgagcgagtggtacggttagttacttaacgtttcgtaccgtccgtacggtaaccaacgaacccaccgacggccgaccggaccccccgtatactaatttaacgtttacacgttacgtacgttacgtaacgttaaccggcccggtaccccgtacgggtaccggggtccctaggtccgttaccgtctttccgtacgtcggtacctaccgtaacggttccgtacggaaccctaaccgtccgttaccggacccctttacccggaacgtaacccgttacgtttcccggtcggggttaccccgggaccctttacccgggacggttacccggttagggaaacccgtttacggggtaacggtttaacggggttaacctttaaacgtttttacggtaacccggtttcggttaccctacgggttttaccctaaacggttttccgtaccgggttaaccccggacccgggttaccctaacccccggttacgtacggttcggttaaccgtcccggttaccgggtaccgggaccggggaacgtccgaacggtcccgtacggtacccgttacgacgtacctacgtccgacggtacccg

SEQ ID NO: 93766 - DNA, 593 bp, Homo sapiens
  misc_feature: GYAE6OF01AVFTX.29.85.H08.1.454.CMB.1.raw
  modified_base (228)..(228): a, c, t, g, unknown or other
  misc_feature (228)..(228): n is a, c, g, or t
  modified_base (504)..(504): a, c, t, g, unknown or other
  misc_feature (504)..(504): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtggacagtcagtccaccatctcctgctacgtggaaccngcagcgtatgtcggtgttatacttgtctcgtgtacaacacaccaggcgacgccccgactctatatatgtatgtacattagccgtcctcggacgggtcctgactcgtcttcgtcgtgtcctaccgtaagtcgtacggacaactactcgtccctcccgtacgaccctatccgtcgtcggtaccctccgacggtcgtacggtacgtagtacggtacggtagtaattacgttacgtacgtcgttcgtcttactacgtttcgacgtaccggcctaccccgngtaccgttgagttccgtccggtcgggacgggtacgaccgtacggtccgtacgaccggttaccgtacggtacgcgtaccgtcgtacccgg

SEQ ID NO: 93767 - DNA, 517 bp, Homo sapiens
  misc_feature: GYAE6OF01B9ESB.29.85.H08.1.454.CMB.1.raw
  modified_base (232)..(232): a, c, t, g, unknown or other
  misc_feature (232)..(232): n is a, c, g, or t
  modified_base (260)..(260): a, c, t, g, unknown or other
  misc_feature (260)..(260): n is a, c, g, or t
  modified_base (456)..(456): a, c, t, g, unknown or other
  misc_feature (456)..(456): n is a, c, g, or t
  modified_base (492)..(517): a, c, t, g, unknown or other
  misc_feature (492)..(517): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgacggcccccgatcataatttatgatgtcattaagcggccctgacggggtcctgatcgcttctctggctccaagtctggcaacactcgccctcctgaccatctcgngggctccgaggctgacgagtggacggtntattattactgctgcttactattgcgacggccacccgctatgtgtactcggttacggacggtaacgggaaccaaggtctacggtacccgtcgtacggcagcctacgaacggtcctcccggccccgttggtacctaaccgttccgttccccggttacccccaacccttccctacgtaacgttacctcgtaacttcgnggacggcggtcgacggacgaacgcgttaacagacgnnnnnnnnnnnnnnnnnnnnnnnnnn

SEQ ID NO: 93768 - DNA, 587 bp, Homo sapiens
  misc_feature: GYAE6OF01EATV9.29.85.H08.1.454.CMB.1.raw
  modified_base (223)..(223): a, c, t, g, unknown or other
  misc_feature (223)..(223): n is a, c, g, or t
  modified_base (291)..(291): a, c, t, g, unknown or other
  misc_feature (291)..(291): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccngcagcgatgtcgtgttataactttgtctctgtaccacaacaccagcgacgcccccgatcataatttangatgtcattaagcgtcctcgacgggtcctgatcgtcttctctcggtctccgaagtcctaggaccaactaccgtcgccctaccgtacgtaccctacttctccgtcgggtcctcccgaggtctagtacgatggacgtgtattattacgtgtcgtgtctactacgtttcgacgtacgcccgtacccgctaacttcgtagtacgttccgttacggggaccgggaacggggtacccaagtcccgtaccggaacccggttaccggttaagggttccctaacgggtttacaaccggggtcccg

SEQ ID NO: 93769 - DNA, 667 bp, Homo sapiens
  misc_feature: GYAE6OF01C62MJ.29.85.H08.1.454.CMB.1.raw
  modified_base (321)..(321): a, c, t, g, unknown or other
  misc_feature (321)..(321): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatcctgggctcagtctcgccctgactcagcctcgctcagtcgtccggtctccgtggacagtcacgtcaccatctcctgccacgtacggaaccagccgagcgagttggtcggtaggttactaactttcgctcgtacgtaccaaacaccaccgaggccgaccggccccgtatcctaattattanagtactgtacattaacgccgtcctacggacgggtcctgactcgtcttctcgtcggtccttaccgtaagtccgtacggccaaacgtccgtcgtacccctcccgttcgaaccctactccgttacgttcggaccctacgtcgtcgtacgacgagtacggtacggtattactttacgtttacgtcgtacgttacgactttacgttacgtttacgcggtaccgtacccgtacgtaccgtacggttcgttaactccgggttaccgtacgggccgggtaaacggaccgtaaccggtcgtacccggtacccgttacccggaagttaccgtaccggaccgttaccggtaacccgg

SEQ ID NO: 93770 - DNA, 558 bp, Homo sapiens
  misc_feature: GYAE6OF01BMY8L.29.85.H08.1.454.CMB.1.raw
  modified_base (260)..(260): a, c, t, g, unknown or other
  misc_feature (260)..(260): n is a, c, g, or t
  modified_base (297)..(297): a, c, t, g, unknown or other
  misc_feature (297)..(297): n is a, c, g, or t
  modified_base (542)..(542): a, c, t, g, unknown or other
  misc_feature (542)..(542): n is a, c, g, or t
  modified_base (546)..(558): a, c, t, g, unknown or other
  misc_feature (546)..(558): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgacggccccccgactcattaatttatgatgtcattaagcggccctcgaggggtccctgatcgctttctctggctccaagtctggcaacnctcgccctccctgaccatctcgtgggcctccagggcnggacgagtggacggtgtaatttattactgctgcttctattgcaggccacccgctacgtgtgtactcgttcggggacggaacgggtaccaagtcgtacggtacccgttaccgtaggtccacgtcgtacgaacggtcctccgtcccccgtcggtcctaccgttccgttccgttcccccgtcccttccgtccgtacgtccttctactcgtaggtcggtcgggtcgtcggcgtaacggccgacagtagntcgnnnnnnnnnnnnn

SEQ ID NO: 93771 - DNA, 674 bp, Homo sapiens
  misc_feature: GYAE6OF01DDP78.29.85.H08.1.454.CMB.1.raw
  modified_base (228)..(228): a, c, t, g, unknown or other
  misc_feature (228)..(228): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacaggatccgtgggctcagtctgccctgactcagcctcgctcagtcgtccggtctccgtggacagtcagtccacatcctcctgcacgtgaaccngcagcgatggtcggtgttataacttgtctcgtagtaaccaacacaccaggccgaccggcccccgactactaattaatttatacgtatcgtactaagttaacgccggtaccctcggacgggttccctagacgttccgtcttcgtcgtcgcctacgtacgtctaggacaaactcgtcgaccctccgtacgaacctctccgtcgtcggcctaccgtagtccgtacgacgtacgtacggtacgttagttactttacgttaccgtgtccttcgtccttacgttagttttaccgggaccgaccgggtacccctaccccggtacgttacccggttggttaccgtacgtttacccgggttaccgggggaaccggggtaaccgggtaacccgtaaggtcccgttacggtaaccccggttaccggtacggtccgaacgtccgtacggtaacccggg
